United States Patent 12,344,895 (LONG NON-CODING RNAS (LNCRNAS) FOR THE DIAGNOSIS AND THERAPEUTICS OF BRAIN DISORDERS, IN PARTICULAR COGNITIVE DISORDERS) - sequence listing, part 6

SEQ ID NO: 4265 - DNA, 23397 bp, Homo sapiens
ccctctggttggcgagcgcctttctgcgccttcaggcatttttgctgaggcttttgtctgcgcatgtgcgggtaggttccggtagcatccgggagacccggcccaggcctggagatgctgagcggagcttggagggagagaggggactgggttgttgaggggagaatccctctcggcatctccttggcccactggggagccccattgccccatccaccgcttagaaccagacccttcctttcactctccactccctatccctaccggctttagaccttcaaagttccaagattcgaccttcggggtctccccatttcgtaggggcttacagatttcctaaaatccccctcctccccgaacccccttccgtccctggagattctggggtccctgctctttcccattcattccaccccatctacttgggacccttccaagggcaaggggggcctctcagtgcctctcctaccctcatgtcctttctcctcttttaggtccaggaggtcatctttgcctcccttccttgaaatctccccagatttagaggccctcacccagcttctcccctctcagccctgtcgaggtgtcaaggttcggggatcacctttgttgttgttattgtcgaggcgtcaaggttcgggtgtcacctttgttgttgtgtgtttttttttttttgaaactgagtctcgctctgtcgcccaggctggagtgcagtgatgcgatctcggctcactgcaacctccgcctcccgagttcaagcgagcctcctgcctcagcctcccgagtagctgggattacaggtgcctgccaccaggactggctaattattgtattttcagtagagacggggtttcaccacgttggccaggctggtctcaaactcctgacctcaagtgatccacccgccttggcctcccaaattgctgggattacaggcgtgaaccacagcgcccggcctaagccctagctgttcattgccacaatgagaggaagtacaggaaggtgttgagatcatgggcgtggagtccaactgacatgcttgactgatgtcacatactgctctgcccctgaaaagctgagtcaccttgggtaatttgcttagcctctctgagcttcagtttcactcgggagctggccaagaacacttgtctcagagttgctatgacattcgaacatggcagtgtacgtaaagggctcggcatggagcttgttctcattaagccccatggcacgtgggcatctatgctttttttttttttttttttgtagaaaaaagtttatttgctggttattgtttgatccttgaaatacaattcctcactggtgatactagtataaaatggtggttatgaatccatgctagcccaacgaaaactaatttaacaaattggtaaaaaaaaaaaaagaagtcgtttttgaatctctattaagatttgaactaatacataagcaaatctgtgctaaaactggaactgctgggccaggcgcggtggctcacgcctgtaatcccagcactttggaaggccaaggtgggtggatcacgaggtcaggagttcgagaccagcctcaccaacatggtgaaaccccgtctctactaaaaatcagctactggggaggctgaggcaggataatcacttgaacccaagaggcggaggttgcagtgagctgagatcgcgccattgcactccagccagggggacagagcaagactccatctcaaaacaaaacaaaacaaaaaactggaactgccttctcacactacatataatttgccttccagcttcaaccatctgatgttgaaatctaaagcactctcatgagttaaatgtccctgacaaaccatgtagatggacaaaccagattggtggtctttaactgctggtgatagaaaaaggctgcagtttagtacttaaacctgcagttagtggtcaactttccatctaggtagagtaactaaggagagctgtgaaatatcaaaagaaaactagaggccaggacaaagaggcaatgtcagtcaagccactgcaagctggtatgcacccttgtatttcagccaaaggcaggcaatccaaaattacagattgctttccttaacttgaccaaacagtgcattttacctctgaaagtcttgtcaagggttgcatttcattgtacctagtaaaacacaaagtccactctcataaaaatattatattttccagaagaaatattatatgtaatacactgaaaatcactgattgcttttgcttctttttttccgtgaatgtgtaggtgtttgagtctcttgtgtttcttattttacataggatatgggctgtttgaaaactatttcattagcttcatcatcgtcattcatttcagccatttcagattttcgtctctccaaaaatgttggtgtacaaactggtgtgaggccctggatatccacagtcttctcaggagtgtcaagagtgcctaaaacctttttcttcttcttatgtaaaagatggccttttgtagacgtctgacaattagtttttgaaatactttctgttttctggaaaatcaaagaaggaagaaggaaaatcataatcaattcctttttttttttttttttttttgagattgagtcttgatctatcgcctaggctggagtgcagtggcccaatctcggcttactgcaacctctacctcccaggttcaaacagttatcctgcctcagtcttccaagtagctgggattacaggtgcctgccaccatggctggctaatttatgtatttttagtagagatggggtttcaccatgttggccaggctggtctcgaactcctgactgttggggtgatcagacccaacactagactgtgggggctatgaagtccggcggagtcaaaggaatgagaaaagacaagagtgcataagatgggtccaggggaccaatgctagtatggaggctgcgaaggccgcaagctctggaagcccgcactgtttattggtgatcaaacaaagaagcaggtagtgaggatgtgggggttgaaagaaagtggtgcatcaagcgcatgatttacagctgtgacagtttagcattttctttgacgcatatggaacatgttctgctacttgagataatgggaaacatgttcttctagtttaagatacacttgatctatgagcctgggaatgctagaagcaaggagccggcaagtctagacacattccagaggccacgaggggtttcatgctctgagccctggattccatccaagccatgaggggttttatgccctgggcttagattacggtgccgcagggcagccttccaccctttagcacagagcttggtgttccaaagaccacaagggcttttagaccctggaccccggcatgttccaagactctttatattatgtcagactagcaagccctgcctcagcttttttctcactacttagcttttctccaacatgacccccttttcttttttgtaaaaccaccacagctatcattgcttgttctcgatggtggctttctctccagaggtggcttccgcatctgcagactaaaaggagacagcacaagcacataattattagaacaggatttccaagtgtagagttttcaatggccttaatccgtttaagaggattgattgcagacaacccattggctgtcttgttcaaattatcagttccagggagcagggctaagtgagtctgagaggcttcaaaatcctgctcttttagttttacaatttagagggtgagattttcctctctaccctctagatggcgtttaaccttcttccatcagtgttctgtctcattgtaactgaggagtaacacaaaagtcagatgtattccagtcacattgcatttgaattctactttctaaattcataatacgatctcccatccaaatctctgtctgacggagatcattaatttggttaactattttttttttatctatttgagcttgggagttccataattttgtggaattcttttgccacttattgacaaattcagcagttttcacagatgaatgtacagccacaccggctattgcagcggtagtagtaacagcaatgaggccaattatagcaaagaaaagagcaactataaatctttgggataagagttttttaaggatttagttacaatacgaatggatgatgatgcctcccatggtctatttagagacacatagggatccaaactccttctctggctttaattatcaggatagtctgatttttattaaaagttggtaacatttcctgttgctagcataaaagatggccgaacacagctttgaatccaaaaggtcctgttggaaagaaaagagagagcatatttatttttacctccctcccctctataccttttatatgtaccctcccaacttttgattgaactttcagccatagctaatttccataattcagaatgttcctgtcttatggcaggagatatcatttttggactaggggcaacaatgccagcaggactctatatgataggggcattagcttccgtccgaacatactgtgtatgattcctttgccagcgattcctctggtttactacatttgttctacaagaaggccttccggtgcaattttccttaaagatccccttaggggactaatcaatggtgattccataggaattattttgtagcacctcagccttacttgctatacaatcttcccaagttcaagcatccacaccttcaaaccaaactttgcttcgctcacattcacgcttattaggatggaacttcagggttttaggattggaataattatattttaaactactcccccaaatcatatgcaaagcagcctgtgatttattttttccggggactactgccaaccaagcttgtgtgtcaatctgtaagcatccaacaacaggtcccaggcatatgggggatatttatatcctatagatatattcattttatcatcccttcctcattaggatgcattggcccttattcagaatggagtcgttctggtttgaatgcttcttacatatttccactttcccttttacaagaggatccttaatcctaaggcttgcagaaggatgaaggtccgtcttctgcaacttcttcatgctgaataggggtgatgatattcctgcctaactattagggtctcttgtattcaggtagagaggagctcagtcagaaagcattggtccgttaagcatctattgtacctctgaatcccagcaaaaggtacaaccttggtgttccagcagtttttcagcttcctgtgtggtttttcttgatctgtccccatgttatgggggtggatgtcagcatgactccggtcggtcctcgttccgtcttcgcattcagactcaactggctcatggcttgtactgggggaaccaggtccacggttgggatccatggatctctccagtctcccattccatggtcgtacacatcttgagggcatccgcacggtttgttcatctcctgcaaaaacacaagcataccctcaaagccatgttagtaaatctagcgaaacagaagcaaaaacttttgtggctgtagccgggaggcatgccattgctgaagcatttgttctacaagctgtaactcagcttctgcctctgtggttaattaccatggggtaaaactttccactgataatgagaaacaggccccttctaacagaaggcacagaaaaagcaaatcgaggcttatccttcttgtgcaacagtatagcagaaaagcaatccttaagccttcaatttgcactgtacaggtgggtccactagatgctgtaactgatgatacatcttcggatgtttggtgggcaccacacaggcacctgactgtcacctggagagacacaagcaaatcctcttccccatataattatctttcctttttctcagctctttgtatgtgcttccctccaccatatatcttgtccagactttttattttccttttctacattccttttttgtgtgtccaaattgcccacaattaaagcaagagcctgagaaacggggcacattccttcctactttcaatccagccatagcctgagctaaaagaggagccctatgcaaggtatctccaatgccatcgcaagccccagtatattcagccaaatgagccttccctctcataggtctgatggcagtttgacactctgcatcagcattttcatatgcaggaagctgtattacaacatcctgagctgttttatcagttatggctttatacacagcctcttggagccaagcaataaaatcaatatatggttctttaggtccctgtcggacgagctgaaagaaggatatttttccgctgtaacatttatcctttcccatgcccgtaagcatgcagggcacagctgaacaatggcaacatcctccattactgcttgattttctaatctaccccagttggggccaactcccatgaactgttcaaaggaaacaggcacaggtggctgcgcttgtgtgttttcccttgcctgagtttgagcttcatcagcccaccaagttttaaactgtaaatactgagacggagtgagaacagattttggtaaagtatcccaattatacggtattaacctagtatcaagagccacattttttaacaaagtttgcacaaaaggaaagttcggtccatattgagtaatggcttacttaaattcctttaataacttaaaaggaaaagtggcccaattagttatattctgtcctccttgctggattatagtaactggaaattgccatgcttcaaggtcttcctcagttctagctttttttttttttttttttaacagagtctcgctctgttgctcaggctacagtccagtggtgcgatctcggctcattgcaacctctgcctcccgggttcaagcgattctcctgcctcagcctcccgaatagctgggactacaggcgcacaccaccacgcccggctaatttttgtgtgtctttagtagagatggggtttcaccgtgttagccaggatggtcttgatctcctgacctcgtgatccgcccacctcggcctcccaaagtgctgggattacaggcgtgagccactgcgcccggcttgctctagctttttgaatagaattttgcatagcaccaccaattgctccaggttttaatgttgcaactacaggagcagaaaattttatagctaattcactttctcgcccattaaggggaaagggaggaggtggccattcacttaattcagcaggtagagccgatgggctagtaaaatatacttttttcggtttccccttttttaacctcttctcttttttgctccttgcattcagaatctgaagttagttttttacactcgtcctcctcttcctcatctgaatctccctcatcatctgtttgaaagggctcaagggctgcctttattagtgcccacattgaccaaacggaaactggaatttttgctccctctttatacgcctttttaaaatctctgccagttctctcccattcatccaactccatagtcccttgttctggaaaccatgggcaaaactgctttactgtactaaagagtgataacaaattttgagtactaactttcactgcccctttttgtaataaatgccttaagaaattcagataagcagaatgttcgctttcactttgtctgattgttaccctggttcttctgagcactcagctttcccaccgagcttctttcagtcatcctcgggtgtcctctgatgatacttcctccactttcatgtcctctagcgttccttcaccgggatcttcattgtcccatgttgggcgccaggaatgctggggtgatcagacccagcaccaggccatgggggctacaaagtctggcagagtcaaaggaatgagaaaagacaagttaaaagtgcataaggtgggtccaggggtccaacactagtatggaggctgcgaaggccccgagctctggaagcccgtactgtttattggtgatcaaacaaagaggcaggtggtgaggatgtgggggttgaaagaaagcactgcatcaagtgcatgatttacagctgtgacagtttagcattttctttgaagcatatggaacattttctgctacttgagataatgggaaacatgttcttctagtttaagatacaattgatctatgagcctgggaatgctagaaacaaggagccggcaagtctagacacattccagaggccatgaggggttccatgctctgagccctggattccatccaagccacgaggggttttatgccctgggcttagattatggtgccacagggcagccttccaccctttagcacagagcttggtgttccaaaggccatgagaggttttagaccctggaccccagacatgttccaagactcttttacattatgtcagacatgcaagccctgcctcagcttttttcccaacactcagcttttccccaatacctgacctcaggtgatccacccaccttggcctcccaaagtgctgggattacgggcgtgagccaccgtgcccagccagctaatttcttcctgagtaatctttatttctttttaaatcactcctcatctgtagcttttgtgttagtgtccgattctgattataccatttcgctgatggatttgatggctgcttaaatggaatattccagtgtttaaagagttctttatgtacttttccaggtggcataaaatgacactccaagagtctttcaccaaacaggtagttgttcattgtttcagcaactatcttggcaacatcctcagactcaaactccacaaatgcatagcctttgccatttccagtcattttacttctggacagtctgaactgtgtcacagtgccaaactgggagaaatatgaaaagatctgggtttcgttaagtagggttgttcttgttttttttgctgggttatgtgcttgcaaacctgcgccacctccttttgaaactggacatcttcctgcgggttaagcagtgagatctcagccaggccagaaaaagctgccatgccaaaagcggccgacactaactccacgcggtgctcctggaaacgtcgggctcccagctcccatgaggcagaaaacgggcatctattcttttaacatacgtatgtatacacagtccaagtgatggaacatcaggatcagtggcagctgggagggtgggggaggcagcaccacctgatatttaggagggagaatgaccgggagttgccgatacgtggagtgagggataagtcagagttgttcctaagattttgagtttgggcaatggtggcatggtaagctaagatcaaggatatgaagggaagaagggctttcaggctgggagcatttaggagagcatgagaggataatgcatgtgttttggacatgaggtacttgcagggtgtccacatacagatgtctgggaaacaatagatgcaggctgggtgtggtggctcacgcctgtcatcctagtcgcctggatagctgaggcaggaggcctgcttgaggccaggaatttgagatcagcatcggcaacaaagcaagaccccatatctaccaaaaaaatttaaggtcgggcatggtggctcatgcctgtagtcccagcactttgggaggctgaggtggatggatcacgaggtcaggagttcgagaccatgctggccaacatggtgaaaccctgtctctactaagaaaaaatacaaaaattagtcaggggtggtggtgcatgcctgtaatcccagctacccaggaggctgaggcaggagaatctcttgaacctgggaggcggaggttgcagtgagctgagatcgtgccagtgcactccagcctgggaaacagagggagattccatctcaaaaaaaaaaaaaaaaaagtcaagaagaaataaacgtggtgctctctggagctggaggctgttgatgtaggtgtgggaattaccacttgggagagttcatctctgcctgtttcaaaatccatcgtgagcattgccagtgctttcttgaagagctctcatgagcgtggggcaggattggtgccatcttcatatcacaggctgtcttagttcatttgtgtggctatagcagaataccacaaactgggtaatatttaaataataaaaaagtacttctcatggctctggaggctgcgaagtccaagatcaaggcaccagcaggttcagtatctggtgagggcctgatctctgcttccaagatgtgcctctcttatggaaggtggaagggcaaaaaggggccaacactgcgtgaagcctcttttatagtctaaatcccattcatgaaagaggatccctcatgacataattacctcctaaaggccctgtctcttcatattattgcattggggattaagtttcaacatgaattttggagggacacaaactttcaatccatggcagaaactctttgcagagccattttgctgcaaaaacttgagggtgggggtatgacttatttaataaagatgacattttctgtataaatgatacctaagtcctcctcattagcaaatgtcgaataggacattttctttttttattattattatactttaagttctagggtacatgtgcacaacgtgcaggtttgttacatatgtatacatgtgccatgttggtttgctgcatccattaactcatcatttacgttaggtatttctcctaatgctatccctcccccatcccccaaccccaccacaggccccggtgtgtgatgttccccgccctgtgtccaagtgttctcattgttcaattcccacctatgagtgagaacatgtggtgtttggttttctgtccttgcgacagtttgctcagaatgatggtttccaggaataggacattttctttctttttctctttctttctttcttctttttctttttctttttttttttttttttttttttttttgagatgcagtctcactctgttgcccaggctggagtgcagtggtgcaatcttggctcactgcaacacccacctcctaggttcaagtgattctcctgcctcagcctcccaagtagctgggattataggcacccgccacaacatctggctaatttttgtatttttagtagagacagggttttgccatgttagccaggctggtctcgaactcctgacctcaagcgatccacccgccttggcctcccaaagtcttgggattacagccgtgagccactgtgccccgccccgaataggactttttctgttgcctcttaaatggtttaaagagggcagccaataatggggtcagaaagcttctctctgcctagcttcccaaaaaaacaaagctgccagctggctgttggacaggtgagaagtctttggtgagatgcttcatcatcctctctttcctgaactcttcacgtgtaccagggctctggataggagggggtgctccaagaaaatgtttaggaaagactagggtttcctgatagaatgggaggaatcaacacactatctccccattgggtgtctgtgtgggcagccaacttcttgctgtgccctgcatctccctgcgcaggggagaggagcattagagaggaaaagctgggggcaacgaggagcttggggcagtgtagcctgcactccacagtccagcatggttaggatgtgtgggtttctgagtcctttctggctactataacaacaataccataggctggatgggttgtaaacaatgaaaatttatttcttatagttttagaggctgggaagtccaagatcaagatgtcagcagattcagtgtctgatgtggactcacttccaggcttacagatggtgccttctggttgtgtcctcacttggtaggagggacagctctctggggtctcttattaagggcactaatcccatttatgagggcaccaccctcatgacctaatcaccttccaaaggtcttgacttcaaatatcattacattgggggttaggaattcaacctagactttggaaggacacatacattttgtctatagcagggggtggatggacacgaaggagggtagctgggcttctgcaatctaggtgatatgtcacccaagaaagcggtaagaggctgcatggtgtctgccaatggtggaattggagaaggtatgggagaagcaggggacacaactctcatatcaagaaacagaggaggctgggcacggtgactcacatctgttatcccagcactttgggagactgaggcaagcaaagcagttggggtcaggagttggagaccagcctggtgaacatagcgaaaccccatctctagtagtaaaaatacaaaaattagctgggtgtggtggcgcgcacacgtgtagtcccagctactcggaaggctgaggcataagaatcgcttgaacccgggaggcagagtttgcagggagccaagatcgcaccattgcactccagcctgggcagcagaacaagactcttgtctcaaaaacgaaaaccaaacaagcaaacaaacaaaaaaacatgattgactcagtgatcagaaaacatataactattttatattcatacttcctgcagttaatgtcccagttgactggttaaaaagaatatttgggggccaggcgcagtggctcatgcctgtaatcccagcactttgggaggccgaggcgggcggataacaaggtcaggagatcaagaccatcctggctaacacagtgagaccccgtctctactaaaaatacaaaaaattagctgggcgcggtggcaggcacctgtaatcccagctactcgggaggctgaggcaggagaatggcatgaacccgggaggcggagcttgcagtgagccaagattgcaccactgcactccagcctgggcgacagcgagactgtctcaaaaaaaaaaaaaaaaaaagaaaaagaatatttggcaatacggaaagttccccttgggttttctgactccaagcctggtgtttttgtttgtttgtttgtttgttttcatttgcacaacattgcctttccccaagagtactggataacaatgccctccctccaagtcccaagtcactattgcagaagtcaggaccttaacacacacatttcaaagttactgacacctagtcaaacctggtgccttagcaatgcaatcttgtaatttcccaggtcaaacagatcttcaagggttgctctcatggcagaatttggtggtagaaggaaggaagcagagtctcagtctttgtgcagcttgtagggagttccctttttctcaagcccttgcagcatccttcccactctaagcttaaaggagactgtgtaaccagcagtgctcacccatcctgggcctgagtttgaatcccagctctggagttcagctgtgtgacatgcaagaccttgtccctctctgaagtccttctgtaaaatgaggtggctgcattgggtgatcccattccacaccatgagtctatagtcctatcatcctgggtataccgacgtctggtggccaactttggtccttgcagctaattcaggttttttctttgtttttgagacatagtctcgctgtgtcacccaggctagagtgcagtgacgcgatctcagctcactgcagcctctgcctcccaggttcaagcgattctcatgcctcaggatcctgaatagctgaggaatacaggcacctgccaccacacctggctaatttttgtatttttagtagagacaggctctcgctctgttgctcagactggtctcgaactcctgagctcaagtgatccgcctgcctcggcctcacaaagtgctggattacaggcgtgagccaccgtgtccagctcagtttttaattttttatttttcagtatctggagtgtttagcacagccaggaaacaaaacacaccagagagggccaccttgccatgtcaccaacgatgcaataactaccgaagaaaggccccttgggtggctatggaggagcagaggtcagcagaggagatggccagcaaagtgctctcctttgctctatttcttttcttttgagacggagtcccactctattgcccaggctggaatgcagtggcatgatctcggcttctgcaacctccatctcccaggttcaagcaattctcctgcctcagcctcccgaggagctgggattacaggtgcccgccaccacacctggctaatttttgtatttttttaggtgagacggggtttcaccatgttggccaggctggtcttgaactcctgacatcaggtgatccgcccacctcagcctcccaaagtgttgggattacaggcgtgagccactgtgtgattcttagcatgttgtaagtttgtcattgttccatttccaaagcattccaacctccatccccgcatgcgtttgcacttctttagatttgtgggtctgagagcgcattagcaccccatccacatgcagtctcctgcccttccaatcctcaccctgaaaaccttcctgtagtcacagacctagtcatttttcccacggctactcttgaactctttatggacctctgcgctcgcttcctcttctgtgaaaacaaatgagtttatgtagattaagatctagccaacttctgtaaaggatcagatggtaaatattttaggctttgcaggctagtgactcaactctgcatgaaaataactgcaatgtgtaaaggaatgagcatggttgggcaccacactgaaatttgaatttcatctccttcccaggggccccagaagagtcttcttcttcggactttttccccaagcatttaaatgtaaaaacatttctagcttgcaggtggtatgaaaataggcagcaggctggaggtgactgaggagcctatctagtcttttttttttttttaaacagagtctcgctctgttgcacaggctggagtgcagtggcgccatctcagctcactgcaacctcggcctcctgggttcaagcaaatctgcctcagcctcccgagtagctgggactacagttgcgcaccaccacgcccagctaatttttgtatttttagtagagacggggttttaccatgttggccaggctggtctcaaactcctggcctcaagcgatccatcagcctcagcctcccaaagtgctgggattacaggcgtgagccactgcgcctggctgtatctagtcatctttaaagaccctcccatctctgagaacccatgaaactgcgcagtcctctggactggagctggggtgtgtcaaaggcaaatctttgcctgccttctcagaacaccatattcagagaaggccattcaggacagatttgtcaggctgttccgaatgcccaggtctgggatgagatggcctatccatggaggatttttattttttcgagacagggtctcactctgttgctcaggctggagtgcagtggtgtgatcttggctcaccacagcctctgcttcctgggttcaagtgatcctcctgcgtctgcctcccaagtagctgtgttacaagaaaggggtcctgatctagaccccccaagagagggttcttggatctcacacaagaaataattcaagacgaggcggtaaggtgaaagcaagtttattaagaaagtaaaggaacaaaagaatggctactccatagacaagagcagcgcctagagctgctggttgcccacttttatggttatttcttgcttatttgctaaacaaggggtggattattcattcctcccccttttgggacatatcgggtaacttcctgatgttgccatggcatttgtaaactgtcatggtgctgtcaggagtgtagcagtgaggacgaccagaggtcactctcgtggccaacttggttttggtgggatttggttggcttctttactgcaatctgttttatcagcaaagtctttatgacctgtatcttgtacggacctcctgtctcatcctgtgacttagaatgcctccactgtctgagaatgcagcccagtaggtctcagcctcattttattcagctcctattccagatggagttgctctggtttaaatgtctgacagctgggactacaggcacacaccaccaagcccagctatgttttgtattttttgtagagatggggtttcaccatgttgcccaggctggtctcgaactcctgggctcaagcaatccacccaccttagcctcccaaagtgctgggattacagacacccaacccatttggaggattttttttttgagatggagtctcgctttgttgcccaggctggcgtgcaatggtgtgatcttggctcactgcaacctccgtctcccaggttcaagtgattctcctgcctcagcttcccaagtaggtaggattacaggcgcctgccaccatgcccagctaatttttgtatttttagtagagacggggtttcaccaagttggccaggctggtctcgaactcccgacctcaggcgatctgcccacctcaacctcccaaagtgctgggattacaggcgtgagccactgtgccctggccagatgtttttttaaaagagagagaaagagagagagagagagaaagagagagagagagggagagaaggaaactttgcactctgttatcttcaacctcttactctaccttcctccctagccgaagtcccagtcctaaagcctaagagaccctcattggaacttgacttctgcataatccgcctgggtgcccttgggcatccgggcctcaggcctgggtctgacgcctgggaagttgagcgtggcataatggagctcctcttggctctcctgggattctggggcttgagtggatgatttgggttctgggaaactgggcaactgatactgctttttctggttcttctttgattctggggagggagcacctggtggaagaggggtccgaggactgtttggtgtggctttctgattccgcttctgagcctgagggaagaaccaccatccttcattcattcattcagcaaatatttgagcacttaccacgcgtcgggcactgatttacagcacagagtgaaactaagtccctgcccttgccttgctgagcttgcattccatcttggaaggaggaacagacaataattagcaaaagtacaatgactgatgaagtttcgctcttgttgcccaggctggagtgcagtggcatgatctcactgcaacctccacctcctgggttcaagtaattctcctgcctcagcctcccgagtagctgtgattacaggcacccatcaccatgcccagaggtatactgcgttgatcacgaccttcactctttcggcctgcaacacctcccctcttcctgggtccaggccccagaccccgccacgcctcctcttaacctacatgatcagggccaggcagaggaaaagaagagccgtgatgccgattcccagaaacgctccgttggagaatgccgttgagatgagtcccttcttatctgcacacggagagggcaaggaaaccctgccacaccccggcccaggtgttaggacttcccattgtgttttcctgtctacatacagatgccacgggtctgctgtgtccctccaagctcctgctccaaccacaggaccctactctttgccccagtcagcttctcctccaagaaccttggcatccaggcggccccctaacctggcagctgcaggatggatccactctgggccccatggacgttccaggcctcacagcggagcctgaggccggagctgagccctccatggaggctcagggagctgttggcccagggcccggctgagctgggggtgacctcgaaggagtcctggctgctgttcccctccagcagctcctccccaagccaccagcgcagagagggggccgggctggcctgggaggagcagctgcagtgcagaccctcagcctcccaggagcaggaggggcccagcagcttcggggagtctgaggggagggaggacaggactcagcagggtccccttcctgggacccaggtgtcccctttcccccactcacagtgcacggagaggctgagagagacgtgctgggagcccagtgggtgccgagcgtggcaggtgaactctccttcgtgctccacttgaacccgaggcagctccaggaccccggggtctgagggctgggaggggctcagaacctgtcccctctgggtccagctcagcctggctggggggctgctgtgtgtgacacagaccaggcacaggctttggccctccagtactgggagagacgtgccgttcccaaggttttccaggactagggaaggaagaggcagaatcgatgagcagctcagggctcagggaccctcctgcgtggggaccctccagactcctgggcccccaattcggcactgagaggccttggctcctctgtcccctttcctacctgtcctgtttgcttgggaaaccatcactctcaggttctctggaggatctgaaatggagacaggggaccggctctagacggaccaggggcttccctctgggtaaagggaaccatcctggacactgaggtgggggaagtgggtgggatagaagggcagggcagaatcacccactgagtcccagacacaaactgcatgagggtctacacaggtaagaaggtcggtctccgaggcctggggctccaggccccctcagctctgggaccctgagcccagcccctgtatccctctgccctcccaatggactccaggcccctgctgggcacactcacactgcacagagaggtccagggctcgctgctgggagccaagcctgttctccgctcggcaggtgtagcgccctgaatccccagccttcaccccgggcagctccagccccaggggtctagggccccagggatgggacgaggagaggactctgttctgcaggacccagctcagtgtggcagggggctggctgtcagcagcacagaggagccgcaggaactggcctttttgggcttccaggtatgggacatttccctggggctggggctccagggctggagtgggaggaaaaaaaaaaaagagagaaagggagggagaaagagagaaggggtacagggaggagcacatcccctcatcccctgaagccttttcatctaaagacaactggcccagccccagcccgacggccctcagtacctggcgtgttgtcacgtgaaatgctgataacaaggtctctgggggcatctgcaacaagattgtgagctggcttcagggagggacaatttattcctcacacctggaaaaaactccctcagggaaaagaaagtgggactatcccgggaagacaagtgacaaccagcgccagggctcacgtgtgtggaccagacgccattcccatccccctcccagggctgcggcggcatcctgggaccccacagcttcctctccctggatgctcctgagctgggagccgctcactgtcccactgggctcctccacctccccacccaccggggctgtctgcacaccccaccctcccaggccacactcacaggccacacggagtcggacggtcctctgtgcgctcacaccctttctggagaagtccacatggcaggtgaggtcggtgttgtggtcctggggtctgggcgtgaagctgagcactgagaagtgggaggtcgttggtttggttccttgggaggagagggcagcccccgtccaggagaaagaagggggtggacattcctcaaaggcccagttaaacacacagatgaccgtcaccggctgcccgggctccagggtctcggggatgtagacatcaggcttctgagtcagggctgggacagagaccgtggtgggagattcttgtgctgcaggggtccctgagagccctctctgctcagcccataggctgtccccagggtccctccccagtgtgagaggcaggggttcccaccccattccatacctgttacttttagaaagaacccatcgttcatgaaattatatctcacatagcttcctctctccacccgaaagaagtactgtgactcatcctgcatctgcgcgtctctgatcaccaaggagcagttccccttggcgggatccccagtgagctggaatcggccccgggtgctcatttccacctctcgactctggtggtttgtggccacaggagcacccttggttgtctcagtcactgctttgaaccagtagccataagctggggtagaccctgtccagtcctgtcgggggtaggagaaagagcagggcacagagatgcacaggccctccggcaccatcactgactcctgcactcgtatccagaatctcccatccatagcctgggaccctgtggggagacagaggctcaacctgcaaccccagccctagctccgccccaggtcctttccggcccttggcccactcaccgcccagcagcgaggacagcagcagtggcagtagcatctccgcataggaggcgcagggcctgcctgagacaggcctgttctctggtcgtgctgtgagtggctcagggctcttggcagaaggggaagccgaaggcggaagctgagccctggggcctgatgcatgaaatgagcttcagacgctgagctcacagaactcctttgccttcccccacactctccggcccaccttgcccagttgtcctctgggtctcctgggggcccagcctggccttgggcttgttgagctggtccttccagagctccctgtgtaggaggagagggcaggcttgtgtctatcctgggggcctggctgggggtggggtagtggggtgggggctctccctctgggccctgggtcatcggaaaagcagaagtgagaagtccacagtgagctacccttatctgggccactggtggtggaggtggtgggtacaggggaagggaccgttactggagggggctggtcttgtcaggtaaaatgcaggatgcctggttaaagctttcacagacaatataaagtattttattttatgttttttggtataagtatgtccgaaatgctgcatgggatatacttataccagaaagcaaaataaatttatctgaaattcaaattaattaattaattaattatattttgagacagagtctcactctgtcacccaggctgcagtgcagtggtgcaatctctgcttactgcaacctccacctcccaggctgaagtgattctcctgcctcagcctcctgagtctgggcttacaggcacgcgccaccacgccaagctaatttttgtatttttagtagaggtggggtttcaccatgttggcagggctggttttgaactcctgacctcaaatgatccacctgccttgacctcccaaagtgctgagattacaggtgtgaaccaccgcacctggcctaaaattcaaatttaactgagcatgttgaatttctttttttctaaatctggccaccgtagggtggtgtcagctccacctcttcatgcttcctggtgagctcactgacccttggtccccagaagcagtctcctgccccaaccaggccctagtccacttcccagtctcccttcctcctctgtcattcaattgggacacccattgggattagaacacatatgtccaaagctaatgctgatgggaagagtttgaggaaggcgggagtgaggggcagagtggggggaacagactagggaaggggtaatttgcaatgaatggagtaaactctacaagatgttttcccctcactgagctcttcctgaaatgactctgtttgggtcacaccgaaacacagaactcatccttcaacctccacataccttgggtatcaagcactgagctttagggggacttggaggtgaatcctccatggtgagtcagctccagggccccaggttagcaaatgaagattcttagaaacaaagtacagaaggtcccctaaatgaactggatgctggacagacattcaggatgggacctggggaaggagtggtcagctcttcctggtggagggaagtcaggagaggcctcctggaggagatgacccagcctctgccctgtcctggttctttcatccatggcatttttgttttttgtttttgagacaaggtcttgctctgttgcccaggctggagtgcagtggtgtgatcatggctcagtgcagcctccatcttctgggctcaagcgatcctcccacctcagcctcccaactagccgggactataggcacacaccaccacgcccagataatttttgatttttttttttgataatttttgtagagacagaggtgtttgtttgtttgtttgtttttgttttttgagatggagtttccctcttgttgcccaggctggagtgcagtagcatgatcttggctcactgcaacctccacctccggggttcaagcgattctcctgcctcagcctcccaagtagctgggactacagacatgcgccaccatgcctggctgattttgtatttttagaaaagatggggtttcttcatgttgttcaggctggtctcgaactcctgacctcaggtgatccacccgcctcagcctcccaaagagctgggattacaggcgtgagccactgcaccttgctgagacagagtttcaccatgttggccaggctggtcttgaactcctgggctccagtgatcctcccgcctcggcctcccaaagtgctgggattacaggtgtgctccacggcctcatccactgtatcagtcgcttgagctgctgtaacagcgtgccccagacagaggggctgaaacaacaacattgacttcctcacagttctgggactagacgtccaaaaccaagatgtggttccttcagaggcttctgcctggcttgcagatgccacttctccctgtgttctcacacagctgttcccctgtgggtgtctgtttcctcaactcctgctcttataagaacttacaagaactcaagtcatattggactaggcccactctagtccaaatgagtgacctcatttcagccggccctcagtatgcacaggtcccacatcccggaattcaaccacctgcccatcacggcatttaaatacaaaaccaacaaaagccaacataaccataaaaaacagcatgaattaaaaatacagcataacaactatttacaccgcattacactgtattaggtgtgataagtaacctggagatgggaggatgtgcagaggtcccacgcaaacactactgtataaggcagctgagcattgtagattttggtatccaaggggtggggatcctggaaccaatccccaactaatacagtggaacaactgtatctctttaaagactgtctgcatgtacagccacattcttaggtactggaggttgggacttcaacacagaaatttggtggggggaggggggacacaattcagaccctaatatccacctctccccatttttttttttttttttttgagagagagtgttgctctgttgcccaggctggagtgcagtggcatgatcttggctcgctgcagccgctccctgtctgattcaagcgattctcttggtgcaggctcacgagtagctgg

SEQ ID NO: 4266 - DNA, 15043 bp, Homo sapiens
tcaacaacacattaaagttggggtgcagtgtcccaggttcactcaacccttcccgttttcttgtctgtgtgtgtctactttgctctgttccctggtggcagcggcggtggcaatgttggtgcatgggcctcctaggacaaggggaaagtgagtatgcccttttcttgcttcctgccaggcatctgcagcctggcgcaagctctggccaggtcttcaagcaaggtacctggagatgttcttttccaatttctggattggtaacttgaggcaaattctgggcactagagtcaggactaagatgagacttgaatcaggggagtctggggtcctgagaggcagaggcctgaaaccatctagagcatgtggggacctgggtgtgtgttcaggccagttgcctttctctgtgcttcaatgttccaggtacccttggagggactgagatcctagggattgctggagcctggctgcatggcctggccaccctgatgcgcttgcattctccgtgacaggacagcaaggctgaggagaatggctcccacagcttcatgcactccatggacccacagctggagcggcaaatggaaaccacccagaacctggtggactcctacatggccattgtcaacaagaccgtgtggaacctcatggttggtgcgaagcccaagaccatcatgcacatcatgatctacaatgtgcatgcaccgcctcatggggaccaaggagttcatcttctcagagctgctgtccaacctgtactcgcgtgggaacaaggagacactcctggaggagtcggcagagcaggcacagcggcgcgacgagatgctgcttctcagagctgctgtccaacctgcactcgcgtgggaacgagaagacactcgtggaggcgtcggcagagcaggcagaccaaggagttcatcttctcagagctgctgtccaaactgcacttgcgtgggaacgagaagacactcatggaggagtcggcagagcaggcacagcggtgcgacgagatgctgcttctcagagctgctgtccaacctgcactcgcgtgggaacaagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagcttctgtccaacctgtactcgcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacaagatgctgcttctcagagctgctgtccaacctgcactggcgtgggaacgagaagacactcgtggaggcgtcggcagagcaggcagaccaaggagttcatcttctcagagctgccgtccaacctgtcctcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagcggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcttgggaacaagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagacctgctgtccaacctgcactcgcgtgggaacgagaagacactcatggaggagtcggccgagcaggcacagcggcgtgacgagactcgcatgggaagaagaagacactcctggaggagtcggcagagcaggcagatcaaggagttcatcttctcggagctgctgtccaacctgtactcgcgtcggaacctgcagacacttgtggaggagtcggcagagcaggcacagcggtgcgacgagatgctgcttctcagagatgctgtccaacctgcactggcttgggaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaagaagttcatcttctcggagctgctgtccaacctgtactcgcgtcggaacctgcagacactcgtggaggcgtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcacgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtggcaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatcttctcagagcttctgtccaacctgtactcgcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcatgggaagaagaagacactcctggaggagtcggcagagcaggcagatcaaggagttcatcttctcggagctgctgtccaacctatactcgcgtcggaacctgcagacacttgtggaggagtcggcagagcaggcacagcggtgcgacgagatgctgcttctcagagatgctgtccaacctgcactggcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacaagaagacactcgtggaggcgttggcagagcaggcagaccaaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatgtaggagtcggcagagcaggcacagcggcgtgacgagactcgcgtgggaagaagaagacattcctggaggagtcggcagagcaggcagagcaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcatcggcagagcaggcagaccaaggagttcatcttctcagagctgctgtccaacctgtactcgcgtgggaacgagcagacactcgtggaggcgttggcagagcaggcagaccaaggaattcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggcagagcaggcacagcggtgtgacgagactcgcgtgggaagaagaagacactcctggactagtcggtagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacgagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcatcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcacgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacaagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatgtaggagtcggcagagcaggcacagcggcgtgacgagactcgcgtgggaagaagaagacattcctggaggagtcggcagagcaggcagagcaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcatcggcagagcaggcagaccaaggagttcatcttctcagagctgctgtccaacctgtactcgcgtgggaacgagcagacactcgtggaggcgttggcagagcaggcagaccaaggaattcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcggagctgctgtccaaactgtactcgcgtcggaacctgcagacacttgtggaggagtcggcagagcaggcacagcggtgcgacgagatgctgcttctcagagctgctgtccaacctgcactcgcgtgggaacgagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcatcggaacctgcagacacttgtggaggagtcggcagagcaggcacaccggtgcgacgagatgctgcttctcagagctgctgtccaacctgcactagcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcgtggaggcgtcagcagagaaggcagaccaaggagttcatcttctcagagctgctgcccaacctgcactcgcgtgggaacaagaagacactcgtggaggcgtcggcagagcaggcagaccaaggagttcatcttctcagagctgctgtccaacctgcacttgcgtgggaacgagaagacactcatggaggagtcggcagagcaggcacagcggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaaccagccctcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagtaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcacttgcgtgggaacgagaagacactcatggaggagtcggcagagcaggcacagcggtgtgacgagactcgcgtgggaagaagaagacactcctggaggagtcggcagagcaggcagacgaaggagttcatcttctcggagctgctgtccaacctgtactcgcgtcggaacctgcagacacttgtggaggggtcggcagagcaggcacagcggtgcgacgagatgctgcttctcagagctgctgtccaacctgcactcgcgtgggaacgagaagacactcgtggaggagtcggcagagcaggcacagcggcgtgacgagactcgcgtgggaagaagaagacactcctggaggagtcggcagagtaggcagaacaaggagttcatcttctcggagctgctgtccaacctgtactcgcgtgggaacgagaagacactcctggaggagtcggcagagcaggcagaccaaggagttcatcttctcagagctgctgtccaacctgcactcgcgtagggacaagaagacactcctggaggagtcggcggagcaggcatagcggcgcgacgagatgctgtgcatgcaccacgtgctgaaagaggctctcagcatcatcggcgacatcaacatgaacaccatcagcacagctacgggggcccgtggacgactcctagttgcagaaattcaaattgattcagttgaactagcattttaaaattctatgtttctgatgaactctaaccttccttctaagcaaatcaaaagctgcattgtactgaatgaggaagagcacaaatacttggctcaatgaggtatcgcaaaagactgtatgcactttgaagaaagacaaccaagcccagcgaaagaatggcatacgggagttgctgcacaagcctgggtgctccacgctgtcagtgaggctcacctcacaaagatctttggagagaaggaggtggggatccgagtgcagtgagagcctcccctgcccctgcctgcccaccctgcctgaggactctactcaccaccatgcttgtcagcacccacaagctcctggggggctggggctcctggaccaggctcatcagcaagcttcagggcagtggccgggaaatttgctgtgtccctcgttgtagtcaccacaagccacaacatcgtctccagcagctccagcagcttcacctggaagggaggggtgctcagctgttatgcatctaccggcgcccaccctcacgcccacccccacccctgcagagatgttgcacaccctaccttcatctcttccttgtcctggaccagcctgatgatgtcctcctccagttgccgcatctttggtactgccccctggctctgttcaaaggtgatgaactttcctgtgggaggacaggactctgacgctgaggcccctccaacagccctgcagctcccgctgccgtgccctggcctcccgctcactgatggcttctgtctttccagtactggatgaatcaaagttctagcttctccactcgctccctcaggtccgccttctcctccaggaggtccataaggccactctggagccaaaataatgggttcacatctcggcagtgacctgccccacccctgcccttcttggtccatgccaggactcactcacctccagcttctccatgacctcctgcatagcctggtgggtctccccactcacagagtcacccccagtcactggggctgggaccgctgcctctggcttcttctggactgaggccaccaggtgagccatgcgctggcagcacaccctctgctctttcacctgctctcgtaaccgtgcctgctcctcctgggcattggctccagcggagttgaaaaatgcaacctgagggcaagaggtgagcattattgtagaggcatacacagaacaaacagggcagagaggtggagtgcagccccttcccttggggtctcagagagtgcatctgttggtcacaggtgaaatggtgtctgaccactggctcccggaaagggtgagtgtccagagaaatcagaaggcagggaaaccaagagcataaaggggtcttggagggaccacagagggaggtggcaaaatgggtacagggggagtcaggctcaccgtggcctcccagctctccaggtgctccgggttgctcggcatgggccgaggtgcctcctcctcctcactgtccagatgtcctcctccatctcctgtggggggtggccagaagggtcctcagacaacccaacaaggggggtactgtgggcccaccgctgcctccaccctcactgtgtaaccctgagccagccactacccagagagaaatgagctgctgttctttatttttacttttaagaaccaagatcaggcataatcccactacggtcagtgcgggagttctgacctgctccctttctgacctgggccagttcagccatccttaggcaacttggtggccccctgctcccaggaggtcaccatattgatgctgaacttagtgcgggcacccggtcggcataaggaccagctgttctaaaggtctcttccatct

SEQ ID NO: 4267 - DNA, 649 bp, Homo sapiens
cagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaa

SEQ ID NO: 4268 - DNA, 4238 bp, Homo sapiens
catccttttccgccctcatggattggtggttggtatcagctgctccaccttttctaccatttactgaacgagttgaggaaaaagggaaggagtctcgtctttacatccttattttctttttttattggttggcacctatgccactcacgtggtggagaggcggggcaatagttggagatgattggttctgagaattggctgtgaaagcggcattgctgaccagtgagagagacctaatgaggagcaggccggggcaaccaatgaaatcggagaagagcgcttgggggcgtgtccgcctgctttcagcctttggcaagttggtgggagctaaaatcagtcatcttcctgcgaaggcatgaggaggaaaagagaggaagtaactgagcgataatatgctgtatgagcctcctgctctgctgcccattacctgcgtcacctccacaagctactgaacctcaaggaacccatctcctcatcaggaaaaaaaataagctttatgtagcagggtctgaactctgtaggtcttcaccacggctcaggaggatgaggagcagtgacaggccaaactacgagaaaagacagagggaatcaaactcaacactgtgtctaaacctcctccaccactgttgaagggatcctggcatcagatggggaacagctctaaatcaaaataacctcactactgtgcttttctgtaaaaccaggtaaagatcagacaagcatgagttgaaaggctatgtctctctccaggctttattctgccatagcagtgaccaggcgcagccaacagaaacggaaagtcatggtgtccaacacgcctctctgttccccatgctgaggttaaaagatggtttttccttgccatggataatgtagaatttgacttttctcctatttatgagaacagaaataggctaaaaaagaaagtaaatgaagaccaattttggtacagaaattaaaaatcaggaaaaaataagaaaaaagcattacagtaagatattttgaattaagaaacaaggtgtaaactgtaggaaaatatacaaataaacacaactgaaataaacatggtataaagagaaactttccattaaaaagcacatctctatctggaaatacaaagtcttagacagaatgttaataaaaatctaaaaaataaaaagagagaaagggtaaacagatgtatacaccgtatctataattaaaattcagcaacatgctttagagtatgcaatatataaaaatggtcaggtgtggtggctcatgcctgtaatcccagcactatgggaggccaaggtgggtggatgacctgaggtcaggagtttgagaccagcctgatcaaaatggtgaaactccgtctctactaaaaatagaaaattagccaggcacggtggcacatgcctgtaatcccagctacttgggaggctgaggcaggagaattgttggaacccgggagctggaggttgcagtgagccaagatcgcaccattgcgctccagcctgggcaacacgagtgaaactccatctccaaaaaaaaaaaaaaaagtaacatataaaaatgtgttttatttagtggacagtaaaatcaggaaatgtagtctttggggcataggattaaaatatgggacgggcgtggtggctcatgcatgtaatcccagcactttgggaggccaaggcgggtggatcaagaggtcaggagatcgagatcatcctggctaacacggtgaaaccctgcctctactaaaaaatacaaaaaattagccaggcgtggtggcgggtgcctgtagtcccagctactcgggaggctgaggcaggagaatggcttgaacccaggaggcggagcttgcagtgagctgcgatcgcgccactgcactccagcctgggtgacagagcaagactctatctcaaaagaaaaaaaaaaatgaacagggggctggggatgggcatggtggctcatgcctgtaattccagcactttgggaggtggaggcagtactgcttgagtccaggagttcgagaccagccagagcaacatagtgagaccctgtttctgcaaaaaatataaaaatcaatcggaggctgggtgtggtggctcacacctgtaatcccagcactttgggaggctgaggcaggtggatcacgtgaggtcaggagccccggaccagcctggccaacatggcaaaaccctgtctctgctaaaaacacaaacattagcctggtatggtggcgggcacctgtaatcccagctacttgggggctgacgcaggagaactgcttgaacctgggaggcaggggttgcagtgagacaagatatcgccattgcactgcagcatgagtgacagagcaaggctctgtctcaaaaaaaaaaaagtcaatcaggcatggtggcacatgctactcaagaggctgaggtgggaggatcgctttgagtacagaaagttgaggctgcaatgagctgtgactgtgccactgcactgaagcctgggtgacagagtgagatcctgtctcaaaaaagaaaatacaaatagggacaagaaggtttaggttaaatgtatgactcatacctataaatggatcataaaaggaaggctggcagtactttgggattccattccaactttctagactcactcacttttccacaaaatttcccttcatggccggttgcagtagctcacacctgtaatcccaacactttgggaggtcgaggcaggctgatagcttgagctcaggagtttgagaccagcctggacaacatggcgaaaccccacctctacaaaaaatacacaaattagttgtgcgtggtggcatgtgcctgtagtcccatctacttgggaggctgaggtgggaggatggcttgagcccaggaggcagaggttgcagtgagccgagatcttgccactgcactctggcctgggtgacagagaagaccctgatttaaaaaaaaaaaatcccttttcatgttattctcagaaaaaaaatactactgcctttactaaaattaaaactaagagaccaaataacagaaaggcacattccggatcactccagaaccccagaggcactgtcacctcttcttcctctgatacactgacctttagagtcatgctttggtaggttttctggtgcaaaggagcaagaggccttgagaccactttttcatctctactgtacatagaatggcccttaatgagtaactactatgtaccaggcattatatcgaaccacttacaactgttatctcatttaagtaccaggacaactctatgaagtctacatcatcacctccatcttatagaccaggaaactgattcagcaatgtgatatcatctgtccaaggtcacaaagctagacagtagcagggaaggactaaaaattcatattctttatttcatattatgtttcccctaggaatctctgaatctttaaacttgatgcaaataaaatatgaaatggatgattctactattcatagtgttatgacagagactgctaattgcctaatatgccttcctacccattatcagaactcttatgtgtcatgacaatggcataaactaaaagatattttccagccttccctgcacttaggtgtggccatgtgacaatgtcctggctattaacagtaagtagaagtttctggttagaactcctggaaaaggtctcaataaggaagatggacagctggtccacatctttttgccctccacatccacctgtccttcttgatgtaaagctgaatcatgaattccacagccatcttggaccatgaggaataatgaacatggaagccactggtaagaatggcagaggaaaaaaagtgaaaaagcctggatccctgatgactctgtcgagctactaaatcaaatttatttcacactagacacataaaatcccattttgttgaaaacactgttatttctagccggttactaggagcttaatgtaactcttgactgaaagaagcctttttcccaagttgctagagatacagcagccattattttaatctataacgcaaattaagacatttcacaaagttcaaggagttaaaagggcaagatcaccttgttctggagcacagcagtgaggtgaggattggagagtgctggtgtagctgcactttgaggtaggttcattagctgtcgcaaaaggctggtgatactcactgatggaagatgatagagaaggagagagaagggactcagtaagcatggcagcacctacaaaaaacaaataaaag

SEQ ID NO: 4269 - DNA, 2288 bp, Homo sapiens
aggcgggagagctctgtcccggctgctcccacagcccaggcggctgcccgcaaacccgcgcgtgcgcagtaggcggcccacctgctggtacctgggccggctctgggatccccgggatgcccaggaaagaatggcagttctccgctgtgtggagtctctcaccgggcctagacctagaaggcaggaatcccaggccggtcagcccggtggagggggcggggcggagacacgcccctccgtagccagccaggtgttccccgcgaaagagaggccaccgccctgccccgaaccacccgaccccgtcccaaccccgcgtcctaaagctcctccagcagagcccggtattcttcctcgctgaggggtgcttccagcgaggcggcctcttccgaggcctccagctcccccggggcctccgtttctgggaaagggttagacacagataaactgtttcacgttagacctgtaacccaaggagatgtgtatagagctgaaactgaagaaattcctaaaatattccagatactatatgcaaatgaaggtgaatgtagaaaagatgtagagatggaaccagtacaagaagctgaaaaaactaatttccaaaatcacaaaggccatgagtttattcctacactctaccactttcctgccaattgtgatgcctgtgccaaacctctctggcatgtttttaagccaccccctgccctagagtgtcaaagacgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttccccttgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttatcgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttcttttttt

SEQ ID NO: 4270 - DNA, 10537 bp, Homo sapiens
agcagtttagtagtaagaaaaaagacataagttttcatctgttgcctgcttttagttatttacaacactaagttaatatagaatgttgttttctttcttttattatagtgaaatcaacaagaattcggtcttgttagactgggcttttataaaacaaagataatgtagtccaaaagtgaaagaaacactcctgtgtggccatagccagcttttcttttctatcctcaatatattacctaacttgtgatatcagcaactaattataatttttttcagtctacctgcttaaaagtgaaaacatgaaacataccatatatacatgaaacatactatatatacctccagaagcaagacaggttttccattctaatggatggaattaactgaataaaaattaaatgaactaaagccacagagaaatagtaaaaaataatagagtctaagaactacaagcatctactgttctctttatgctgcaacctttctgctaaagaatgtattctctatactgtgtatgtggtacagtgacagttgggctcttcccacctgggtttgtaaaaacggatgggtgcaggctcctttggccaccattattgcatattgatgttattctgcacaacagctgacaagcagcatcgatctcccagcctctgctcccagctgtaaggggtaagaacaagggctgtggtgataacttgtttattcactgctgttgctgttgctgctgctgcttcttaaacagcaagctgagaaaagaatatcaaactgacacacagaggaaaaatggttcagacatcaatctacctctcaaggtctgcttatatcactatatgataaaattatttttaaaataatttttctttaaaaagtggggtggggagagaaaaaagacaaaattggtgttttgattataaagggaacctataatgtatgcaaggaaaaggaaattaatgacatatataataatcttccccttgtaagtctagatttaaccgctcaattatcaaaattctctgaagagttttaaccaatgttggggtaaattcattgagagtaacttccctacctattctcctggaaaataagaaagtgtaaaactccaatcaagaaatgacactttattttgcttacaaaatgcctctagctcccaagtgccccatatctaatcaccaccatatgtttgactttagacactattagcaaagaaataagattttagtccatactgtttttgcataaatcccattaaaaaaacttccatatgcaatttacctattttaaatgtgcaatacaaagttaaaaacttagtaagtacatagtattaattgatgagtaacagaaatagaaatattcactgttcaattacctttaaatgtaatgtgatgctatttatagacttacagctttaactgtaaatgcaactcatcttttagaaccttaagcaacttgtgattcagaaaaatataaaaagtcagaaaaatttggagatctataaactattaaaaagaaaaacccacataggctagaactggcaagtaagtttaaataataatacctaatcaagaaggctaagtttgagacattttaaaataaaagtatgaaacagtaacaatattttaaatttagatattttgtaacaaatcaaaacccaaccccaatcttctatttttatcacaattgaaaaaattttctgcttagcaactcaatgaggaacaaaaaatgttaataataataaaaataattctgaagaccagaggataacaagatactttaaatatatttgttttgtatgaaggctataaaataaaaaagactaacagcaaatcctcaagcaagatttttaaaaattcagacacttagaaacagtaatggattaataaactattaaccagtgggattaatcagtctcagcagccacatgtgaaacatgcttcacatttctcctctaagattctaaccatgaaaataggaaagtaaaactaagtcaaataatatgttaatgaagtatcaaaagtgtggtttgtggtgctgtgaatagaaatttcacttcaaaatgtatttaattttaaaccttcacattaattaaatattaccctttgaaaaatgcttatcagaaaatataattctgatacattagatctcatttgaagaaaaactgaaagaggttaaggatgttatttgctagtttaagaaaaaacacaaaatacacacatgaacaaaactgcttcaaataaatatttttaaaacttttatttaaaaagttaattgtatctattatttaacaaattctcatcaatatataaaacctctattaaaatgtcatagctgacaaactgcctaaaatgtaacatatccttataaactagcattatacatctctgacaaataataattttaagttccttcatatgtagatatgttaagttacctctattctagtttattcaaatattctttctatactaaaaaaactatttcagtaagacaggaacaatgatggtataactgtattttagggacagctaagaatttttcccaaaagtgaatgttatttaaccctgattgtgcatttagccaaaaacataaatattgaaaaaatgagatacaaatcactgaaaaaaagataaaaattaacacaataaatctcttcccccaaattccaacataattaactacacatcaaggcttaaatttagataatcaggtttgcaaatttaaaacggtcaaaatctttacaaaatgtcttacaaggggtagttaaaagagagccaatcatacacagcagttgaactctttgttaattggcctcctaaaataacccatactcctaattaggttaaagtttctcaccctgtaagaattgaccaaatacaagtaaactgttaatatttgtattgattcttttagatatgaaattatttactaagctaaattattagaagtttataacccagtataataactataggaagaacaattatatgatgctaaatatttgtgttcaaaataagttttgatatcttcaaagatcacaaatcacaaactctctaaatttggacgactctgtggatttatatcttatctaccatataaactcaaatgctgtctctcttttcctatttaactcattaaggctgttctaaagatacctgcattgaaagtgacaaactgaacctggattttttttcccagatactcaggtaactgtattttccacttttcatcttaatgttctctaacctgaaaaatagctgttaagtcagtgagggaaaaattgtatttattttcattttattcaaactaagctgctttttcataaaaatctcaaatcaaacatatgaagacattccatacctcatatttatctgaaccacattacagtatgacaccaatataaaagtatctaaacttcacccttatgttaaactctgatttctaaacatctttacattttatttaacttcaactgttaattgattcattcctggtttatctacctaatatccaatatagaaatatcaaatttcagtttttagtattttgatatgtatttcaacattcactcttaaacacacctcagaattcatctttaaaaattttacattgttggaagttaaaagcagttctatgatcgtgatgatatacttcattcttaagactaaataataattttctcatgaaaacaaacctttgacatttcctctaagtatataaatatttttaggtgaaaaaattaaaaaaaattgtattatgttagtaaaccttactttagcaaatagtttttacacaaataaacgcacacatatatgtacatataagattaatactttactatgaaagaattaaccaagtaatacttagtaatactgttcaataagttcattttcactataccagattaccattttagaaaatgaaagttgtattagttaaatactgtctgaaattttcaactaaaactataaaaatcactggaggtttagggattctacaattttatttttagagtctgcaacttttgatattaacaactgaaatattttactcagtgtatgttgagtaagatactagtaatttctgcttaagaaagtggttttttcagtttcgaccatattgccacttttggttagggcagtacttggaatactttacattttcttaaaatattctcatcaattttacctaattttgcaggctctacctactactcttccacctgtcaaacagctaagcactaaattccatttgatttaaactctccattttataagatgaaaagttcatattttactgagtacactgtaataaccttaagaaaataaaaattactataaatacatatttttggaataaattcagttggagttagaccttaggatgctgagaagaacattacctgtataaaaaaaaaatctggagttttagtaagctagacaactcagcttatggccacttcatatgatgatttctgtttatgagtaattacttattgattttagttcacgtaaaaatttcaactttaccaattgtctagtccgattatattgcaaagacataaaattatatggttttaaaatttgttagtataccttaatctcatgtcatgttccaatgcattatgtaagtattcaatcaaagaagtgaggctgttctccagaattggttctctgctacaggtcaaaacctgcaataaaaatgtcatgtattatagcatgaagacactcaacagatttccatctcctgcagttccacagttgatccctgaacacagaggtatggtcttcaaaatgaccctaatcttgccaatgttcagagaagctctaacttgaaaatgttttaaaaatagaaataacttgattagaaacacctgtgatatgctttatcatccgaagcctcttcaaacaaatcagattaatatgtttctgctttcatttctctttagggcattcatgttcaaagtagtatgggtgagtgtgtatgcgggtagctgttagaggactggtacaagaggagttcataaagaaaatatcagaaatgtagtttgtacttgtaaaactcataaaatccacacagtttaaaaagttactgaagggacagggacgaaattttactttctctccaaattatcaaatgttttaatgatgacagaatttaccattctttttttttttttttttttttgagacgaagttttgctcttgttgaccaggctggagagcaatggtgcgatataggatcactgcaacctctgccttctggattcaagggattctcctgcctcagcctcccgagtagctgggattacaggtgcctgccaccatgcctggctaagaatttaccattattttcaactttagtctactgccaagcctaagtgaaaagtatcagtatttccaaatattttaatacattacagtcctaacagaccaaaatgtggagtttttttttttttaacaagttaacatatttacaaataataaatggaccactactggaccaaatggttttttaatgtttctaagagatgtaactgaatatatgttaagtgttttttttcatttctttcacctttctgaattataatgattcagtggcaatcgactgtataaaaatattaaattaccaaaggtgtatcatgtattacatgtaaatcataatgctctgaataaattttccagttatatttaagaatagcttaggaaaatgaaagagtaaaacctaaaaaaacctttattcctctgttgccaaatatttgattgtttaatgacaaaacccacacaatcatccataactcataaacaccaatccaaataccatgacattttaaaaaattaccgtcatttatacacagtcttcctcaaaagacagacagttttctatatttgagcactctgaaaattaaggtatcttaagtttaaaaatcatagaaggaaaatagtagaaaacaaaatgtactacatgccaaatgttaagtttttaaatagtagggagatgaaaaatactaaccaataagaagcaaaagaggtctggatataaataaaataataaaccaatgtgtatgataaaaaaggcaatattaaaaaaccttcaaatagtaaaactcaaatctaaaatctattacaaaatagagcttactatttattcttagaaaccactacaagttattccagtacaaattttctttactgaaataaggcaggattaaccaaaggtatagtaaacttcttataatttgataagaaatattaataatattcaaatatatatttaatatcaatttcaatatttaaaacttgtctttctaaaaggaagatcctttaaagcatctctaatacagatcaaaaaataaaaacaaaaaaccaaccgaggcaaaaaaataaaaaacattcagttccccaccagaaagtaatatttatatgatctacgagataaataaacatataatagtaatgtgatattctaaaaatctatcctgttactcttaagacaatcatgacattaaagttctaatactgtcacttccaaaaattaaatgcttaatctcattttcaatgcttatttgaaataaagtggtattttattactgatttcctttggtgttatgagatttggggctacaaaatttcagcaagtcatagttgagctctaattatgtgccaaaattagttgcctggcatacaatgtttcaaagtttgctgaattaaaaacaaaacaaaaccaaaaacccccacgaaactatatatatgacaattttttctaagatgtgttttctagttataatcagacctaaaatctgtgtcttctaaaaaggggttaaaaagaaattaatatgtgaatttttaagcttcattagacagaagaaaaaaaacacaagagccaattttaggtaatattttaaaataagagaaatttttatagaataattttttgaaactataaatttatcatcttcttttgaagaaagctaatgtgtcatatataataattatctaatacagtctctgggaattttttttcattttgtaaaccaaatcaactgacccatatttctggctttaagtattctgtgacattccaaatagttactacctaccaataaacaaacaaacaaacaaaaatacacacaagtctccacaaaacaaaacaaacgaaaatgtactacataaagcatgatgaaaccaggaatctagactatgaaagctactttaaaatttttatccttagctgtagttcatgctaaacattaaaactcatattaatctgattagaaaaaatatgcagtgttacatacaaacacccgaggctacattttctgaatgtacaactaagacaggtcaacagtatttttttaaaaagtctgaaactgcacttttatttgaatttttaaaaatagtgtgggggcaaacaaatgaaaatcaatgctaccaggaagactgataccttaccagtcccctttcccccacaataggtaaacataactttaaaaaggggtgacctattatagcaacaccacaccccgcagttgctttcctatggtaataaatgactttgtaatacaaaataaattacaactgtcaatttctacagagaaatatggataagtgcacataaacattaaaaaatacacatatgttgtaacttatacctatatgcccacaagtctaaaaccaaaatcttcctcttatatagcatcacataaaagtgaaaatattttgaatgctgtggattttatttaggcgctagtgtattctcaaatttgaagtgatgtattttaaataaaggaatcacttcttttaaaaatggcttattaaacaaacaatcctttacccattaccccctaaacaaacaaaaaatcccataaaccaaagtgctaaaaatgtatggttatacttaaccagcctggtggaatttaaagcttgcccccaactcttcccaaaactcacgtaatttgaatgagaatacaaaactcaaaacaaaaaccatcagtaaaaagcaaaacccaggagttctggtactttaggtataattacgtttaaaatagaaatgagatctcctaaaatttcattaaatcaaattttatagagaagataattagcaccttctatgaaattttcataagatgacccaaaataaatagctttgaacaaaggtaatgaaaagggatctgttatcacaattcttgttatgagggcagtacaaaatagtatgaattataaactcagctattccacttactaatgtaaattatatttacagccctacagagatttataaaagccataagattttttatttgaatattttttaacaatgcgtatttgacttaatgcgaacatacacactataagcttcaaaatttaactactattcataaaagaatataaacgtctattaaattaaaacaattgtttctcaaagcatctacagctgtttatcagttagtttgccgctgttctttgaaaacgacacctgccttttatcaagatgcaattaaatggaatgacaagctcggtaataaatggaaatatactgaggctgtctcaggcaacatcgaacaaaaatcaactgaaaatcaaccagataaaaaacagcacacccacactgttgtatacaatatatttcttcataatgaatttatcaaaggaactaaataatagatacgcacctgtgcttacctgttgtctaaattaagaaacataaatgttttgtaaattaaagttttagttcactgcagttactgaattagcaaaatgtatattttcactagatgcgaaaagttttttaaataagatgttcaatttttatggaaaatgttaaaaagatcattcgtgaaccttaagaaaattagtttctttgcatcaaaataaaagaaacaactgtccggtaatctgcatccaacaaatatatgtagtttaaggtgaaaaattcctatcaaaggaaaaaaactaaatttttcactcagtttttaaccaataaagaacagtgacaaatatataaaagtcttgttaatttcaaccagcagaaacataattttgcgaaaacagcctcttcagttttacttttaatatacatttgagaaccacacgaaaatcctttctgagaggaaaaaaaactattaaaaaccaactttttttctaaactctcgtcctaacgtttcgtagctatttccgtggttctctggctaaaagtatattttttcgtaaagtcgagaattatagtttagcgttcaacattcaaaccccccaggcccgcttccttccagccaatcagggggtaacaagtccagagtttagggagctccgttagacacaatttgaaaaacatcacattgcactcttctattctcctccgggaaacattctaagcgagggcgggtcccccagtcttcatagaatataagaaataaatcaatcgttacatcaattccacggggaaaaactctgtaggcaggcagtcctaaagaagcgtgtcaccgcggttcccaggaagcgttattcctctttgcgaacaactgaacagaatagctgctgcagaaagcatctccggaatatttgcaacccagagccgtgcgccccacacgcaatacaccggcaaagggttaatctagtggtgcctccagcgcggaaaagaactcaagatctaatacatccttaacgcgggatttttacaaaggccatagaagtattacctaaagttaatgccgtcactggctcacatcactcaagagctgtggagtaagaattgatagaaaccaccagctaagggggaaaaaaaaaatcaccgaagggaaagacaaataacaactctcgtccctcctcctcagcgtcaagaaaaggtggggatcgcaaaattaccgttaagttgtccgggtaaagacttttgggggaggaaaacattaatagtttcacagattgcttttttccttgcgacatgtttcaaacaccggagaagaaaaaagtcttctaagaaagtgcgactcggaggaaatagccacgagaaggaaatcgttagctcgaagccccatctttcatctcacccgtgaacactcctcccctttgagaaaggacaacgctgcgagagcaaatgacaaaaatccccagaaagaagctaaagtccagcatctttcctaagagcccgctacaacctcaaaagcctgcccctgccccatcttggaagcgcgagccgcggccagtcctacctacctagagacctcaccgggacccagcgcgccgggggagggcagccagggcttgggaaactctttcctggggcacctcacgcttcagcgtcaaaagacaatatagatagatgggtgccgggcggtggcgggggggactgttgccacgacccaccggagggacccatgactccgggtcctgaattttctgtcgaccttaagtttcttgtcacgagatgacggccatcaccgggtcgagaaaacggcgagaaaaggcggcccggttcggaaatgggggaggggcgcgcgtccagtcctcctgtcaaggagcggccgcctgcagagaccccgcagtgcgcc

SEQ ID NO: 4271 - DNA, 356 bp, Homo sapiens
gggggaggtgagcgccgacgaggagggctttgagaacctgtgggccaccgcctccaccttcatcgtcctcttcctcctgagcctcttctacagtaccaccgtcaccttgttcaaggtgaaatgatcccaacagaagaacatcggagaccagagagaggaactcaaaggggcgctgcctccgggtctggggtcctggcctgcgtggcctgttggcacgtgtttctcttccccgcccggcctccagttgtgtgctctcacacaggcttccttctcgaccggcaggggctggctggcttgcaggccacgaggtgggctctaccccacactgctttgctgtgtatacgcttgttgccctg

SEQ ID NO: 4272 - DNA, 933 bp, Homo sapiens
atggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtcctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgccatcgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaa

SEQ ID NO: 4273 - DNA, 581 bp, Homo sapiens
gatctcgtccacgtcgcccggcgggtagaggcgctcctggccgggcccgcgcttctgcagctgggcgccgtaagtgtagccttcgccgaagaagtacttgttgcgcagtggggcccggtccaccgtgtgctcgttgtacaggcccttctcagcgcgggacaccacctcgtcaatgcgggcctcgatcttggcgcactcgtcctggctgaagaggcgcatctggcggatgccgctcttcaccttgcgcgcctcctcctccttctgcagctgctgctcctcatagtcgctgcgctcggggtccgagtcctcctgatacttgcgcttggccccggacacaggatggagtttcgctctgtcgccaggctggagtgcaatggcgcgatctcggctcactgcaacctccgcctcccaggtttaagcgattctcctgcctcagcctcccgagtagctgagactacagagataccagggttgtgcgcacacagaggaaaggccatgtgaggacacagtgaggacagctgtctgcaaaccaccaaagaaaccaaacctgctgacaccttgaccttggaccgccagcctcc

SEQ ID NO: 4274 - DNA, 2642 bp, Homo sapiens
caaaaaaccaaatggatcttgttccgcatagggcagacaggacccagaggacacagcagtccacaacaaaggcactggattctgaatggcccctgtcttgtttggggagaggggaactgttggtccccgtctgtgttccgaggcttggtgacaaattctagcaaaccttagtggtttaaaacagcagtccacatagatggtctctcacagttcctgggaagcaggaccctgggctccatggcaacctggttctgctctaaggtctcaactgaggtgtcagtgcctgggtttacctcgaaggtattgtagtggggtaggttgggcaccccccttcacatccagctggagccttggagcaggacctcctgtagaaccagggtcttggcagacatcctcaatgagtgacgtcgagaccaggccatcctggattagggtgggccctggacccgtaacaggtgatcgtctaagagaaagaggagggggatctgagatgcacagatcgggaaccagccatgaagacaggccagagactggagtgtgtggccatgcgcctgaggcacctgagccaccaggagctggaggaggctgtgcagggtcctccccagaacctttggagggagcatgcccgggacacctcaatgtggggcttctggctgcagagttgcgaggaaatacctcccttgctgttgtgaaccacccaggttgtggtaacttgctgtggccaccctgtgatgccagtatacctccttccctcatgtctggtgccaaggccgggagagtcaaatacctggggctaaaagcattggggttcctcagatgatcctctttgcacccctgcatagggtgtctgcccacacggcctcagggtcatgagttttctgcaggcagccacctgacctgtccagccggacatgtgtctcccccatgggtcagtttgggcagcaggttgggtcccgtgtaaggctcagggctgctgggctctgatgtcacctgttgccacggtgactctggttgctaggatcagactactcccttcctgggcacactgtatcccgaatccccagaagaaccaaggggatcccccagcacaaggctcgttggggagggagtccttggcgctcagatttgagagagagagtcggggctggccagggggcgtggcttgggcagaggagagtgctcatggtgaccctggaggagaccctcccttccctcgttcattgctcccaaggccaggtgtctctaaaggaagccagttgtggagaatgttggtcctgcagtggcgattaatgcaaagatgccctgaacaaagcaggacacacgtgcctgcctgctacccctgcccagctgctgttcttggacgcatgtgctcttctggtgggacccgtgaatacgtggctcacggtcctggggcacaccccattgtgtgaggctgggggtcttgtggggagccaggcccctggtgtgggtccctgctcagaagccccacgcagcccctgttctgctgagtgcggctgaaagccccccatacccacagccctctgtcctcaaatttttctcattttaaaaattgtggtaaaatacccataacataggacttaccattttaaccttttaaaaataatttaaattttttaagagacagggtcttgctctgtcacccaggctggagtacagtggcgtgattttggctcattacagcctccgcctcctgggctcaagcaattctcccacctcagcctcttgagtacctgggatggtaggcacgcaccaccatgccagctaattaatatattttttcttgtactgactgggtctcagtatgttgcccaggctgatctcaaattcctggcctcaagcgatcctcccacctcagcctcctgagtagctgggattataggcgagagccactgcatccagtgacttttttttgtttgtttctctaatagctgccatcctgatggggtgagctggtgtctcatggtggttttgatttgcctgtcctgaaggactcgtgactttgagcgtctttccatgtgcttgctgctgtttatagatcttctccggagacatgtctgtcttccctctcattcttgcatgcgggcgtccacaggctgacccctcagctgctcagccaggcccctgctcctgtccacagagcccaccctccaggtgcactccctgcctgcctcctgcaggttcctttcctgggcatggtggcccagccctctctgtccctcacctcacctgctttcttcatggcatgtgcacatctgacatggttactagttgtgtgatttctgtctgcctttgcagtggacacaccacagacgctcagccaatgcttgaaccagcaggtgggtgggactatgccaggacgggatggtggctcagagaggggctgcctggtctggggcctgacaggcgggaggaggagaggcctgtagcacccattggaggtgtgtggtcgcccagcacaagaacaagggaggaggcagtcaggcgggggcgctcctgcccaggccacggagctttaattaaaacccgcccggagcatgaccccactctgccatgcattcttcacttaattggggcccttcaggaggggccggctgaggttaattaaaaagcccagctgaaga

SEQ ID NO: 4275 - DNA, 862 bp, Homo sapiens
tgtatactggagttattgggcggccctgaggagaagagacaaaaaggagccttcctgaacacgtccacggttggttgaatccagatgcagaaactgcggataaggaggaccttctctgtactgtattccggaatcttctacttaccattccactcaatcagtctatgccccagagtgagctagagaaggcagcggagaatctaccatccacacaattgatttcacagtaattaaaaatcagtgtttttccttaaacatggcctctagatacatgccagctgcctcaactcatacttaactgatggaatatgatctgtctcagagacagagagaggaacagactgtgtcaacttagagaaaccaaatatactgatctccaaagggacagcttcttaagctgtgaccttaaaaaattgtgaccatacacaattttcagccaatgtgatggtttccatcacctcccacctaagagatgacaccattaatgtatacaaattgttgtagaagcttagagaaagaaccaactaatggggaagttggagaaaatgtctcagcagcggggatattcgagctgagttttgaaggataaagagcagtttccaaatgaggaagaagtgggcaaggacaagctaagtaaagttgcctgaactgttgacggccaccactggctctagaaaagcccctgctacttccttctgtctacttgaaagtgcaacataagatgttttcagaacaaacaggagtatgaatgggaagactgtggttcagtatttcccaaagtgtttgccatggaactagttctgtgagatgcttcattgaaaagagattctgaataaaataaaacattcatttaacaaaatat

SEQ ID NO: 4276 - DNA, 11226 bp, Homo sapiens
ctgctgcagcagccaccacacatggagggcggagggacagccaccctgttgtgtagctcggagcagctgtgtccttcagtgcaggtccagccaagagccgtgggccacagatgacgctggtggggaagcagagggcagactaggcagaggcaaggctttcctgtgccctgagctgtcagagatgggccagggccttcagcttcctcgatagggcagaagtgaccacgctggctccattcagcaaaggacgtggacggagctgccgggcttgtctgagaggaggagaaatgtggaattgagtgaggctctctaagaaggttctgctggagttgagaaaaattagggtgaggcacctccccgattttatgtcctttttcctgggtccagcctcctgaacagctaccattcgcttctgtgagacacctgtcggtgcctccttttccagcccttaatggaacgttcctctcccagccacctcagacttcccataccaccctccctggacaggaagcgtttttacaggagtttgaagcttcaggagtgccctccggccacatgaagacaaggcgctaacaaacatggcgttctgcaaattgcaccatcgccaactcctgtcttactctcacagaggtctcttgggctcttctgagaagggtgaatgaacttggttggagggaagagaggggtttggtggctcttagtaaaattgcttcacgcagtgacctttggcagtttaggataataacctgtgcagagagagggtctcctgtcctgaagtcacagcccggatctccaggctggctctgctgcctctgaatgatttgtgggtcacacacgccaacagcatcgccaagggctgacatcagcctgcttgagccacggaaactgaatgggcaaggatgagttccccagcacagagggaggcatcctctgtcaagaccatctgcgcatgtgctgtgcagtctccagtctgcactgtgagcagtgtgtctcaacggcttttgagaactgcttcgagaggggaccagatgcgcagagacaagcttccagcctggctagggacggaccctctggggatgctcctctctggccgggcagcagtagaagcacctgcctccatccacatccagacgccattcccttttcttcaccgctgcttcccatcagatggtccccaggagtggcaacctcccacttggtctcgcaggagtcccagtgcttctcaggtgtgtgtgccacatccctcttctctgaacacacagtggtcagggtgcctgcacagggaagggcaccacagtccaccctgggaaaggtcttcagtcttcgggaaagagcctgtaagcaccttgactgctcttcttctctagggcagagagctttcttatccacaggggtccttagtcagagagagggagcgcactcggtgagctctttcagaggcagcagagccctctgcctctccccaaatccctgctcctacaagtcgaattaatctctcctagaaatccaagtcctaacttcttccaggcgtctttttacatccactgtttgcatagcccaccctttcttctttggaggatcccctcaggtaacttccatctgctcctcagtgtgtcttaccccttccttctgttctttcttcacctccctccctctccacctccacactggactatatcaaattcctgttcattttttagcatggcccagtcaaagcaggttaatctctcagtcagcagaggacatttcacaaaaattggggccgctaaatcacaaaaatattctctaagtccagggccagcccagaaaaaatgccccaagtccaggcagccccccagagtctgccgccgtctggaaaatccggctcagctcttgctcctgcacatcctctcctttccagtgctctgtgtctggtccctgtcccacctcctctcctttccccagtgtcttctgtctgaattctgtgggcccaggacagccccagccttctcaaagtcacctgcatgtctcttggattaggcagctgagtgcaaggtaacaaccagatcatgcattttcatctctccatggatggttggggatagagcatcacaagacaggcattgtggctgggtgtgttggctcatgcctatgatcccagcacttggtgggagaccaaggcaggtggattgcttgagctcaggagttcaagaccagcctgggtaacatggtgacacctgatctctacaaaaaaatacaaaaattagccagatgtggtagtgcatgcctttagttccagctactcaggaagctgaggtcagaggatcacttgagcccaggagatcaaagctgcagtgagcctagattgtgccactgcactctagcctgtgggacagagtgagaccctgattttttttttttttaaaggcagacatggttcttgccttcatgaaattgacattgtagttgtggggaggggtgagacactagtacagtctctacagtaatataggaggtaatgtggggcacgctttcggaaggaaatagaattggatgatagaatagggtaatctgtgctgggggcagcagggaaatgtccttgaaggggtgacatttgagccgaggcctgtaggtgctctccatggaagagctgggagaggaacactcggggcagatgggacattttttgcaaaggccctgaggcgatacgaagcttggtgtgatggagaaaccgaaaggaggccagtgtggctgggggggtggggtgggaatgagcatgagggaagtgatgggaaaccaggtcagagacgtgacagctgggggtggagggggtggagggaaaacacatggtgcagggccctgttgtccaaggtgaggatttggattttattcccaaagtcataggaaactcttgaagggtataaggcagaggagtaagtgatctgatgtatgggtttcatttcttttatcatgttttattttctttctttatttttgtatgatgtgtgggttttaaggattcctctggcttcctgttttgtgcaagtgtcttgccccactgtctgtcaaaactttcttctttccctgccattagggaagccctcatgattcagcagctgctcatttctctttctctctctctctctatctcttctggcttcaccgtcctcctgcagttgaatccaaagctcataccaatctctgcacaacagccaataaatcaagagacgagatattgggggaaggaaaaatgacattatttcagagagccagcagactgaggagatagcagacctagtgtcttgagaacaatcttaagtaatagaattttgggctccttttacattagggaagggggaagagagtgaggtttaagatcaagaggtgaccgatgatagcggacatctgggtggcagtgagtgtccgaggaggggcactgtgcaacttctttgtcctgctgaggtcacaatgttcctataaatctttaatatgatgtagctgctagtgtgtacaccctccttatctccttgggggtgagtgttgggaagggattattgtcatccttgctttaaagttaaactgtaaactaaattcttcccatgattagcttggctgatgtgcaggaatgacaaagaccattagcttgtgaggttagaagcagggtggagtcagctatgtcagattctgctgttacactccatgcagacccactttctagatgaggagggggagcataagtgtactttgcgtctcttgactgtcctcacatcatctgcttttattattttctgtaaatgtttatcatgtcctggatttgagtgaataccacaagcttcctggcaaggagatgttgataaaaatgagtacggctttccccttgagttttgtctcgcctggcctcctgcccattcttgactagatggaagggaccacaggctctgaggatgatcgaggaatctccacttggcgaataagtcaagccacacgcggtctcgtgatccttagaccccttcagtgtcctcctctccactctggtcacctagggggcattcctaccctgcccctctccaggtgttcagcctgggtaggcgggagaaggaggaggcgtttcaggtatgggagtacgaacctggagcaaggctgcgttcctcctgctttctgccagctggcctcaccttcccccttttacagccttcccgtctgatctggcatgaggaacgtcaggcttccatgacgcaccccgcccctgtcacgtgcacatctttcctagggttaacaggggatcgtgctgaagacagactctccagtgctgcggagtattcagaagcctttacattggccagtgtttgttcccagccctgctgagccaccccgtctagtatctctgaagagtggagggtgatgcgggtatttgggaagagagagtgtgggatgggatgggggtaagtacattgacaaagcatgtttcatgttattttatatttgaagaacaaaaccaaaaacagttgtttgcatggcatgaagtggtgaacgtcagcttttggtttatttttacgaaagattgagaggtaccaagaagggaagatggcgggccaagtccagctgtcagtgggggctgtccccaacatttatttaggctgagcttcaagcctctctccacgtcgctagttctttcacaattccaccccagtccagcgccctcttccattagtagagctgtccataacccatgtgggaacgcatgtaggagctaaacacgcaggttttgaggttagactactgggattcacatctcagttcccatcccattgctagctctgggttccctggcaagtgacttaacctgtagctaagccattaaactcatgatttcaggggttaaaagcgtggaatctggagctggccctgtgggctgcagtcctggcggctacttgttggctgtgtcaccttgggcaagggcactcatttctctgggcctcagtttcctcatttgtagaacgaggagactaatatacctaccttgtaggtttgctgtgaggattgaaatgaatatgtatatgtttgtgtgtatgtgtattacacatctttacacaaccacatgttgtgtgtatacatatgtttatagttgtctataaacatacgtactgggctgggctggggacagtgacttatgcctgtaatcccagcactttgggaagccgaggtgggcagatcgcttgagcccaggagttccagaccaacctgggcaatagggcaaaatctcgcctttacaaaatatacaaacgaattagctgggtgtggtggcatgtacctatatttccagccacttttgaggctgaggtgggaggattgattgaacccaggaggttgaggctgaagtgagctgtgattgtgtcactgcactccagcctggacgacagagccagactctgtctcaaaaaatcccatatgtacgtatgtatgtatatgcctggtacatagcaagtacttagaattgctggctgttactgttattaatatttatttttgtttagggtaaggctaaattatatgtaagaaaaataagtcaattaaaaaaaaaaaaaccagtggctctgccaggtgtggtggctctgccaggtgtggtggctcacacctgtaatcccagcactttgggaggctgagctgagtgcatcacctgaggtcagcagttcgagactagcctggccaacacggcgaaaccctgtctccacaaaaaaacacaaaaaattagctgggtgtggtggcaggcgctccatatcaaaaaaaaaaaaaaaaaaaaaaaagaagaagagcaagttttctgtctctgctctctctattgagttgggatgtccatcttctcctgccctcagacatcagttctcaggccttcagatttggactgaattacaccaccagctctcctggttccccagcttgcagacagatgggacttctcagcctccataatcacatgagccaattcccacaataatcctccctctctctcagaataaatgaggtaacatatgtgagaacactttgcaaaatggcagaatactcctctattgtaaattgtgtgagaaacaaactctgccaggtgccgtggctcacacctgtaatcccagcactttgggaggccaaggcaggtggatcacctgaggtcaggaatttgagaccagcctgactaacatggtgaaacccgtctctactaaaaatacaaaaattagccgggtgtggtggcgggtgcctgtaatcccatctactcgggaggctgaggcaggagaatcgcttgaacccagtaggtggaagctgtagtgagccaagatcacgccactgcactgcagcctcggtggtggtgtgggagggggtggttaaggaagccctgactgataggtgcctggcagctagataaaagggaaaaaagaaaaagaaaaagaaaaagaaaaaacaaacacactcacttgtccaaaccaaagaatggacttagggatgggagaacagcagaagcgagaccttagtggctgccttgcaagatggggtgtctggcatgcgggcacacctgcaacgatttcaacaagcaatttattcccaagtgcacaagtccctcccctagttcctcactggctgagtactattgggttacaatctttctgcatgtcacctattgatatttgggttaaggatttcagtatgttctttagggtctttctgctgcattttattgcagcccataatgcattgcaactgtctcaggactcttcaaacatttgagttatggccatagtgactggacttagctgataagaaagagtacaattatttactttgcaagctagcctaaactaaattctttttttttttttttttttgagacggagtttcactcttgttgcccaggctggaatgaagtggcgtgatatcagctcactgcaacctctgcccacccggttcaagcaattcacctgcctcagcctcccgagtagctgggattacaggtgcccggctaatttttggatttttagcacagatggggtttcaccatgttggccaggctggtcttgaactcctgaccacaggtgatctgcctgccttggcctcccaaagtgctgggattacagtcatgagccactgtgcctggcccaactaaattctttggaggggtggaaggggatggttaaggaggtcctgactgataggcgcctggcagctagatgaaagggaaagcaagaagcaggatgggcaggagggggtgggggtgggggggtgacttagtacattctgcttctttatctctttgtagcctgtttaaacctatattaaggcacttagaattgaaaatggaccaccacacataggttattttctgcagttgtaaccagacaactgaactcttttttttttttgagaccgggtctcactctgtcatccaggccggtgtgcaatggctccatcacggctcactacagccttgacctcccaggctcaagcaatcctcccacctcagcctcccaagtagctgggactacaggcgcacaccactatgcctggcttagttttatattttttgcggagttgaggctttgccatgttgcccaggctgttcttgaactcctgggctcaagcaatctgcccggcttggcctcccaaagtgctgggattataggcatgagccattgtgcctggcctcaactgaactctacacaggagcagttctctttttttttaagatggagtctcagtctgtcgcccaggctggagtacaatggcgtgatttcggctcactgcaccctctgcctctcaggttcaagcaattctcctgcctcagcctcccgagtagctgggactacaggcatgtgccaccatggctggctaagttttgtatttttaggagagagggggtttcaccatgttggccaggctggccttgaactcctgacctcaagcgatgctcttgcctcggcctcccaaagtgctaggattacaggtgtgagccaccatgtccagcctaggagcagttcttaacttctttccagtgaccacacaagggacaggttatgtccaaatgctggatagactccaaagcaatctagctgcaacttctcccatcctgctcctgctcaagagagggaatgttgacagcctccgagtcagaagttccaaggggcagaagagatgcctctgtgcctgtgggcataccttagctgttcccagctccccagctccagcccaggagagcatcatgcagtctctccattagaagctctgcactcccgttccctttctgtgatctttgccttccctggttctgtctgtcccttggcagtgagccccttgccttgcccccaacagtgtggccctctctcgattccttctccaccaacatcctttcccggagtataggcagctgcctggaaaccttgctctactctcattttttgttggggagtggagtggtaacctctaaacagaaatcttcttgctccttactgaagttgcagagtcggagctggctgtacctcctctggctctgctctagggacaggctttcacactgagatgggctgtgtccattggaaagttggtagttgattacctctatgaaaaaaaaacctgaaaaattccaccttttctccagaactgattccacgaatctaacgtatggattcccaaatgcagaccttggctgcttccacagtattcctttgacttctacatttaggtacctggagaggcatctcgtgaggccatgtagagtggcaggcaagggcatggactgggatgcagactgcctggattccagccttgctgggctccctccagctgtgtgtgcttggacaagtcctgtagtctcctgggctgtggtttccttccctctaaatggaggaaatgatagtgcccacctcatgggcttttgtgaagactgaatgggttgatgtatctaaaacttttgggcagctgagtgcggtggctcacgtctgtaatcccagcactttgggaggccaaggcgggcagatcacctgaggtcaggagttggagaccagctcggccaacatggtgaaaccctgtctctactaaaaatacaaaaattggcgacagaatgagactccgtctcaaaaaaaaaaaaaaaaaatagctgggcgtggtgggggcggctcctttaattccagctacttgggaggctgaggcaggagaatcactcgaacccgggaggcggaggcttcagtgagccaagatcatgccactgcactccagcctgggtgacagagcgagactccgtcgcaaaaataaataaataaatgtcttgggtcaggatctgggacacagtcagtactgtgtgttttgtgtttgtccttcctcatggtaacctggattccttgatctcccggtaggtccactccttcatcacacctgggactactctcatatttgttccctcctatcctgagtcctagtgggttttcatttgcactccagggttcagctgcagacccaccaggtgaagacccaccagcacaccttgccctgcttctgggccacgtctctccagtgcacctgcaggagacctctgtggatgcaccgtgtctcctaacactgtctccagcccacactgagcttgtcttgcgtggaaatctttgtctctgctgttgcctttgcctggagcgtccttgccccacaccctctcacagctgcctctctgtcatctttccaatgtctgtcctcagagagcccttcctggccactccatctaaaggagtcctgggccaggtgtggtggcccacacctgtaatctcagaactttgggagacggaggtgggaagatcacttgaggccaggggttcaagaccaacctgggcaacatactgaaacccccatgcctataacaataaaaaaggaaaaaaaggggtggtggtgcacacttagaatctcagctattctggtggctaaggcttgagcctaggagttcgaggctgcagtgagccaagatcgcaccactgcgctccagcatgggcaacagagtgagaccctgtatcaaaaaataaataaaaataggtcaggtgcagtggctcactcatgactgtaatcccagcactttgggaggctgaggcgggcagatcacctgaggtcaggagttcaagaccagcttggccaacatggtgaaaccccatctctacaaaaatacgcatagtcgggcatggtggcgggtgcttagagtcccagctacttgggagactgaggcaggagaatcacttgaacctgggaggtggaggttgcagtgagccgagatcgcaccattgcactctagcctgggcgacagagtgagactgtgtctcaaaaataaataaataaataaataaataaataaataaataaataaatataaaaaaggaattcccctcttcttattacactaatcaatttgttttcttcacggtgctttaccagaatctgaaattgttctatttattcatcttttgtcaacaattcctggtaagaggtgctactcaggtcacagaattggttttaggttgctctagtaaaaactttttgctgtctttagcaaaaagagctgtgcacatagacatactttcaggttaaaccaatatgtatgtttttaatttgctaccccttgccacctcttggcctagaaacagggaggaggaagccacgctttcattattattaactatctcgggccttttattagtttgatcaagtaataatcatctaaagtgcatctcctttgtggggagcccaaattccaggccggaaaaggtccaaccgctgttcctccaacaccggtgcttttccagaacgcgaacttcacgagagctgccgcttcctgtcttgttcaccaaaacattctcagcagcttgaacaagtcctggccgggagcagttgatgaaggagtgaatgacaggcaaattgggatgcgagcaggtgtccatgtctctggacaagggagtgtctttttttccccaaatccctgcaacgagagcctaatagagtgctttagagcacaggaaacctttgaaatagcgccgaactgttgacggaaatgtaaattaatacagttattatggaaaacagtacggagtttcctcagaaaagtaaaagtagcactgccatatgatccagaaatccccctgctgggtgtaaatccaaaggaattgaaatcagtatgtcaaagagatgcctgcacacccatgtccattgcagtgttattcacaatggccaagatgagga

SEQ ID NO: 4277 - DNA, 3131 bp, Homo sapiens
ttggagcctgttgtgactgtcacagtaaggagtttgaagtcctgaaagcagttgagagctgtaggagggccagattgggcttttgagcaagatagtctagatgaaagtaaagagatggagacgcttcagcaaccagatgggaggttgggcatgggagctgtggctgtgctgagctgagaagcctcagactgcctgcgaggctctctctgggaggaagtcaggtctttctttccttcgtttccttcctttcattcctttcctttccttcctttttcctctttctttctttccttttctctctctctctttttctttctctctttctttcgagatggagtctcgctctgttgccaggctggagtgcagtggcatgatctcggctcactgcaatctctgcctcccgggttcaagggattctcctgcctcagcctccctagtagctgggattaaaggcacgcactgccacgcccggctaatttttgtatttttaatagcgacagggtttcaccgtgttggccaggatggtctcgatctcctgacctcatgatccacctgcctcggcctccgaaagtgctgggattacaggcgtgagccaccgtgcccagccaggtctttttcttaaagagggacagactgaaggtaggctgtgaatggtcagttatttgtatttctttaccttttatgctatcttgtagtttgaccagtttgcaaaacaaattgaataaaaagtaattgataatgttgttttgatgctcagtgtttgagggaaacacaatctagtgaatggggttattggttgtcacacctgggagagtgaaaatgaggggctcacaacccaggtgaggtcatctggtgccactcagccccatcccagagaaagcagccttgggatgctggcctcggtgacaaccaagaagtgatggtgggttgctagagacagggtggagcacagagccctggaaggaagcaggaagtcaggttcaagaaaggacttgtgacctcacccttggcttcagggttttatttttctttcttttaaaacattttgagacaacatgtagacattcaaacttacagaacaaagaactattttttccctgaatcatttgagactaagttccctcctatcaccagacatttctacaaatgaggaccttcacaggactaaggtgccaccatcagaaccacaatatgtggggacggtactgccagctaagccttagtgctgtttcggtgttgacagctgtcacaatgatgcccttttcagtagaggagcctgtgatggtcacgtgttgcaggtgatcattgtgccatttggtttacttctgtctggaaagtttctcctttctgtaacctccatgaccttgacacatgaggtcactcttctcacccgccccacctctgggagggtgcctgatttgccctgccccacccagcggctttaggactcagctcttcaggaacaattagggagagggcccttgggtctaactgcaaaatcatacttgaactagaaaatcccgttggcataggtatggattgtcatatagaaacatttttcgcagtgtgccccgtggaacacttgttctgtatgttgttaacagatgttttgcaaaaaatgaaaaggacctgagctctaataagtttgggaaatgctgaattgaagtgaaacagcttttcttggtgtgagacctttcagagtctttaaaggagagttgctgaccacacgtgaaatcacaatagaaaatggccagcaggcctccaggtaggcagcaattcctagacatttgcctgtgttccctgggggagctggtggcctgtgaccatccactgggaaattcccttctgtggcgaggttctgttgttttccagaggctcccacggagcatgctgggtgggtggtctgtatgagaccacaccgttgatgagcagtgaggcccaaacaggtatatcaaaaaatgctcagcatcgctgatcatcagggaaatgcacatcataaacacagtgagacgttgcctcacacctgccagaatggctactgtcagacgaaagacaacaagtgtgggtgaggatgtggagaaaagcgaacacttgtccacctttggtgagaatgtaaattggtatagccattatggaaaacaggaagttcctgaaaaaattaagaacagctaccaggaatcccacatctgggtgtatatccaaaagaaatgaagtcagtaccttgaagagatctctgcagcccctgttcattgcagcattattcacaatagccaagatagggaaaaagcctcagtgtctactgacaaataaagatggatcaagaaaatgcatgtatgtatacacacacacagtggaataccaagtcttgcagaagaaggaaatcctgtcatttgtgacaacatggatgagctgagagaacattatgctaagtgaaataagccagacacagaaagaaaaataccagatgatctcacttatatgtggaatctaaaaaggttggactcagaagcagagagtggaatggtggttaccaaaggccagagggtgcaggaagtgagcagatgttggtgaaagggtgcagaggttcagctatgcaacatgaatgaattctggagatccactgtgcagcatggtgactatgatactgctttgtgtatttaaaattttcagagagtagatcttgtgttctttcccctctccaaataaaaggaaattatttgaggtgatggatatgtttaactagcttgactggggcaatgattttgtaatgataagtatctcaaaacatcatgttgtacaacataagtatacaattgacccttgaacaatacaggtttgaactctgtgggtccacttacatgcggttttttttttctgtaaaagttacacccgatgcgtcagccccttcttctacctcttccacctctggcacccttggcacagcaagaccaaccccccacttcctcctcctcctcctcagcctactcagggtaaagacaaggatgaagacctttatgatgatccacttccacttaatatataataaatatattttctcctcatgattttcttaaaactttttctgtattttattgtaagaatacagtatataatacatacaacatcgaaaa

SEQ ID NO: 4278 - DNA, 374 bp, Homo sapiens
ctcatcctaccgggcttcgggataatttcccatatcataacatattactctggaaaaaggaaccatttgggtatatgggtatagtgtaagccatagtatcagttgccttcttggggtttatcatatgggtccaccacatatttacagtaggaatagatgtagatacatgagcatacttcactctgctactataattattgctattcctactgttgtcaaagtcttttagctgattatctacacttcacaggggtaatatcaaatgatcccccaccatgctctgagccccagggtttattttcctttttacagtaggaggcctaaccagcattgtattagccaactcatcactggatattgtactacatgataca

SEQ ID NO: 4279 - DNA, 1999 bp, Homo sapiens
ttcttcctaaaatagttataaatttagtgcaaccttaataaaaatctcctcagatacttttttcctggaactagacaagttgattaaaaagtttatatgaaagaataaacaagtgagaataaccaagaaatacttggaaagaacactaatgtagtgcatggctaatctggctaatcctattacatatgagacatggtctatcatatgaaactttctaacctgtgtaattggagttcaaggagggaggaagaaaagaatgtggcagaagcaatatatatcagtcattacttgatattttacttggggtagtttatatatttacattactgagataaatacatgaaatacccccatataaatatataaatgttaataatatagctgctccggctttttaagaaaaaaatagaatgcacatggtacatctctttctatccccttgtttttaatttatctgtgtatttttatttcaagcgagcatcttttaaatagcatatagttggtcttgcattttaaaatccaggctgagaatctccaaggaagacgaaagcagatctcattagagcaagggagtgtgttgcaatggaaattcactaggccttggagttaaaagacagggattttagtcgctagtaactgtcagatgcatgtgagctgtaaagcctgggtcaagctgccttgctttcctaaattgtaaaatgtagacgttgggaaagatgatcctcaagctcagaccttctatgattggactactggtctcttgtaccctctggctagaaggtagcatagtgtttaaaccgcagccctgttacctacacctttatggaggttaaatgagttaacgtttacaaaatgcttataatagtttggtatgtagtaggctctatgtaaatgtttattaatgttgaggggtggcaagggaaaaccaaatgtagtgacctccttgtcaagtaagtcactgacagtttgctccttctcggagaaagcctcgactatctcaggatgctcagatgaaatgaccattcatgacccctttctgtttatcctactctttctgtcaagattgatagacatgttatgatccagcactacaggaagattaatgcatataaatatatgagcacttaaggaaaaaaagtttctaaggcagtctgaatgggaattgtgcatcataatatttagtcccccagagctgttaaaagaagggggttttacccagagtcagatgcatcaggtgctggctttcttccttctttcctcattgctaccaaatggtgtattatttaaattgcaattataataatttctagggattccactaagactcaagagagacctctcttctgcagataaggactatctgtgacctgagcttcagactcagttaatctcccacctggacgtagggatgagctggagcagtgatcacctcacccagcttccccagcttctctgagagatgcacagccagctttactttacttttctttttttttgagacagagtcttgctctgtcacccaggctggagtgcagtggcacgatcttggctcactgcaagctccgcctcccaggttcacaccattctcctgcctcagcctcccaagtagctgggactacaggcgcccgccaccatgcctggctaattttttgtatttttagtgagacggggtttcattgtgttagccaggatggtctcgatctcctgacctcatgatccgcccgtctcggcctcccaaagtgctgggattacaggtgtgagccaccgtgcccagccttcaacagctttacttttctagaatctgttttcttcttagcgattgctatggtttctacaagttccccaaagccctgcagtcttaccttgccagatgccaaggcaaacataaataggtacaaggtgatattccaaggtatttaatcataatggattatattttatatatcttaggctttatgcaaatatgttcatcaatatatcatgtcattagatggggggg

SEQ ID NO: 4280 - DNA, 1063 bp, Homo sapiens
cacaaatacacacccatgcacacagatcctcatacacacacatgcacaaatacacacccatgcacacaatgcacatatatcctcagacacacacatatgcacacacacccatgcccagacacacatgcacatagatcctcacacacacatgcacaaatacacacccatgcacaaggatcctcacacacacgcacaaatacacacccatgcacgcacacacacatagatcacactcacatccacaaatacacgcccatgcacacatacacacatgcagatacatcctcagacacacacatgcacaaatacacgtccatgcacacaaacatgcacatagatcatcacactcacacacccatgcccaaatacacacccatgcacacatacatgcacagagatcctcagactctcacacacacacacatgcacagactcatgcacacagatgcacaatcagccatgtccagcccagaagtggaggctcagctaaagtcctggaagccagcacctggtgaccaccatgtagacagcatatttcaccggcagctccagttggaattcggttttgttggttctgggcatgttgttctcactggagggaaagaaagagctccagccggctcttgagaactgacagttagtctttgctcctccctctccctcactccctgcctccaatcagccaccaagttctgttatctctgcatctgaaaccccactgttctccaacccctgcccccgcctagcccaggcccatccctctccagctggatgtctgcaaccaccttcttctaactggtcccctgaattcacacctgctcccaccccaatcgccagccctcctgaagagtgatcgttctaacatgcaaatatgattatgtcactcccagaggcgaaactgcaaatcccaaacaacacccgtcagtcattttgggacatggcctgtatctaaccaccaccaactccttcagccctgcatttcatgctgaggccactcttaaacacaccctgatcttcccgtccctggtatctgcttcctgccttctgtcttcatgcccgccct

SEQ ID NO: 4281 - DNA, 1726 bp, Homo sapiens
accaggtccactggacaccaaacgtggaggctgtattagcccgttttgtgttgctctagaggaatacctgagactgggttatttatttatttatttatttatttatttatttatttatttttgagatgaagtctagctctgtcacccaggctggagtgcagtggtacgatctcaggctgctgcaacctctgcctcctgggttcaggctattctcctgcctcagcctgctgagtagctgggattacaggcatggaccaccatgcctggctaattttttgtatttttagtagaggcagggttttgagatagagtttcgctcttgtagcccaggctacagtgcagtggtgcaatatcggctcactgcaacctccgcctccagggttcaagcaattctcatgcctcagccacccaagtagctgggattataggcgtgcaccaccatgcctggctaattttgtatttttagtagagacagggttttaccaggttggccagcctagtcttgaactcctgatctcaagtaatttactcgccttggcctctcaaagtgctgggattacaggcgtgagcaccgctcctggccctgagactgggtaatttataaaagaagtttatttgcctcatagttctgcaggctgtacaagcatctgctaggcttctggtgaagcgtcaggaagcttttactcctggcgggaggcaaagagggagcagacgtgtcgcatggtgagagagggagcaagagagaggaggcatcaggctctcctgtgaactaatagaaaactcactcattgaatcacttgaacccaggaggtggaggttgcagtgagccaagatcgcgctactgcactccagcctgggctgtgagtgagactctgtctcaaaaaaaaaggaaggaaagaaagagaaaaaaaaattagaaattagaaaactcactcattaccatggggagggcactaagccattcatgagggatcccccaccatgacccaaacacctcacactataggccccacctccagcactggggatcacatttcaacacgagatgtggatgggacaagtatccacactatgtcagaggcctccctgtcatcagagtcttctgtcctcggttcaggtgcatgctggcttccatgcctggcttcctaggaagtcatcttggccccatggggttgggccgggccactaggctgagggttggagccctatctctcctagtcccagcctgggtctccatcactgactagcccgctctgcttgctgcattctctccacacctgttccctgtagcccaggggtcagtctgggtgcaggcctgggtagaggtccaggagcagattctgccccccagctcatacctcctgtgcaccatggcagccaaaatgcaccagcatgaccaggagtgctggcttgtccctgtaatcccagtgtttttgggaggctgaggtggaaagatcacttgagaccagcctaggcaacatagccagaccctgtctctacaaaaaataaaattaggcatggtggcgtgtgcctgtagtcccagtatagcaggacaagccgcagacaaaacttcgtagacaccgagttgtagaagaagggctttattcagctgggagcatcggcaagctactgccttaaaatccgagctgagtgcacaatttttgtcccttttaaggcctcacaacactaaagatttcacatgaaagggtcgtgattgatttgagca

SEQ ID NO: 4282 - DNA, 7692 bp, Homo sapiens
tcaggcgccacaggaaaggctccttcgggcaggcctcagctttcagcttaagtttttttcctttggccgagtcaactgcggtgccgagttgtattttcctttcagaggtgtgtccgagaaccattcttaggagacgcctgccggccgctttgggatagggcctgtctgcccatgctggcttccaaaggcctctgtgtgttcctgtatgtgggcgtgcacgtacctgtcacatgtgtacgcgcagaccacaggatgtccacactggcttccaaacacatctctgtgtttctgtctgtgagtgtgtacgcaggtgtcaaatgtgtacgcacagatcacagggtgtccacactggcttccaaacacgtctctgggttcctttatgtgcgtgtgtatgcacttgtcatgtgtacacacagatcacagggcatccacactggcttccaaacatgtctctgtgtttctgtctgtgggtatgtacacacatatcacatgtggaagaggtaggaagaggctggaacaggtaagggtcatgaaggtgcagtgcactattgtactgtttgcgctttatatgtgtttggttagttttgcaagaacatgctggtgaaggagagagaaccccaaacaattgattagcagtgctactgaaactcagatatacacaggaatggcaaagaaacatctatgaaaaaaagcagattctggaactccatctccctgagattgtcactcatggggtctgcaggaagtttcaggaatctgcattttcttctaataaacgtggtccacaggttataagttgagatacaaatagaatatataaagtaaaaaaggaaaatttgaagtttcctgcctagcccaactcttctcattggtagtgtctgttaaattggaaacatatctctttccagacatattaataccttttatacagttgactcttgaacaacattagtttgaactgcgtgagtacacttatatgtggattatcttttagtttactaacttgacttaagaagtcctgatcattttttgatgttcatgcataccgtatagatcctacctcatttgactcctacaaaatatttgttaagggtgttctaaaagttactttttgtagttaaactacactttatttacatttgtttgttatggaaataatgcataataatcgttaaaaatccaaacaaaaggggggaacatattaaaagaaaagtaagggtctccctgctactctacctacctacccacctaccttatctgttaccatatcctagacccaactgcaattaacaatttctggttttagttcttctggttcttttcattataaccttaaatactgtacatatacatcttgactcaccagctgaaaatccttcggtgacacttaatgtcagacacacacacctgttatgagagtttcctgattgaataagaaagaggcattccaggcagaagtacccgaacatacaagagtgcaagaccaagaggctaaggcagattgctctgtgcaagaagtggcaggtagtgtggcgtggctggagatgaagaaatgactggattgggaaggactttatccaccaatctaatgaatttgactttcatcttgaaggtgtgaaatagcgtgctaaacaagtttaaaagcaaaatgtcattagcctatttgtatttagaaagagcactccagaagcaaggaggggatgggtgaattggatgtactgacactggaacaaggaaattattccaatagtccaggaactgactcacaagatcactgaggctggcaagtctacaggatgagccagcaagctggagacccaggagaactgatggcatagttcctgaccagaggctagcaggcttgaaatccaggaagagtcagtgtttcaatctgagtctgaaggcaagaaacaagctgatgtcccagtcaaaagatcagaaggcaggagagattctttcttactcagggaggatcagtttttttgttttattcaggcttctaactgattggatgagactcactcatatgttagggaggtcaatttgctttactcaggctatccatttaaatgttaatctcatcccaaaacaccctcatacacacacccaggataatgtttcagcaagtatctgggcactctatggcccagtcaagttgacacataaaattaatcacaaatatgttccagtaacttagtttttaaacaactagattcttatgagaataaactcaggataggataggggaaatgctttctggctttccacttgcatattcttggaatgtcactttttcttaaatgttaaaaattgaaggccaggcatggtggctcatgcctgtaatcccagcactttgggaggctgaggtgggtggatcacgatgtcaggagttccatatgcccacagacacacagctagcagctgagatgaaccacccaagtctatttggttttcagctcatgttcttttcatgatattttgctttctctcaatatttatagaatttaatttaattgactagaattaaactaagagaaaatgattgaatgaagagatgcagaaggcaagagatagcaaaggtcattctgggctgggcatggtggctcacacctgtaatcccagcactttgggaggcctaggcgggtggatcatctgaggtcgggagttcaagaccaccctggccaacatggtgaaacacccccgtctgctaaaaatacaaaaattagctgggtgtggtggcaggcgcctgtaattgcagctactcgggaagctgaggcaggagaatcgcttgaactggggaggtggaagttgcagtgagccgagatgtgccattgcactccagcctgggcagtaagagcgaaactccgtctcaaagcaaaaaaaagaaaagctacctttaccaaagacagttaaaatgatggccaccaaggggcagtgtgcagcaggcagagaaggtggctttttaaattatttttcactgcctgctgagacaaagatgttacaccagaatatgccaccctaacatatgcttctttggcataaggattattttgagctgaagacgattgagaagaaacaaataaaagaaaaactctgccttccctttctttgcctaattttttggacagggacacactaaggttagctagaagcttgcatggtggggtgggggaaatgcctgcagctgcaaggaggtacccaggacaaggcatggaaactccccctattcttgttagcacatgcaaggtggaaggagaaaggcagtgtggagtcgcccaagctaagagcctgcctgcatgataaaagaatggggtaggggctgccagagattccactctatacagatgacacacctggtcctaaccaggttttcatgccctatgtagataagatacccgctccctactagctcgttgataaaaaccctccattttactgcagcacggcaacccgtctgggacctctctctgtgagagagagctgtccttttccttttgcctattacacttctctaacttcaccctttgtgtgtctgcattcttcatttctgtggccatgagacaaaaaacctcagctgatatcccagacaacaaggctgctttagagggaaaacggatagctaatattatcagttaattggctatgttaattgataccttcaaattaggtgttttaaaataaatgctgagaacaatatgaaagtgtttttcttttactaattctctgaggattttgttatttatttagctttacaatgcctagccccctttataaatgtaattattgtgttgctaagtgcatgtatacaaaaaattcattggttcaaaagccataggcctggtaccatagccatatatggtacgttcaaaccttggaaatgcacattctcagtgtgtcggaagctctgtactgctccttcttgaagaactactttgatttgtggttaactcgctgttttgactcactgttttaactcccattacttcagtatctgacattcagcctcagaatctggccagtgtatcagggctggaattaattgattaacaccattagatggcagtactatttaaattccaaaaatggttataaactcattctctaaaatgtgtgtcaaatagaatatttgactgataataactctaagagcacaaaaggattaaacacacacacaagacaaagtttgggatatacccattggaaaaacccttggtctctttaaattttttttcatatgtatgtatattgcacatattgccggcctctttatctcttttttccttttttttttttttttttttgagaaggagtcttactctgtcacccaggctggagcacagtagtgcaaacatgactcactgcagccttgaactcctgggctcaagcgaccttgattattttttagatataaaaaatattcacacattaatttgatcacaagaaattttaaagaaatttaaacattttcagaaaaggctacttcaaggtgtcatgacagctttggaccaaacattaatgttctatatgactttgggcaagtcagtcatgtttattagacttaataacccaggtaacgttagctgttggagggttttttaaaaaacgttttattttgaaaaaacttcaaacttaaaggaaaaatggcaagaatactacaaagacctatttattcagatacaccagttgtcacaattttgccatattaactttatctattgatcaatttctctttcagtctattgacctatctatcttgaactatttgggattaagttgtagacatctgatccccttacccttaaacactttaccacgtcttcctaagaataagaccattactccacacagtacacttatctaaatcaggagacagcattgttataatactgttaccaagtggcaagctggtgcactgtccagacagggagagagggagagaggacctgatttgtaacatttgccagttcccatgtgtgatggtttactttggttcataactaccattgtccttgttacagtcttttattaaaatgtggggtgtgttaggccgcaagggcaggcctcaagaaacagaatctctctcctgccctcctttcacctgccccaaggcaggattccatcttctcccacctttccaactgtgggtcttaagacttttcagagagggtcctgccatacacactgggggaaggaatgctgacgtcatgaagcttccatgaaaactcaagaggactgagttcagagagcttccggatagctgaaaacatggaggttcctggttcctggagggtggcgccccaggcatggaagctctgagccccttcctccgcacctcatctcttcatctgtatcctttgtaatatcctttattataaaacagcaaatgtgtttccctgagttctgtgagccactccagcaaatcaatcaaacccaaagagggggtcatgggaaccccaacttgaagctcaatcagaatttcccaaggcccagatttgcaactgatatctgggggtgagggtggtcttggggtctgagccctcaatctgtgggatctgatgctacctccagatagatagtgaaggaactgggtggaggtcctggcttgtgtctgcctcttgggctacacagtggtagaaaattagtacaagatgaaaaagatttaaaaggaaatgacagatatacatatataggaaacaggcaaggaagaccctgtacacatgggtacacgtgcatgcgcacacacacacagatatattagttcctaaagaaataaaatcagccaggcgcggtggctcacgcctgtaatcccagcactttgggaggctgagacaggtggatcacctgaggtcaggagttcaagaccagcctcaacatggagaaaccctgtctctactaaaaacacaaaattagctgggcgtggtggtgcaggcctgtaatcccagctactcaggaggctgaggcaggagacttgcttgaacctgggaggcggaggttgcagtgagccgagatcgtgccattgcactccatcctgggcaacaagagtgaaactccgtctcaaaaaaaaaaaaaaaaaaaagaaaatcaaaaggaatagatccaaacaaacaagatgtataattcaggaaaggtttcctgaaataagcatatacttgaaacgacatattgaaagattatctaaacaccttggaaaatggagtccaaatatccaataccaagacattctagtaaagggaaagaaggaagaaggggaaagagggaagagaggttgaggctgcagggagctatgatctgcactccagcctgagtaacaaagtgagactctgtctcaaaaaaaataaaaaaaataaaataaaatgaaaaaagatactcgaggaaagtaaagataagccaaaataattttcaagtataaaagcagcaaagtgttaccaaaatgcaaagactcaggaaatacagttaccataagctattcctaaggaatctactagtgaacaagtttcaaacagtcacaatgactgcagagacattgacgtaaagacagatggcaaatattaagtgggtgggtaggtagatacagctgtagatatggccagctgtttgctggaggcaatttggacaagcttatgagagccaatgaacttttcaagaattttatgagttggttattaaacatagacattatgaacagttaaagtatatacatgtacgtacatttaaataaattaaaaacagtaaacactaggggtttcaccatgttcgtcggtctggtctcgaactcctgacctcatgacccaccccctcggcctcccaaagtgctgggattacaggtgtgagccaccacgcgtggcacaaaacaaacattcttaatgagagtacctctaatatatcacttacatgcagtcaactccaggataaatcacgtaaatatatattctagctgtatgatagagtcaactcttagctctctgcaaaaggctaatggtttggatttttaatgagaagaaataaaactggtagaaatacagtaacattgaaagtattttatgaatttttaattatattcaataattttctcaattttaaaagaataatgtgaaacagtatatatgagtcagtctcatatttgaatacttgtatggggtaataagttgtgtaatagttaaattcccaagagaccgaaaaaataattacccgcattttaaaacagtaaattgagggtgaaaagactcaatcatttcctcagaatgttttctcgtaactgactcataaataaatacagtcttcctgtagattattttaattttacccaatgaaattcactatagaggttatcactaaacaggacatattcttgcgtttttatcacattgtttttggtgacatttcaagaagccatagtcataatttagtgtggaagttatgtcggtattcacagtaggcagatacacacaaaataatgtcttttgacagaatccaaatgcttctgtccaaatctgctcttatatctaagaagtaattctccttgaaagagcagctttacataagctttaaaaccctaattataagctcagaaactcagctctaaattactttaattacataaaattgatgtaaatcataaagtgtagagaagtcacttttccttttgtctgttggctgcagcaagcatcctaagaactgctccaatgtctaagc

SEQ ID NO: 4283 - DNA, 1774 bp, Homo sapiens
ggggtcaagcccccttggagcctgcagcccctgccttccctgggtgggctgatgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatagataggtgggtgagtgggtggcccttccattaaaagggaagccagctgtgtcctttccgggcctggaggcttggcccctcctctcccaagcctggcaggggcactggcccggcccgcaccttcctagcagccagttacccaagaggaagctgccttgggcctccagaccgttaaatgccaactcctggcttccggtatcaggctgggttgacctgacctggccccttcttgctgggccctgcagctttctaacttgccgggaggagcagtgacacccgccccacatgtggggcatggaacaagttccttgtggacccagaagggacacaagcaggtgtgcttagtcctgaggcgctgggaatagctgatcctccctgccttgagggggttctcagggcagggaagagttaggactctgtttttttttttttgtttttttttttttgagatggagtctcgcactgtcacccgggctggagtgcaatggctcgatctcggctcactgcaacctccacctccccagttcacacgattctcctgcctcagcctcccaagtagctgggattacaggtgcacaccaccgcacctggctaatttttgtatttttagtagagaccgagtttcgccatgttggccaggctggtctcgaactcttgacctcaggtgatctgcccgcctcagccacccaaagtgttgggattacaggcatgagccactgcgcccggccaatttttttttatgttttgtagagacggggtttcgccatgttacccagactggtcttgaactcctgacctcaagcaatctgctcgtcttagcctcccaaagtgctgggattacagctgtgagccaccgtgcctggccttttattgtttgtttttgagacggagtctcactctgttgcccaggctgaagtgcagtggtgtgatcttggctcactgcaacctctgcctcctgggttcaagcgattctcctgcctcagcctcctgagtagctgggcttacaggcacccaccaccatgcccggctaatctttgtatttttagtagagacggggtttcaccatcttggccaggctggtgtgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttca

SEQ ID NO: 4284 - DNA, 1772 bp, Homo sapiens
ggtcaagcccccttggagcctgcagcccctgccttccctgggtgggctgatgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatagataggtgggtgagtgggtggcccttccattaaaagggaagccagctgtgtcctttccgggcctggaggcttggcccctcctctcccaagcctggcaggggcactggcccggcccgcaccttcctagcagccagttacccaagaggaagctgccttgggcctccagaccgttaaatgccaactcctggcttccggtatcaggctgggttgacctgacctggccccttcttgctgggccctgcagctttctaacttgccgggaggagcagtgacacccgccccacatgtggggcatggaacaagttccttgtggacccagaagggacacaagcaggtgtgcttagtcctgaggcgctgggaatagctgatcctccctgccttgagggggttctcagggcagggaagagttaggactctgtttttttttttttgtttttttttttttgagatggagtctcgcactgtcacccgggctggagtgcaatggctcgatctcggctcactgcaacctccacctccccagttcacacgattctcctgcctcagcctcccaagtagctgggattacaggtgcacaccaccgcacctggctaatttttgtatttttagtagagaccgagtttcgccatgttggccaggctggtctcgaactcttgacctcaggtgatctgcccgcctcagccacccaaagtgttgggattacaggcatgagccactgcgcccggccaatttttttttatgttttgtagagacggggtttcgccatgttacccagactggtcttgaactcctgacctcaagcaatctgctcgtcttagcctcccaaagtgctgggattacagctgtgagccaccgtgcctggccttttattgtttgtttttgagacggagtctcactctgttgcccaggctgaagtgcagtggtgtgatcttggctcactgcaacctctgcctcctgggttcaagcgattctcctgcctcagcctcctgagtagctgggcttacaggcacccaccaccatgcccggctaatctttgtatttttagtagagacggggtttcaccatcttggccaggctggtgtgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttca

SEQ ID NO: 4285 - DNA, 2684 bp, Homo sapiens
taggatttggtattagaaaagatgtgtaaatatcttagtatataattgtttctcatttgaggtttttcttctaagggaccttaaagagttttatatacttttgctcacagaaactgctggtgagattaccattttttgagtatctagtcttctagtttttcttttaggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacat

SEQ ID NO: 4286 - DNA, 1905 bp, Homo sapiens
tacacacagtttaatcctactagattcacatttcactactgacaaagatttgtattctgcaaacgtgaagaaaaacgtgtaagtttacaaataattaaatactactacaaatcgtcctagtacttttgagctggttttacatctgagacatactaataatctgcaggcagagtccattttgtaaataaccattgctacgtaccttacacgtattcttacttaattcctcaaagaattttagcagaacagtaagctgtgctcccctctcccaaaccacttgggttgatatttaagcatactgggctttgacttcagaaatcactattcatgaggcctatggtttctgtccactcatcagcaatgttaggattagctctgcacaatctctccctcactcacacaatccccaagttgccagtctggcaccacaggctctagtttattctccagcacaccactttgtgtcctcagtctctcaattccagcaaaaggggaaggaaggttttcaaatggaaccaaggagctctctgcctaaggaggaggcagcagcacccatttctctgtggcaaaaacaatgctacctcttacccaactagtttaatttttcctctagacacatagctaaactccgtttcccagcctcccctgatattcaggctgggccaagtgacttatttctggcctggaaaaaaaataaaacaaagcaaattgatgttcccatcctgcagagcccctggaagtcacatctgcagatggcagaaacacaggatggaaaaagcgtaggtctccaaatgaccacatggagcagagcccgcacccccgaccccagccccatccccaaagactagcactgaactaagaaaataaacctttaatgggctgagccacttaaattgtgagtagtttattagcctatcctaatgaattctgctcttccaaaaaattatctaacatctttatttaaaaaaatcaccaataataaagcatcgctttacaacaaactagatttaaactggtaaaaaatattatgaccaaaagatgcgcttgcatcctgaaaagtacatgaacctagattcacatgaataattcctagagatccaacttaaaccacacttctattacatagccaattaacactcgttcaccttcaaaaatacatctatctaataaacagagtctaccaagggatattctccaaaaactctaagtttaaattcgagcaaaataataatgaactaattttacagtacacaatttgctctcagagtttggagtgctgaattacagagctggaaggaaatgtaagtattttttaatccaactcctgcctgagagccagctcaaaaccctcccacaaaacacctgacatctctctgtccaggctccttgttacaatcataatgaaaacagcctaggaaaacatgggttttttaacatcaggagcaagaccctgggctggttctttgcctgcttgctaggacgttcgcaggggtgcggtgctaccagggcaggggtgcctgtctctcccaacgcagacctgatctccggaggcttcgagagcatggttcacatcatgtccagctgcctctccctcatcccacagtgaatcctgtagcaacccatcctgtaaccaagccacccaaagctctgctgtagaaaaacacacagaacacacggaagcaagggccagaaagaccctctgggtggggcagcacttaggctggaaaccagaatgggccctagaattgctctgagcagtggtgggatgccctgcagggtgcctggagtcacagcctgggggtcaacagatggggcaggtctctgatgatgacggaatcccatcatctctctacagctacaactgtgtctacaatcgtcaagatatggacagcggcaccgcttttt

SEQ ID NO: 4287 - DNA, 2442 bp, Homo sapiens
ttggtttatgtaatagttgtctacgttccttcctcctctgaaaattaatgtgggttgtcagaattacagactttttaatgcctaagattttaagaaataaacctgtaggtgttggcaggacttatttcatttagattttaattagtttagatgtgtagaaatgatttttatctgtaaggctctctctccaccaaaataagtgaattgtttgggagtaaactagttggtaagttgggccttgctgatagatttatacactggtgtgtaagccctatactgctgctgtcactaatgtttttgatagtttacttaggcatgactgctgttaatgaagtttgctttgtgaatactctctctttccttagccttggcaacattcttctctgtgctatctttatgcttttagaagaactagaaaaagcagatttaagaactgtaaagaaataatactagctttgagtttttaaaaaaaatattgaaatcccatctctgtatccaaatcctactacacatttgataataaatctgccaaactgagttatggaatatgagctgccttttaaaatccttattctcctgctgaaggtgttacctcaccaaataaaaatatttgcagctgcagccaacatgagactttgcaaacatcctagtgatttggttatctcaactatgtcttgaacagaactgagaagaggggaaaaaaatgactaaatggggtgagttgtttcatattttctttacagataggctgctacagaactgcaaagtagctatcagtgatactttctctggaataaagaaattttgattgtagaacattctcccatacttaggaatctgaagcacaaggagctttgcttcacttaaaggtaacaaaagtgcttgtaagataacagcgatgaacttcctatctccatatggttgtttggtctaagagacttttagtccactgtggcctttctcttcatagtactgcggctctgctcatgatgattttcagtgtcaaccaaaaagtaagtgaatgtgcaggcatgaatactgtttaaaccaaagaaattatttgggatattaaatctgtggatatttgggatttaaaataatggatatttaatccgtagtatcattgcttttgcctaaaacgtagcatttccatcaaatggattcaaatgttgattaaaacctaatatattttatttagcaaaataccgtcttctagggatcttagttctaatgtttttttgaacttgaacaaacaaaatggactttgctttactagttactttcatagaaagcccttcattcgagggaacacttgaaattctcttagttttaatttataaatgaggaaggtagtaatgttggatattgttttctctatcctccattccaccctcccctattttgtagcagtaatcaaggtttgagtgagcctcattgacttagcctcatcactcttagtacctcttaataagggcagcaggtcctcctagaggggtattttgacagtttgtaggggtgtttcttcagtggttaggggacactgcaaacaatttgatgggtaggaccaggaagaattatcccttgtcctgcatgactttctgatttcctatcagatacttaaataggtaaaaaacctgtttataatgatctgatcctcgagtctgactttttaatatattaatgcaaaatatttttgtgtggttttaatatgcagtacactgaatttttagcaatacaactaccttataaatcaaggaaataatgtttagaatgctttcaagagttgttcgccattttggaaaattatatcatcaacatattattgggattgccattataatacacaagggtcagttttcatttgtagctgtcacattcatctctgtcttctgttgtagccgtacctgagtatttatgtattacaacgtacattttatcgtaaattttatttctcccttaacaattaagagttttatttggtttttctttaagttgtgtgtgtctgtgtgtaggtaggtattatctaggaattttatttcagcagagtaaaaggatatcagattgggtggggaaccattgctgtaaacaaggtaataatctgattctgtgttgaacaggtaacctaggttgatccaaagagaatgacacctaggatttgttgaagaatggatgaggaagtgctctcgctaaggggtgtggtctgcctgtgtaaggttaggcctgggactgttatagccattttgctgtcttgagggaaactacctagtagagaaaaatggaatacacagtggaaaccaccttgagcataggctagtttggtatttcgtgcaaaatacacccatcttcagagttctcttttgagtttgaaaacacaacctatgtattttaagggtctccatttgcctaaatctcatctttagcagtttaatctacaaacagcac

SEQ ID NO: 4288 - DNA, 504 bp, Homo sapiens
gcgtcccctaccacagcacttcagagaagcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatcgccaaaaatat

SEQ ID NO: 4289 - DNA, 1434 bp, Homo sapiens
ggcagtcgtcggtaacgtggccgcagcccgagagcgtgacggacgccaggttggggcacctgtgaggagagtgcggtgacccggggctcactggcttgttaaagctacccaaccgccccatgggaccgagtggactcatttaccgaggaggactcgggccctgcgaggtcacttcatcctggcccaggtactgcagctccaaatcgtggggattctgtaagagcttgctacctgttgactgaggaggcccacgagttgagaagaactagcaagagtggtacaaaactgcaggtcattgggctggccaccaggtattcccacccaccagaagctggctgttgtactcacccggaaccatggtgcaccaccacagcggcgaggtcatacaggcagctctccgggccactgttctcaggctacagaacaaggaagaaggagcagtggtcaatgacatcagtatctcgatgacctctaccctctccatgtgatgacaatcttactgaagagccattttttcaccatgctaaaaaggtaaccaccttacctctagtaagtagcatttcatgtctaggcctctcagtggaaattctacgtatgtatcaactttatttcttaaatatgctgtccaatgaaatcttttcaaatgtaagcatagcacctggaggacagagatgcggtcaaagattgtgaacacctaatttacctttcagtcaaagtttgatactactatcagttcagtaaataacattttagctgccctatcaatcattcttccatgcataccttatgcattcattctgtaaggggtttagcttttactgaaaatcctagagaaaaatacagaacagttcacatagtgtaaagttatagacatggtcttagcagtcaagcactttcccattgaaattgcttcataactcaaaattcaacactcaccttgggtagtttttgaatccaaaacttttttgtggacttttgtttctttttgcatttatggcacatatataactctgtctcatcaagttcttctaagtcggtaaaactgcgaagacaatctaaacaaattgattttggcagcattaaaacaagatgccttttgtagaggcaatgtactgtagaaaaaagacccaggtttaaaatctcagctttattagctatacgaccttagaaaagttaacctttctcaattgcaaactggagacaaaaaataatacctactttgaagaactattataaggaagagaaataatgtgtagagcacctggcatcatgcctgacatctggtgatgatcaattgtgttggttttactattaatgataattcatctggataattctgataaaatggtttcctgatgaatttaaagtttcaattgtagttttctgtcaatatgttacattatacaggacaaagctccaaactcataaaaaaaa

SEQ ID NO: 4290 - DNA, 642 bp, Homo sapiens
actgtcaaaccagaaaccacccctactcctaatccccctgtgaagaggagaaaacagaatctaatcaggaggttgctaacccagaacactatattaaacatcctctacagaacagatgggcactctggtttttttaaaaaagataaaagcaaaacttgacaagcaaacctgccgctgatctctaagtttgatcctgttgacttttgggctctgtacaaccatatccagttgtctagtaatttaatgtctggctgtgactactcactttttaaggatggtgttgagcccatgtgggaagatgagaaaaacaaacagggaggatgatggctaatttacattgaacaaacagcagagatgaagggacctcaatcacttttggctagagactctactgtgtcttattggagaatcttttgatgactcagtgatgatatatgtgcagctgttcttaatgttagagctaaaggtgataagatagcagtatggactactgaatgtgaaaacagagaagctgttacacatatagagagggtatacaaggaaaggttaggacttcctccaaacatcgtgattggttatcagtcccatgcagacacagctactaaaaacagctccaccactaaaaataggtttgttgtttaa

SEQ ID NO: 4291 - DNA, 1099 bp, Homo sapiens
tcgcacagtataacttgactacttgcattgcatacttcttgaagcacaggtcttcttgctgtttgaatttctctccataaaggagatataaaacgacaaggaataactagaaaggaaattgatcttcttagtgatagcaaaataagaatcttctatggaaaagttaaaaagcaattattttgttgctattccttatagttttctgaaatatgcatacacaattatccaaaccaaacagaatctgaaccatttatgaagacacctgcaaacccaaacactgtaaaaaattgcaatgaagcaaggagaaccaatacagtcatatttggagtacactccatggatagtccaaatcaatatgaaaactattttaggagctataaaatagctctttttcactcagtgttgcttctaacaataaacagaaatacttttagctcacactggcatgtaaaattgggatataatgacaacttcagattaaaagataattcatcagtttggtcaggttgttttagtagagaacatggttcatttttttaaccattctaggggctgaagtaatataactgctattttcctttacatattaatgcaactcagactatgtatccacacatttctcactatttccctataaaaatcaaaataaacctaggcatagttattcagcagggatcgtacacatacaaagatcttgctacagtgtttactgaacatgctcctatgttaatgcttattaaaaatgtgaatcaatgtgaatgtatggtatttttgctggcttgtcttgaggatttcattaaaaaatgctcaactctttctgttatagtgacttatttcatgcagccagtataaactgaacatgtccccagaaaagaggtagaatgtcaaatgcgattagaaactcaagagctgattccaagattgattccaaataaggttaacgctcatgagtaacaacgtaatcatatcctatcagcatgtctttgaactgacacaaagcctttcatttaggagccattcattaacccaaatattgagggaaaacaatctgaaacaaccaagaaaaataaaaatcagaaaagtaagtaagcggttctgg

SEQ ID NO: 4292 - DNA, 6347 bp, Homo sapiens
gtcagcgaacgagcgcgcgcaatagcgcggggcaggggtcgccgcggccggaagcccacgcggggggttgcagggacgggtcgtaaggggcggggcgggcctcgaggaggcggcggtggggtccccggacctccgcgcgtggcacagcccgcatcctgaactgactcccactcgaggaccacctctcctctcccttctgagggcggaacggaaaggccaagcgcctcctcgcctcgggagctgcaggacgccctaattcagccgagtcgccgcgtgcccgggtgcccgcgaacagcaggagagaggacgggcgctggccccacaggggtcgctttaccccttgaagagctcctcgctgcctgccctgggggtggtgggcgtccaggttcacagggtacttgagcttgctggggtgggggtgtgtatgaagtgcgtccagggttttgtggagcgcgtctagcagttgctctacttcttactgacagtgaaacaagggcgcccacgacaggtgttcccttttcgctgtcgctgccaggaagcttccagccaggttcagcgcccagtggtgtcagccggcccatctcgagccttggttccgctgtcatcttctggtgcttattctggtgtttatccaactgtccgttttgaaattatgttcccaagccatttaacacctctggagaaccaaagcactggctgtcagcggagcgggatgcacgcgcagcggaggggactgggcacgccaaccccacgagggttcctgcggagatgacacggaccttgaggtctgaagccaaaggacgatttgtgtgaagggattttattgttagctttggagccagcaacaagaacacagccctggagttcccggggcaaaaaggataccaagataataattcaggtattacgactaacatgactgcatttgcacccacaggctgtgggacttggggacgtttgagctacatccaaaatacatgagaaaatcacacaagtgaaattggatgagagtgcgaggggtgaagtgatacattatgacctagaattaggggaggcttcctggagcaggtgacatttgcattgggtcttgattgggaagagtggaacccagcagtctagatagggtccagaggtaggaggtacctcgcatcccaggctgcctcagttcatggtgagagtgcagatatttagtgaaacaggaggaaaggacacttggaaatacaccatgaaagaaggattgaagttcttgcagacacatgggagtgtccgaggctttattctccttccaccttgagccagtggaattgcagtgtcttttttctacacctatgcagttttttctacacctgtgcagttttttctaggggaagatcagaccctcctctttgggaggaactcttgcttctttagataatagcagtgacattttctagcctgaaaattatgatgtatgccctgataggtttaattatttgagaagttctcacaaaggtatacagatgtgctaagagtatcaagtcaagtgagtgactctcaagcttcattatggggaagaatatttggtttgcttgttaaaatgcagattccggccgggagcagtggctcatgcctgtaatcccagcactttcaaaggccaaggcgggcggatcacgaggtcaggagatcgacatggtgaaaccccgtttctactaaaccccaacatggtgaaaccccgtttctactaaaatacaaaaaattagccaggcatgatggtgtgcgcctgtagtcccagccgctcaggaggctgacacaggggaatcgcttgaacctgggcggtggaggttgcagtgagctgagatcgcgccactgcactccagcctggcgacagagcaaaactctatctcaaaaaaaaaaaaaaaaaaaaaaatgcagattcctgggtcccacccccaaaagatgctaattttgtagatctgagtaggacctaagggtctgcatttttaatactgaagcatgtggtcttcaagcttatggcatgtagtagggacaggacgaaaaatgaaactggagaatgaaatgaaaccgagtcagtatgagaagggcctcatgcacagcacctggagtttggacttcatcccgtggtctgcaataagtgagtagaggtttctaagtcatgtggttatttttaaaagctaattctagtattgagaaggaatgggagtggaaacagatagtaggttgaatgaaggaatgaatgcagtaaaatgctcagtgaaagatgtggcactttttgttttcagtattctcttgctttgaaccaaaaccacttagaatgtatttcttttaaaacctgtatgtcagtgtaaatattcacaaacaactgtatgttctgacctatgtcttctggacttccagagttagcattaacattattagctgccaggccaacaaaaccttgagtaatcctgcaatactcggaatcaagaaaagtggctacatcatggtcaactttgaagaacatcagcctcaagatcttttatactaactcatatgtttattaaaatctattactaaaacagatttttaaaaattatcttgaggttataatgagacatagtgcttctacctaattcctattgggaaaaaaaaatgttgagatttggggaccaagaaaaaaaattctgatcgctttttttttttttttttttgagatggtgtctctctctgtcacgcaggcttggagtgcagtggcatgattttgtctcactgcaacctctgcctcccgggttcaagtgattctcctgccccagcctcctgagtagctggaatttcaggcacccaccaccaagcccagctaatttttgtatttttagtagagacaaggtttcaccatgttggccaggctgatctcaaactcctgacctcaaatgatccacctgccttggcctcccagagtgctgggactacaggcatgagccaccgctcccagctgattgctttcaattagtattgataatagtttgaaactgggacaagtagcctagtcttggcagtctttctgctccttagctcagctaggtccaagttcttgtctcacaaccaggaaaaactaggcacacagacaccggaaagtgagtggagtggaattgattaagcaaaaggaaagctctcagcaaagagcgaatgctgggagcagttcccctacccgaaagtgggaaaatcccctctcatgtggctgagcctggggcttttatgcactcagaatggggagtgcatgctgattggtttgtgagtttgcaaaaaaaggttaaagcaaagacaccactcaaaggcaggcacgacagtgtagaaaaccaattagaaagggtaagtatacgtaaaataggtgaagggtggagatcagaggaaagcgtgccaaacaggaagacaagttctcaatctagtctgaaaatttaacttgtagtttggctttcaggctttaaactgtcttcagcttggaggtggggtttcaccggggacctgcctctatctgcctaggcgtttgactgtcttctgttgctgtcactagtagcacaatataaagattttgtgctactgtttcacagtgatttgcaattagtgcttttttttgtcatgtagttttgtttttagtgcattattctttaggagaatttatccgtgaagcttgggtatcacagcttactgctatgtccttgatttatacttctcattgactgtgagaagtgatggctagttttcctgctgtgagcaggtttggtgatatacaataccattcgcaagatgttatatatgtgcattgtcacatttctttcaaaaatgatatttccaatttttccaaacattcatatcttctttctggccatcatactgattttattaccaaaataaaatcttatcattaactctgaaaacaatttaaataactataagccatagttagggaatgatttttaataaaacctagatacaaacaccatcattttctcctctaatagcaggttgtcttgcctgactctcaaaaatgagggagctaaatcatacagataggtgacatgttcatggctataaggaacaccatagcataatatttggacagtaagacataatacatatcctgaaaaaactttgatgtgtagtcagtgtaacccttgtcccctgtcctcctccctaacctcaggaaagatccacacttccacatttattccctacccacctttggttttgaatcctcatttccacagatgcagcatgacatctgtaacccctacaaatctgcatacccctccagccttcccagaacttcattccctccatcttcattgccttagctccttttgtctttaagtattcactcactaagtcaagaaaatattggagggggggtggggcaaaacaactaggctttaaaggtgggggattacccagatcaacacaagtctcccacttgaacaactgctctttgacacctgtaccctgagatgtgactatggattaaagtcatagcacccctgcctccaggttggaaagttttatggaaaatgaacatattttattagaagacaatgagaacttcctggagcagatgagtaaacacaccctcatgtttacctgataactgaaatcaaagatgaggtgtagcctctggtttgaaatgttacaaagtgtaaaattaagataaaggcagaaaaatgaaaaggaaatagccagttttgaagcagaagaactcagtgggacaggggccaaatcagtgaaagaggtgctgctcagataccagatttaatgacaaccaaagtggcccaaatatccaaaaaaaattgcgcttctgaaaaccagtaggaggttgcagtggactaaagatggccacaaaatttttatcgttttccccgtcaagaatgggagtttatttttcatcatcttgaatctggccctgtgactgcatcaccaagaagacactgcagaagtgatgctctgccagttctggttctagtcttttagaagactgttagcctctacttcctctttcttcaaatgagctctcttgggacaccctctctcagaaccaaaccaccatgcatggggcatgtgtggcctcttcactcaggagccccagcagagcaaccagccagtactgagcatcaagtgccagtcatgtgaatgagccatctaggatgttctttggtcaagtctatacaaaagaacttaccagctgagcccagccaacacatagaattatgaaatagtaaaatgattattgtttaaagtcatgaaattttgcagtttttttaatatagcaatagataaccaaaatcaagattaaataaaatatcagatgattaaaatggagcatgaaaatggagttaactttgtaagaagaaccacaaccccaatgatcatgacttagaggaaagttcagtaaataaaacagaaaatattgaaaaaggctgtttcattttaaacctgtgtcaagctcctagacctaaaatgacacttgaaattgtcctccattagaattcattgtgctacagattttctctcattctgttacatatatttatttaatgaagtagagaaattcttctctcataagctaatgctgcaaggtgtttttatatgtattatatgtatatgtacatacatatattttttatattaacataacagtttataataaatgtttaagtgttttataataatatttatacatttatcaccatatatacacacacacaaatatatgtatacacacacatatacatacatataaatgtctggggatagaaagtgagaccctcagaatcttggatgtagcctgactgctctgcacccaactggggaggagtgaggggagaagaaagtagagttccagccagaaaggtgacagaagactgcccaaagcttcatgtaaccaatccctcaagcctgcggaaaagttactaaatgtttggtgccagtgccttcctgcagagtcagtgatgcttatgcttggtactgaatcagagacagcaccttcaaccatagtcacacgtctgcaaaagacagaaaaatccagtctgatagctttgttctatgtatttgttcgtgtttacaccaaggattgtagcctgcagctcctgatcttttattctgaaacgttctggaagtagtaaaggctactctataacatacttgttttaataaatgtattctccattttttaatgcaaaactggcacaaccaagagaggtgccatattttgactcatatttttacttcacctcttcatataacacttcattcagtgtcctcaatcaggttctcattcaggttctcaatagaggccaattttgcaccccccaccccctgcagca

SEQ ID NO: 4293 - DNA, 10451 bp, Homo sapiens
gctcctccttggtccccgcgccatggcgcgtccgcgttgaccgctgtcttccctttcgggctgtgctgatcgcgaacgctgcgcagtccgtggtggcgtcgaggcacctttctcgtgcctttacctgtgttcactcctttgctttaaaaaacagccctagaagtacacatcgttggccccgaaggagccccagcagccatgtcggaccgcgaggtgaccttggagggcgggaggacggacgaggggcctggcggagctagactgagagggcgccgccggcgtcctgaaggccctgctccccgaatgtgtgggagtgtgtctgacggtgcgagggtggctgtggcggggcctgagcagcgtgtccgtgtcccgatgccgcccgcctgttactgagttaggcaggagtgcccgagtctggcgaacttcagcagttctcgttccagagctccacacgaggttggccaaagctttgcgggacttacatacccttcttcctccgcccagtcctgcttccttccccttcctttcacgggtgttgataccatgtcaacatcctcgtaccccaaactcagtcgcagcgtctgcttctggagaaaccattctgcagcattaaagctggtgagaagatgggattcgaggctgcatcactcaccagtggtgaagtaggagggtgaactagtgaaatggaatccacgagtgggtgaagtatcagacatttcatatatggtgaacgtagtagataaaaggaaggaaagggggattggatagctattgcttagtgccaaccgagactcttaagaatagtggtcagctgaaggcaagcaacaaacagttgtaagccagtgaatctgtcccgttacatatagagaagcttcatttactgcagcaggtcaaagacaagaaccaggcccaggaattaacatccctgtttgactgaactccaaaaatagcaaaacacccaaacaaggcaatactcttccactaagtttggatccctgctaagaaaagatgaggctgggcacagtggctcacacctgtaatcccagcactttgggaggccaaggcgggaagattgcttgagttcaggagttcaagaccagcttgggcaacatgacaaaaccccatctctactgaaaacacaaaaaattagccgggcatggtggccacggctgtggtcccagctgcttgggaggctaaggtgggtggatcacctgagccctggaagtcagggctggagtgcagttgctggatcatggcccactgtagcctcaacttcctgggctcaaacgatcctcccacctgagcctcctaagtaactgggactacaggtatgtgtcaccacacctggatacattttttattacttgtagaggcaaggtcttgctatgttgcccgggcttgtctcaaacttctaggctccagtgagccatcacacctggcctgccttgaacctgaagcctgccggggtggctcacctctcctattaacctgacactactcctcctccctccacttactgctcagtagatgtataattatggttgtttcttttgcattattcagctggaaacaatgagatagaaaagagaatatagctccctccccctcagaagaactgcgttattagtttgctggggcttcagtaacaaactgggcagacatttattgtctcccagttctggaggctagaagtctgagatcaaagttttcacagggttggttccttctggggctgggagggagaatctgtctcatgcctctctcccagcttctggtggtttgctggcagtctttggttccttggcttatagaggcattgtcccagtcctgcctttatattcacatggtgatcttgttgtgtgtgtctctccagacgaaggcataagtaacatcattgacaaaggtcattcgacatgggcctctttttagaaggacaccagtcatactgattagggcccactctaatgagcgcatcttaacttgtctacaaagacccatttccaaataatgtcacattcacattgaccaggggttagggcttcagcatcttttgagagggacacacttcagcccataacaagctgtaccacccagccaacatgtactgacaggagctgggaaagtttggggctggattatgagggtgcttgatgaagggagctggaatgtaaacttgcatagatgtgtttattgaaatacgtgatttaacaccttggcaaagagtggctgcagacttcctgcaaggatggctcctagaatggcggtatagctactgctgcctaacaaattactccacacttcgtggcttaaaacaagaatcatttcttatctctaggttactgtgggtcagacatagtggggatcggtgatctctctaggttactgtgggtcagacatagtggggattggttatctctcttccacagtgtctgaggcctcagctggagcagttcagaggctagaggttggaatgagtgaaggttcatctgctcgaatgtctgacagctgatactggagattggctgcagcccagattggggatgtcagccagcacacccctacacggccggtccctgtggccgaggctttctcacaatatgatggctggattccaagggcaatctaaagacaaaggacaaaagaaagctccagatgagaagtgcagaagatcctggagacagctgctccagagagtggcatataaaccctacaggaatccaggagcctgctacaatcctaacatttttagggctccagtggtcaggggtgctctagggcatcccttccaaaagcgaatgaattattgctgcttgcacctcctgccgttaagaaagcaagacgcttgttggttctcgagctagttcttgcctcaggttctggaggcagcatgtcccacacctgggagtattgctctggtccagagactagtggaattgggagatttccaattttggaaagagcccagaactggaaacgtctgtacagtagatccgggttgtgatgaagtaatgctattgcctgggccatatagtccaacaggtgtttttttggtgttattaatggtgcagaatgatgcaatgtagagattctgtcatgccacctggagcagagaattgtatgcatttggggggcgggcgggtgtagatctgtcttctggtatgccacttgtctctgacagagatggaacgcctgaccgtaagccaccaggtgaccatgcaaccagaactgcctgttaatgttaaactagcaaaagtcataacatcagttggggccagcaacggtccctcataatatggaagtagtatattcaaggttgagcatgagaatgtacagaggttaccaaatgagctgcagagcacagatgcacatgacttccagaactgttggatcagccacaatgtcatttcacacctgtgacagtgtgagggggcccttatagccagttgacaggagtaaaaatcgtgagcatggtgtataaatgggttggctcagtatgagttcaaaatgaaaatagcagctacattacagccttctcaggggtgaccttgaaaaatggtgataagggcatatcctctcaataggcagaatttcaggcagagctcctggtcgtccacttttttgtggaagaagtagcccaaggtgagaatatacatggagccatgggcaatgctagagggcctgggtaactggttaagggcctggaaggaaaacaatcggaagttggagataaggaggtgtgtggtagatttatgtggtcagataaattggaatagcacgaagtacaatgttctttgtatacaatgttaatgcccaccagagagcatccatgaaagaagcattatacaaccaagtagacagttgactcagccagttgatattggacagcatcttttattggctactgtactactggcatgatgggcacatggacaaggtagccaaggtgatggacgctgttcatgggcctgacagcaacccatgctctctacccagctttggttaatatctagctgcccctgaatatctaacctgccagcaaaagagatctacccggctttggttaatatctagctgcccctaaatatctaacctgccagcaaaagagaccagtgctatactcccattgtgggtcacttcatcaaggagcacaaacatccaggtttacagaggtctttagacatagtccccattttataaggagagtttactgtattggaactctcccatcctggaagggctggtggttcacttttcacaagaatagtctcatattccagatacgaggcttgtcttttcctactcacaagtgtcagccagaaaggcttaaggagtgtttgtttcactgacataagcacacaacatttcaaacgagattcactttatagccaaggaagtgtagtgtccatgggccctcctgcctggcagagcgctgagacagcatgctaaaggcacagcctcccaaaggcatgagccactgagcccggcactgaagacttccttgaaaccgttctttgcaatctttctgttattgaccagctggacagtgcgtaactgcatgggaatgcttgcagatcagtaaattcagacaccttcctttccacataagatggaccaccagctgtaccctcccaagttttgccagctggaaatcttcaaaaatccaaccctaaactaggttgtagtgtagcaaccatctttttgtttgttttttgagacggagtctcactcggtcttccaggctggagtgcagtggcgcgatctcagctcactgcaacctctgcctcccgggttcaagcgattcccctgcctccgcctcccgagtagctgggactacaggcacacgccaccatgcccggctaattttgtgtcttttagtagagatgggatttcaccacggtggtcaggatagtctcaatctcctgacctcatgatccgcctgccttagcctcccaaagtgctgggatttcaggtgtgagtcactagtgtagcaactatttatggttcatgccaccataccgtatggatccgttggtagaacaaacctgtattttttcgtcttctgtcaactggtcctagggagcgtcccgtgaaaccacagatgtagactgaggggtgtgaagtagaagaggcggcagcatgtgtttggtcactcacttgggtcacatacttatgccttctgaatctgttcaggcatagttttgtgtatattatttccagtttcagtggaatgctgtttatgtccagtttaatgatttgtgtataggctgtcctcctatggtatgcctcatgcttctgtgggctgtattgggatcagagtcttgggggtctgcaagcaaggtggtattgttgggttttgagaatcagcatctctctgtgaggcactgtatttgttctcacactgctataaagaaatgcctgaggccaggtgtggtggctgaggcctgtaatcccagcactttgggaggccaaagccggtggatcacctgaggtcaggagttcgagaccagcctgaccaatatggtgaaactctgtctctactaaaagtacaaaaattagtcgggcctggtggcgtgcacctgtagtctcagctactcaggaggctgagacaggataattgcttgaacccgggaggcggaggttgcagtgagccaagattgtgccatttaagcctgggtgacagagcaagtctccatctaaaaaaaaaaaatgcctgagactggataatttataaagaaaagaggtatatttggctcacggttctgcaggctgtacagtaagcatagtggcttttcctttggggaggcctcaggaagcttccaatcatggcagaagacaaagggggagcaaggcacttcacatggctgtattaggaggcagagagaggatggaggtgccacacacttgaacaaccagatctcgtgagaactcattcactgtctgaggacagcacccaggtgttaaaccattcacgaggaactgtccccatgatccagtaacctcccaccaggtcccacctccaacattagggattagaattcagcatgagattgggcagacacacagatccaaaccatatcaggcatccatcccaggtgcagtcattaaaagttttctattcaggcttttgaggtgattgtggtggggccccttcaaggtgggggctggacaccagaggacccaaccacatgattggaggattaggattttcagccccaccctcaaacctctggagaggggagggggttggagtttaagttcaatcatgtgatcaataatccaatccatcatgactatgtaatgaggccttgataaaaactcttagccaatgaggcttacagaggttctgggttgtgctgtgttgcgggaagtcagggaccccaaaccgagggaccggctggagccgcggcagagggacataaattgtgaagatttcatggacgtttatcacttcctagtaatactcttataatttcttatgcctgtctaatctcaatcctgttatcttcgtaagctgaggatgtatgtcacctcaggtccactgtgatgattgcattaactgtacaaatcgattgtaaaacgtgcatttgacgaggccaggagatcaagaccatcctggctaacacagtgaaaacccgtctctactaaaaatacaaaaaatcagccgggtgtggtggcaggcacctgtagtcccagctactcgggaggctgaggaaggagaatggcatgaacctgggagatggagcttgcagtgagctgagatggcgccactgcactccagcctgggcgacagagtgagactccatctcaaaaaacaaacaaaccaaaaaaaaaaaaaaacgtgtgtttgaacaataatgaaatcagtgcaccttgaaaatgaacagaacagcgattttagggaacaagggaagacaaccataaggtctgactgcctgtgggttcgggcaaaaagagccatatttttcttcttgcagagagcctataaacggacgtgcaagtaggagagatatcgctaaattcttttcctaacaaggaatattaagaccctaggaaaataattgcattccttgggggaggtctataaatgcttgctctgggagtgtctgtcttacgcagttgagataaagactgaaatacgccctggtctcctgcagtaccctcaggattgttagggtgggggaaaaaaccactccctggtaaatctgaggtcagactggttctctgctcttgaaccctgttttctgttgtttaagatgtttatcaagacaatacatgcacagctgaacatagacccttaccaggagtttttgattttgccctttgccttgtgatctttattggcctcagaagcacgtaatctttgttctcccttttgccctttgaagcatgtgatctttgtgacctactccctgttcgtacaccccctccccttttgaagtccttaataaaaacctgctggttgtgcggctcaggtgggcatcacggtcctaccactatgtgatgtcacccctggcagcccagctctaaacttcctctttgtactctatttctcagactggccgacacttagggaaaatagaaagaacctacgttgaaatattggggatgggttcccccgatagtgctgggagggcagcacgcctgcagtggacacagaagctctgagccccatacctgtcctgctcacctcttccatttggctgttcctttgttgtaccctgtataataaactggtaatcccaagaatagtactttgcatcattctagtaaattattaaacctacaggggtggggctgaaaaccccacaaacttataaattggctgggcagaattgcgggtagcctggaaacaccacttgtggctgacgtctgacgtggagactgagtccttagcttttagggtctgtgctgactccaggtagtaccagaattgaaggactttaggccaggcactgtggttcacgcctgtaatcccagcactttgggaggccaagataggatcacttgagcccaggaattcgagaccagcctgggcaacagggagaccccccatctctacaaaaataaattaattaaaaatggaaggactttgtccttaacttgtgggaactgtgtccattctgactctaggtagtgtcagaatggaactgtaggacaggcagctcgtgttagaaaaggagacaagcctccagcaggtcagggaggcggcagcaggcagcatgaacggtagcccaggctcccatgcagttctccagctctgctgtccccctgcatctatccattcctattctgcatatgaatttgcttttcccgcccaacactcatttgcagacttcccaaattcctaattcatcatcgcttctaaccagaaaactcttctgagagcaagtgtggctctaagcatgtggttgtacgatgccctcatcttaccccaaactcctatcagtcagaagtagcttgcttagtggatggtggaaaggcctcccgaaggctcagttatgatgccagattggagacaatgccctgtcaatatggatgttataatacaggatgtggtataggctttaactgaacaatacctagtgctacttctcccacagccagcatatgctggcttggaaacctaagggctgcagataggaatggcccctcttactgttatgccaagtaaccccagaaggaatttttgcttctcatcttgtaactctgaactccactgtcccaagggaggactgcttctaccaggtacgacaatggtggtattttgaactttgaactagcagttgagactgctgcctgagccaacacccagggatggagttactgcactaactggtgctattgatcccaatttttgagggaaactgggtggctcatacacaatgaaaacaggaacatccttatctgcaatctagtgtcttcactggcaccttttggtaccgaggactttcggctcagtgcagcctccgcctcctgggttcaagtgatcctcctgcctcagcctcccgagtagctgggattacaggggcctgccaccacacccggctaatttttgtatttttagtagagaccgggttttgccatgttggttaggctggtctcaaactcctgaccttgtgatctggccacctcgacctcccaaagtgctgggattacaggtgtgagccaccacacccggctgacagcttcttggcttcaagctagaacaggctcctcacattcatgtcccattgtctttgatgaaacgagggcagttaactgtagaatagcccatgttcatctttttcctcatggtttcatttatttttccttcaataaactataagttagggctggacacagtgtcttgagcctgtattcccagcactttgggaggccaaggcaggaggatcacttgaagctaggggttcaagaccagtgtgggcaacagagtgaaactccatctctacttaaaaaaaaaaaaaaacaaaaaacaactagctcaatgtggcagtgcgtgcctgtactcccagctactcgggaggcagagacagtaggattgcttgagccaggagcttgaaaccaggccgggaaacaaagtgaaaccttgtctctaaaagaaatacgaaaattagtgccaggcgtggtggtgcgcacctgtagtcccaactactcgggaggctaagcaggcggatcatttgggcttggtaggtcaaggctgcagtgagttgtgattgtgccactgtactccagcctgggtgacagagcgagaccttgtctctaaaaataaaaaaattatacccatctagtacatttttggataaagggtccttggctaggtattactgtctagtctaagcgagtatgagtgaaacataaaaaagcacagccagccgggcgtggtggctcacacctgtaatcccaacactttgggaggccgaggaggatggatcatttgaggtcaggaattcaaaccagcctggccaacatggtgaaactctgtctctactaaaaatacaaaaattagctgggcctggtggtgggcgcctgtaatcccagctactcaggaggctgaggcaggagagttgcttgagcccaggaggcggcggttgcagtgagccgagattgcaccattgcactccagcctgggtgacagagggagactcccatctcaaaaacaaaaagcatggccatgagaggtggatacatagtggcagcatctttaaaaaaataagaaaccaagtaagagtaaacaacagtcaagtggctattcaagaatgctccgggttccactgaaaatttttgacttacgagtttaacataaactctctgctcaattttttagtcagtgagaaaggcaaactgataaaatggataaaatggaaaaaaaaaacaacacaagggctattcacaaacaaaacagtgattaaattttattcctttttgagttgttttgtttttatttttaaatg

SEQ ID NO: 4294 - DNA, 321 bp, Homo sapiens
aacttcttccattagaaaggactcctcaggacacctgggagcatgggctcttacacagggggtcctggtcataccactgagggagctctgggctagacttggatggtgaacactgtgtaaccctggcattgtcactgtatctctttgcccctcagttttctcttctcggaaatgagaaaacatatccaacaaaattttgaggattaaaaaccagaggatgtgtagggacacagtgacaaatatgaagtctaaggtcttactgttattatatcacttatggttaacagtaaagatttctgagtcagaccgttcaagttcaaa

SEQ ID NO: 4295 - DNA, 2381 bp, Homo sapiens
gaattctttcccttcattgtcagagagaaccgcccccgcacggcgagcgcgcgcgcgctcacgcaccactctcacactccggcgcgccaaaggctttccgcttggcgtctcgcgcatgcgcggagggggaagcagtggcgaaattggatgctttttgctgagtttctcagagaagtttctggaaagatggagccaaagggacgctggggggtggggagcgccaggaagcaagcgtttgaaagaaagcgaaaaaacccaagcgcaccgcgacacctccaaccttcaagccacggcccaagcagagcccaaggccactgagaccctcacgccagagaaaaagcacagggaccgcggcagccgctcctccctctgccactgctcagcccccgagactccccagcacggggagagggcagggggtagccatgagaaacctagagcgctcactggacttttgcgaggtggaaggaaagccgaaacccgccctttggagccgcctgtgcgcacgggccccgtcgagtgggctcagtacgttaggactcagcgtggccgccaaagcattggttgggggcgtctttcactaatttttcctaggttttctcttctatcgggctctgtggtcctttcaccacccatcttcactttggtggcctgacgctaacgctgcgagttggggaaaccgtagtaaccccgggcctgaggggcgtcccgggcggcggtgctccgtttcttccagcggttgcccctttaagaaaaagccccccggagaggggcccgtgtggctgagtaaaggtggcgtgcgcccgcacaaaggcgccgcgttgttggcgggctccggaccctgttgcccctgggcggggcggcgtgggaagaccggggcgcctgggcggggagaacgacgttggcgctagcggggcagggcagggggagggagtcacgggatttagcaggtgcttctccgcgaccgagcgactgccattttgtggtgcggccgccgccatttcgcgcggccgaggggcggggtgtgggcggagcggcgggcgcgcccgggctgtccctcggggcggcgggctaacgcggccgctttgttcttcgcttctcggctcgaggccccagtctcgaccgccgaccgcctcggaaccgggctgcatccgagctgccacgcggcgtgtgaaccttgaagcgcggccggggaatccgcaaggcgccgactctcttcctccttgcaagcccttcgaaagtgagatttctcaccccacccttgcagggtggagagaacacgtttcaaaaaggggatgcctagaactcagccgtgggaagtgcctgtctaaagccttgtgctggtgccagtagcaaacccgtgcgcgtgctcggctttgagcgatcatggagctctgcaaatagctcaactgcagagcgtgccccttagagctcctgtgctgctgggaggcctcataaaggtgccaaaaccaggtgtccccagcggttggcctctttaaaaagaaaaaaaaaaaaaggcggagtgggatgtccttgacgtgctgaaagacggagtagaatgagacgttggttttcattggctggccattaagcacgcactgcgcaactgttttccagatacgggtttatagcccattatttatatcggagccataaacttgaacaatagattggaatatcttatttttgcctgttgagaatatctcccatttaacttcttttgaaagttcagatgagtatataaataatacattgacccagtagaatctattgtgtgcgttccagcgtcatttcaaagagctattgtttttctgatttcaaaagaaatatttaaatgtgagtctttgtgttttaatgttaaccttgtggttcgaaatcaacaaagccaggaaattcaagagaactgctgctaaatttgtcttcttcctttgctttcgtacaaggtttttttgtttaattttttttaagtttttcttcacagcgtgagtacatagaagagccagccctttatattcttactatgtataattatagggagttatttcagtaacaggaggtaaagctcataatgataggatgaaaaggtaaaagaacatctgttgaaggaatcgatcaggatttgatggcttccagatgaaagaaatatctgagaagaggcttttggattccaaataatttagtttcattatgaccaaaagcactgcatagagctttaaatttttataccgtatcttttgacatcaactatcctttttttttttttttttttaagacaaggtctctgttttttgcagtaacgaaatcacagctcactgcagcctcgacctccctggactcaggttatcctcccacctcagcctcctgaatagctgagaataggc

SEQ ID NO: 4296 - DNA, 611 bp, Homo sapiens
agaaagtcagagtactgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgctccacattgaatgtggaatgctggaagagagataaagtgtacctgtcacatactttttgagttttatttattttcttagaagtaagtacacaaagagatgctacctaggagaagggtattcttttcactattctttcaaattttctgtatgttcaaacattttcatagtagaaagttggggggaaaatctgtttcataaacatttcctcagcagcagtccagtctattgcattttaattggttgtgatatcattg

SEQ ID NO: 4297 - DNA, 8048 bp, Homo sapiens
gttggaggagtagatgaggtgctacatgcagggccctgagaactgtcctgtcgctcaggaagcaagttttgcagggtgtggacaatcgggcaagtgactgcatgtgacaacagagagagggcatggtacacggtggcagatgagcccgggactggaggcagatctgggttccagttcgggctctaccagcagcacccatgtgtccttctgttctctgggcctcaatttcctgttgtaaaattcagaacttggaagaggtaagtggttaggtcattcctgagacatcccagataatcacagccatccaaacgttggctcgggagccctgagtaaccaagactgcaggaagcaacagtttagtaagggttcagaatcctgtgattagggctcgagaatgaaatactcttctaagagcttctcccagaccaaaaggagctaattaggaaagaatggtggcattctctgggcaaactggaggagcccctgggcttggcctccttatgccttcctccttgaccctcctctagcccccttggacacaacacaacgtcccccctctgctttttccccagatactatggtaaacctgctctcagatctttctccacacctagaaaaattcattcatcgactatacactttaatgaatatgcacttactatgtaccagatattctttggctgctagggcagagcagcagggacatagcccctgtccccgtggggtcaacatgctggtggagggagtcagaggtaataaaataagcaagtaagacacacagtagagcaggcagagttggcggagaactggatctaactgggttggggttttgccaagcaagtacagtccaacttggagtgtggagggaagggtatagaaaaggtagggactagaataactaaccctggaatttaggctgggaaaggagggagtagggatttgaaagcgggtgaggtcagtagtctgtggggccctgaggggcgatggctccaaggcacgagccggaaagaggtttgacagtggcttctctggagggctcaagcttgaccaggaaactgagtgccgagccctggaagatcactggggagaggaggtcaaagaactgggaggccagggcaccatcggcgggctggtaagtggatggtgaaaccaccaggcagggggcaggaggagctggagagaggacgcgagatgggagctaaaatcctaaaatccgcagggagtgcggaaagcagtgacagcagtgagcgcggggaggctggtcctgagtctgggatggggcgatggcgttcaagaagacatatttaagagtactatgtaattttacgtgtgggaagaaccttttgtttttgtaattagaactacagaaagggacagagctgtttatgtcatgaaaagcaggcctgagcattagaagactgagaaacacctgggaggatcttgtttcaacagagctcaaagccgtggcaaaaggacggagctcgaattgtgcaattgtgagtgactcgaagctgggtgggaaagcgtctagtttcttatgcataaaggaccttcctgttgtctctgaaatcataccaagtagatgccaccatttcagcagaggcttgaattatactgataatgacaagttatcagtatcatataactaatgtaattgattgataggaggagttaaggacacgggatctggccgggcaccatggctcacacctgtaattccagcactttgggaggccaaggtgggcggatcacttgagttcaagagttcaagatcggcctgggcaacatggccaggcaacatgtaaaaatacaaaatttagctgggtgtggtggtgggcgcacctgtaatcccaactacttgggaggctgagatgggagaatcatttgaacctgggaggtggagggtgcagtgaactgtgattgtaccactgcactccagcctgggtgacagagtaagacctcgtcaaaaaaaaaaatccaaaaatgtgggatctgtttaaaccctggctctgctccctgctactcattaccctcatctgtgcagcaggggtgataccagccctcacccctctgtttctgagaagtagatgagcgtgtatgtgcacagagacctgcctgcagtgttgtgaggactcacaaaatgttggctagatatcctaatctttctcatgtttgttggcaaacaaaaacaggctgagatggccctgtgccattcgtatatctgtgtgtggaataacagacagtataaagctgaaaagcaggtccctccctggctaattgcatttcagcagccgctgggaggcagtgtggcggggggcggggagtgaaactgtgcggggagtcagggagcctgggtttcctcctcagccaatgaggccaaggccaaatcaggatgtccctgagcccctgtttgcctacctgtaacgtggggatgacggttcctgccaggtacccacaaggctgttgtgaggactgaatgaggaaatgctccttgaagataaatgacaatgccacagaagagcggatgcagctcccctgtgctgagtactcacctactgtgtgctgggcacaggggcagagccacccacccctccctgcagcagtgcctggaaggcaggaccagcatcctgatagccagagttgagacagagtttaagggcctgccaggcataactccctcgccaggcatagaaataaaggaacatcttgagttctttcaagggaagttccaggcacctagctagccctgagagtaaatgaacaacatgataagcaagaaggaaataatagcttttcaaaaaaaatagccaaggaagttagagtcacaaaatacttggttccctattgaaacttaagataacatcttaatatatgttcctgagttgtttttcagaaacccaggcccccagcaaatggaaaatgccatccactggcacagagacttcagttgggagccgaggactgaactcagaccaccattctttgttcaacatttcttcctgaggggcctggaggaagtcacacccacaggccagagctcaacattcctttctgctgaccccaggtttttagacaaagctttgcctccttaaccaatcacaaatcagaggatctttgaatccacctatgacctgcgggccccgcttcgagatgtcccacccttttaggtcaaaccaatgcacagtttccatgtattgatttatgactttgcctgtaacctctgcctccctgcctttaaaaacccttacctgtgagccaccctggagttcggggcttaagcatgagctgcccgattctccttgcttggcaccctgcagtaaatgcctcactttctcttgctgcaaatcccaatgtcagtgcttggctttgctgcacctggtgggcagacccaagtttggcaacagagtctgtgggagaaagtgctgtcagaggaacatgctggagcagccagattatagaagaaagaagtatcgttatggttaagtctgtgagcagatttgaggagaagctaacgaatggcaccaagtgtgttcagcatctccccttctagggtgtcatctgacagatgtgttatctgacagatgtgctgctcatgccttctgcacctgaggtcagggatgctcacacagaatgggttgtaactgcataaggtcgggagccccctctacatccaccaaatagaggatgagttgagtatgcagataataaagcagaataaggaaaggctttttatgaactgacagggaaagactatcaagaaatactaagttaaaaaaaaaaacaaaaccctcagtgccaaacagtacatataggatgccaccattttttttgtctaaaaaatggggaagaatatctatggaatatactcatttatatatgaattgaatattctaaagctagttgcaagaaactagtacccttacttttctctaggaaggaaaactgggaaatagtaggaagaggattatcactgtatatccttttgtaccctttgattttgagaccatgtaaatgcaattatctaagagagagagagaggaaggaggaggaggagaaaaaggaggtggaagaggaagggagagaaagaaacgctgtgcatgggctctagaatcagacggacttgtgaattccagctccactgcttcccagctgtgtgaccttgcccaagctactcaacctctctggggctcaatctgtgcaggaaaggggcatgacaattacataatgcctccaacccacctggactgttgggagattgagactaatgagtttaaagctcttagctagaaatggttgctgtagatgtttagccagccctggcttcacactctccagaccagcttccaaacttcctggagggcacatgcaattcatcttttcctttcccatgcaattccccaggcaccagtccatggcactccctatgcctgcaggataccacatcaaagcagagttgggggagcatttcaggaggttcctgtgaaaaacctacatgcacacacccccacgtgcagctgcagactgctatctatacacgaagttatgcatcgcagagtcgactgcaaaaggctggagcccacacagcgtctatcaatagggaacgggttaaatcgaccacaagatttccatatgacgatggaacactttccagccaagaaaggaggaggaagtcctcactgctctgatacggaacagtcaccaagacatattttaagtaaaaaaaaggcagcatgcataaccagggaaatgaaaactaaaaccacagtgagttacaatttcacacagatccatctacaaaaaaaaaaaagctgataattgcaggtgttggtgaagaagtggagtgaggggaatgctcaaactactagtgggtgtgcgaatggttataaccactttttaaaattttggcattatctactgaagttgacaatgtactttcccaatggccttgcaaatgccctggagaagttcttacccaacccccgccattccccccaacacacaccaaaagaaacaattaagaacatttgcaccagctctgttcctagaaccccaaaactgaggccagcactgaggccaagcacagtggctcatgcctgtaatcccagcaggcatgagccaccctttgggagcctgaggccggaggattattgaggttgagagttcaagaccagcctgggcaacatagtgagaccttgtctctataaaagaagttttaaaaattagccaggtgtgatggctcatgcttgtagtcccagctaattgggaggctgaggtaggaggatcgtttcttgagccctggaggttgaggctgcagtgagccatgattgcaccactgcactccagcctgggcaacagaatgagaccctgtctcaaaaaataaaattaaattagaaaacaataataattattattaataaataaaatagtccaatgaaaataatcatactatctccatgcaatggaattctatacaagagtgaaaatgaactaactccggacatgcgtatcagtacactgaacttcagaactataattatgggtgggacaaaagccagccatagaaaactattctattcataatcccaaaaaggtagtataccatattcaattattatatatatttatgtcttgttatatataatgtttattacatttatcttagtataaaaatatagtatatttatcataatctattataaacaagtagtaggattataaaaagacaaaaagggcaggataagcgtaaaattcatgatagtatttaggggaagaggagggtggggctggagagaggcacatggtttcaaaagcccagcttctttgtctaaaacagggcgtgggtacccatactggtctattgtattgtgggtgtctttaaaatgtatatatattctataactactatttttgtatctactcaatatttaattttaaaattttaaatgaggcctagaacactataaaaagtatgctaccatttgtatagaaaaagtggacacacacatcactcatgtgcatagattaaagtgtctctggaaacttacacatgcaactggtgaaactggtttcctctggggaggagaactgggaggctggggacaaggaggggcaataaatcaattgaaattaaaaatcacaaaatttaaggagaaggagacaaagaagggaaggaggaagagaagggagggtggaggggagaggccaagtcctggtcccaggagggacagggagcagaaagaggaggactggccaggctctggctatcaaaacctgtgtgtgccacaggcacgagtggagccagaagcctgcagtcctgcccaggaaagcctgtgtcctccgcgcacaactcaggcttagacccagagaatgctctttcttgcacctgaggacggggctggcttcaaacagttgcccaggttgaccctggctctgcagtcttttgtttccagagctttgcttccaaacgaggctcccttgggtctctttccctggccctgccttcttatctccaaccttcaccccacctgtgatccaagcgattcctttgaagttgcttcagagtcttctgagccttcatccttgatgactctgaaatgtgcgtctgtggcaccaaggtcagccaacagcaagtaggcccttttcatctccttttaaaccttcccctcaaggactcagtgtccttgctgtattgccttatcaaaacctgctcacatatcctttgttcacactgggataccggtcatttaaaggaaaacaggcccactctaaccagggtcactgccaagtccctaagtatcatgcccttgagaggtaaaagcataaagcactaagggtagaattttgggcaacagccagtggacaaggacaaaatgggtgcaatatgcaggggtcccttctgccccaccggtaaccataacacctcaggacacaggctggggtctgtattcaaaagtgggtccctcagaccgggcacagtggctcacgcctataatcccagcactttgggaagccaaggccagcggatcccttgagcccaggagtttgtgaccagcctgagcaacatggcgaaaccccatctctacaaaaaataccaaaattagtctagtcgggcatggtggtgcacacacctatggtcccagctatttgggaggctgaggggggagaatcgcttgagccccaggaggcagagattgcagtgagctgtgatcgagccactgcactccagcctgggcaacagagtgagaccctatctcaagaaaacaaaaacagaaagtaaaaaagcaatcctcgagcaaaagtgggtccctcagagcccaatgacagtgatgaggaggatgaggtgggaaaggtagtgttactctgaactaaaaaggactgcccagtgtgaccctatctcccaaacagcccatgcagggatctgggtggcaccatagtacagaagtgggtgccaagagaggcctgggctgcacagccaggtgcatacatgccctggagtccaggacaggatcagcagcaaatccactccagggagctctcccccctcaccatcctctcaatcagggttccccagttgaaaagcaccttggcagttcataattctccctctaaagccagaaagtgctgtaaaggataacagaagcctggctgcacagtggagcttaatggaagtcattcaacaagcaggtctggagcaaacatcatggaccagcagtactgtgtgttggcacagatgtgaagcaactatactctgatacggcttggatatgtgtccccacccaaatctcatattgaattttaattcccagtgttagaggaggggccgggtgggaggtgactggatcatgggggcagatttcccccttactgttctcacgatagtgagttctcagatctggttattttaaagtgtgtagcacctcccactttgctcccttcctcctgctttggccatgtaagatgtgcctgcttcgccttccccttccgccatgattctatgtttcctgaggcctccccagccatgcttcctatacagtctgcagaaccgtgag

SEQ ID NO: 4298 - DNA, 4051 bp, Homo sapiens
accctggcacctccccacagccccgcatcggacccaaggacagtcccaggagacgtgggggcgctcacccctttcgtggacgggaaactgaggcaggcgggtgaaggtcggctcacatgcggagctcaggaagctctggacggactcggagctgctctgccaatcaaatgcccatggtgagtcctccctggagcacagaagtgacccacaaggcagatgctgcacggcctggacaagcattcatcctcatgcccatccgtgaaaaaaatacatccaacccactccgttttcctgccccagacggtgcccttcctgagtggtctttccttcgccctggggaggcccaggattgctagcccattccacagagggaaaattgaggtccagggaggcgctgcttggccagtactgttctgcctaaaccccaatccataccaccacactctcatttttgcaacacaagggctctcccaaaagacatggcagggagaagaagggtcacaagagacacagcatggaccacctggtccacattcttttggtctggttgcctgatttcctttagggccctccgcctgctttctttaaggcaggaggtcccacaggacttatttcccccagtctatccaagactacctacctcagtcaagttggaaacagtctttggtgtaatcctgaaataaaaaagcgatgataatttgaccctccattgggccccctcctgtaacatcccctgggaaagaaactctaagaatagcagccagtgcttctgtctcatagctcaggccctttggggcactctcttgagatttgctattcccttgagatttgctattctggcggccaggcctttgctcgggcagcgctctcctcctgccaggcccttcttcctggcagccctccattcttcctggagccccttcttccccacgaagattctatctaggcagggtcttatctccctgcagtcagcccatatgccccagaagaaaggggccacatttccccaccaacaccccgccctgtgcctgactccaaggggccagggagaggtttgcggagttgaccgccccctctcttctctgcagcacatactggaaatccaagaggcttaagaagagctttttcttagaataggaggcctggacggtagtcacgatatcctggggagagaaaccaaatttgctgtgagccagggctcttcccgaagcagagagcaaccctcctagctcagggcccctgattctttccactgagggactggagaggcaaggatgacacgggaaccaggcttagctactgctcttctgaaaaccgaggaaagttccccagcacctgtggctttggggttaggacctgagaagtcactttctttttcttttcttttctttttttgtttttgagacagtctcactctgttgcccaggctggagggcagtggcacgatctcagctcactgcaacctccacgtcccaggttcaagcgattgtcctacctcagcctcccaagtagctaggactacaggcatgtgccaccatgtccggctaatttttgtatttttagtagagatggggtttcatcatattggccaggctggtcttgaactcctgaccatgtgatccacccacctcagcctctcaaagtgctgggattacaggcgtgagccaccgtgcccggccgaataattcttttttttaacaaatgctcaatgtttcagattcttaacaacaaaaaaataagtaaataaaataatatgtctacatccacatgagaaagccaaaaggaataaaacagaaaaatgaaaaggaaagtaatacaaaaattaaagagatatttaaaaggctaaataaactgggcacagtggctcatgcctataatcccaacactttgggaggccaaggtgggaggatcacttgagcccagggatttgagaccagcttgggcaatgtggcaaaaccctgtctctacaaaaaaatacgtggtagtgcacatctctagtcgagaagctgaggtgggaggatcaccgctgcactccagcctgggcagaaacaaacagacaaacaaacaaacaaacaacaacaaaaaagaacggctaaatacaatgtgctatcctggatcagatcttggaaaagaaaaagggtatcatcagtggaaaaactggggagattcaaataaagtttagagtttggttaacagtcatgcaccaatgttaatctctccgctatgacactgtagcatggttatgtaagatgtggacaaagcgggaagtgggtgggggatatatgggaacactctgtattttgcaacttttattcaaatataaagttactccaagataaaaaatttatttaaaaataacaaagcaccagaaggaaatgcacccagtcaccacatcgaaggcccctggagaagggggttatggtgacagtggttttcttctttctatttttctatattttccacaatgtgattgtatcgctcttgtctttagttcttaatgtattaagaaatattggccgagcacagtggctcatgcctgtaatcccagcacttttggaggctgaggcaggtggatcactggaggtcaggactttgaaactggcctggccaacctggtgaaaccccgcctctactaaaaattagctgggcgtggtggcacgcgcctgtagtgccagctagctactggggaggctgaggcacgcgaatcgcttgaaccaggaaggtggaggttgcagtgagccgagattgcaccactgcactccagcctgggtgacagagtgagactctgtctcaaaaaaaaaaattgaagatattctaaggagcattaaagataatactgattcttaattccttatttgtaattataaaatcaaacaggatctgaaaactacaagttttttcttaagttttgttggcaaaacctggccattgtctaggaagctatgtatggtatttatcttgcttcatatgaggagaaatgccaattgaggcatttgaggagaattgattgtggggtgccaccccacaccctattggggtgttctgcaatatatccagtgtctatacactatactacttttacaaattcacagaagttctgaatttggaaacccttgtggccctaatgaataaagggttgtggactcgggtaataaacaccattgtccactgctcagcttaaggaggagaatattggctgggcgtggtggctcatgcctgtaatcccagcactttgggaggctgaggcgggcagatcacttgaaaccaggagtctcagaccagctgggcccacatagcgaaaccctgtctctactaaaaatacaaaaaattagtcaggcgtggtagcgcatgcctgtaatcccagctacctgggaggctgaggcatgagaatcgctggaacctgggaggcagaggttgtagtgagccgagattgtgccaccgcactccagcctgggcaacacagtgagactctgtgtcaaaaaaataaataagtaaataaataaataataaataaaaataagaatgaaagaacatatgcttggcatggtggctcatgcctataaccccagcaacttaggaggccaaggcaggagaattgcttgaggccaggagtttgagaacagcctggacaacataacaagaccccgcctctaaggaaatttttttttttaaattagccaggtgtggtggtgtttgtctgtggtcccagctactcaggagggctgaggtgggaggatcactcgagcccaggattcgaggctgcagtgagctatgagtgtgaggctgcactccagcctggatgacagagtgagaccctgtctctaaaaaaaataaaaataagaaaagagagaaaatattacctaagctgtggaaaccacgtgtgtaccccctcgttacttgcatgatgtgattttgattgtaaggagccatgtgcaagagacaaccagtgccagcagaggtggtgagaaggatctggaggcttcagagacccccaggcccctgccctctgcggcccatatgtgagtcaggttcccccaccaccacctctccc

SEQ ID NO: 4299 - DNA, 1551 bp, Homo sapiens
agtcttatgtttgcaatcctgagaaaggaagtcctgaaagttcccaggagccttaagagcggtggattttccttctgataatgctgctaggaaccaggtcaagcaatagagacccacgctggggccatcaagactaataggggtagcttttcttccctcctcctaagccaaacacctttgatcagggtgaacggacaatcatcaaaaaagttgtcaaggtcctctggcttgctaacatgccaagaggccaggtcaccattgatagctccacactttaacctcagctacaaatgacatgctctctggctactctcctggcctctcctaaggagagagagccaggtccagagaacatcagaaaggattgccccagatacagaattaatggcactgctcaaggaaaggaaagagaggtaactcagagttttaaaaaaggcctactgggctggtccaagtacaatagtgtttacaagtaattgatcactaccagttaccgatttctttgttccttttccactcccacaatttcacttcactagcctaaaaaaaaaaaaaaaaagaaagaaagaaagaaagaaaaaaaagaaaagaaaaaaaggaaaaaaaagaggcctgttgggaaggcttgggaggactagtcagccatatgtccaggagatccaaaagattctggccagctgcctaatcgcaccagcacaattactgacagagctactttcagttttgtcactggcctccattgcacagtctgaggttccagctttaagtagcttcctgttgtcctgggcacctgagggtctgtcggaaggctaacagaggcaggattatggatgtggctgcagacagaagaatggggtaatgtaagggagagatgaggggaggagtttaggatggaccccagcaatttctccattcaatatccagccccaccctgtgactaggaaaacaaaggtactgggggaaggggagaagaaaagtcatttcctttattgtaactgtagcccagctgggtaagagcaaggctggaagggggccttgaagaatgaatttctctgagtagcacagagggagagtcctcctcccagcaggcctgcactactcaggtactctaaattcatcagagaaacactggcaagctggcgtgggagagatcttacaagaccattcaggttgatgccccatgttcctcaaaacccaggttatctctggggtcagacaaatacaatccttcctagccctgaagattttcctccaactggggcaaaagtcaaattagatccaaaagacagtcactctccccagggcaaattaccaggctctatctgagggcgccgtgacatccagtttgaatttaccaggggaaagctcagaagtcaggagatgtgctccttcagcacagctggattagagtctctgtcctcaaggtaaagctgcaactaggagacagaacctagatactctacttcctccacgggaatgatatttggcttgattgtgtcagggtagttcaaagttgcccttaatccctggggctccacatcagatcaccaa

SEQ ID NO: 4300 - DNA, 835 bp, Homo sapiens
tcagagttgagctgggggaggcttcagaggctctgcatgcccaggaggcttctctgagactgggaaggagtggaaactcagtagcccgtggtcctggttgcgcgctccctcccatgtcttcattatctgatttggtaaaatatctacaagacgggggagtccgggctgctttctttgacactggtcatcactccacacctagacgctatgtccatgtctggaagatgcttttaaggaagttttgatgcagagaagagtggccggtgctcttcctcgcgtgccaccatctgcttacttccagaagctaattattttcatgtgactgatgtgactaatattttttaacgcctgcaggacacactgggacctgcagtgaaacaaaggacatctgtagcaaagcctttcaactctagattgtcctctccatcctagaaatggaggaggaagtgatagctgaagttggttaattaaatgctctgatcttctgtaaaatacctagccagtgttcttcaagactctcaaggtcatggaaaccttggaaaaactgagaaacttccatctcagaccagaggacactaaggagaaataatgagtaaatgcaatttgatatcctggattggatcctggaacagaagaaagacattggaaaagcaggtgaaatccaaataaagtgtggactttagttaatagcgatgtaccaatattagtcctttggttttgactaatgtactatggttctgtaagatgttaacattaaggaaaatgggtgaaggacattcagaaactccgtaaactatatttgtaacttttttgtaaatctaaaattattccagaa

SEQ ID NO: 4301 - DNA, 2760 bp, Homo sapiens
tctcagagcatgttaaatttacataacattatcacaaattaaataacagccaaattaaaacctttgcaaatgaagattaaacatatttttttttttgcctttcagaaatgttattgaaaaaaactggcaagagacatgaagtatgtttgttcttgtgcttcgatggtgattaatgaactccttttgggagaggcaagatctgtacttggcattaatattataaacttttctcatcccagtagcttctctttaggtggggaaagcagttacataaggcagcgattaatgagatgccacaaatgttgacttagtcccaaatagggattttttttcctccctcaaatctgagtgcttcacccaaattaattttaagtcacactacaaatatgagtaaagtgccgactcgagttgaaaatacatcatatgctcaacctgagtccatatgcttttcccccaatttcttcctgttttgctagaaaaaaaaatccttgaacagtttgaggttccaagaaggtgttgccatttcgttttctcaaaatcattggccagattctgttcttggatactgcttgaatttaaatggaagatgcataaaatatttaaatctgggatccccaaagcatggcattacagttttttgaaatggcaaagtttcttcctctgggagtgaaaagctataatgttaggcctataatggtaggtggaggtagagaaatatatgtacactttcatgttttgtttatctaatcatgttcacgtcctctagacaaactgaaagagtaattcttactcccaagaaggaaagctctgtcctgaactgaagacatcacacgattttgttggggcatttgatataagaggtagctatgatcacaacggttaatatctggacatccagaagcacgttctgtgaacagatcataaggggcaacatgccaggcaggaatccaaagtcattattctacctgcttacaaccgacttctccaagaaagtctatttattaaacacctaatattttcatgatgacatataagacttgccaaattagaacttgaaagtgtagaatctccacactgtttttgaaatgagaacatatctactgcatacttcaaataaagtagaagttgaaattttcatacttagatgaagaattactaaaactaaagctcttttaaaataataggtctagtctcactcccaggagcagcagagtaaattaagatgaggaggatttgtaaaataaagggagacacatatgtacaaaaggaaataagaacaacgggaggagctactctgaactcaaaaggcagagccatagaatatttttcttcctacttctgaaaatccttggggaagttaggcttagtttgtcatattttaccaaaaaaaacaaaacaaaactgactatttcaatattaagtatttatatttgtttaaaacgtaatttcctatatatacagaacatgtattgtgacatgctttgcacaagataacttacaattttagcaagctatgtgtataataaagcacaaaacaaaaagtacacaatataattgtggttgttatgcaataacaaaaaagataaatttagactgggtgcagtggctcacacctgtaatcccagcacgccgcaaggccaaggcgggaggattacatgaggccaagagtttgagaccagcctggtcaacatggtgaaacactgcctctactaaaaatacaaaaacttagctaggcatggtggcacacacctgcaatctcagctacttgggtggctgaggtacaagaatcggttgaacctgggaggcagaggttgcagggagccaagatcttgccactgcactccagcctgggcaacagagcaagactctgtctcaaaaaaaaaaaaaaaaaaaaaaagataaatttaaattctgtaaaatcttgtaatgtaaatcctgaaaaacattttaatgtacatttggaattagtcacagaattaaaatctattccttaaataaaaataagttaaataagttattacttaaaaataagttaaatggccaaatgctacaaaaattaaacaataaaattataagtaggtgtttaataagtcagaggagggaaaattttctaagcataaaagcagtaaaacagatcataaataaaatgtctgtaactttgactcctggtaaatttaaaactttatatagaaacaaatacaccagaaaaaaaatataaaaatattttcgataaatgtaagattgatctctctcacacacacacatatattcttacaagtaatttagaaaagcaccaaatcttgaatagaaagagggagtaagcataatagataattctcagaaaaaaatacacatagccaaaaacattaaaataatctatctcactaaaaatcaaggaagttcatattatggtatcaactactatgatatgatagtaagatactattattttcctatctaatgacttatagtgaaaagaacaatacaaggttggtgggcataaaataagacatattctcataccccaataatatgtggggacataattcaatgtaacatttctaaaaggtaaatttggcaacatctacatccaaaatctaggagttcatatgctttgacccagatattgtacctctatgacgccattgttaaataataatcagccatatggaaaagtatgttcatgcacagatgttcctcaaagcatttataaaaataaaaattagaaagactaatgttcaacaataaattatactaaaa

SEQ ID NO: 4302 - DNA, 1314 bp, Homo sapiens
ggatggggagccgacactgggtgcttccctgacatgtgctggtctctggttacgagatgagggagcccacacctcagagcaaaagaagagaaccagtacagaagcaacttttaaaaatatgcctggttgagagacctgcccctgcctacatctttcagtggggtgtgtccatcctcctgctttcccacatcacattgaaagagcactaatgacggggaggatggagacaatgtttggatttacttaggaagcacgtaccctaaacactggtgcatgaagaatccccccggagctcttatcctacataatgcctgcctctacaccacaatgcatgctcaccacttagttttaaagaagatgcaaacagatctagaaagcctcaaccagctgctccatttaagagagggagtttaaactatagggactcaaaacatcatttctgggagactgtgggccaagaaagaattaactaaataggtttttctacctgtgacagggccacatccactcttgaatttgggggtgttgggggaggggtcgtgtgtgtgttggtcagaagaggggcaccatgctgcatgctttttagagtatacagactctcatggcccagccaaggctcagcactaggcatgtcaccgaattctctaacacccaccatgatgaactgatgtgagctccataccctgaggttccagcatccatcacaatgatccgagagaaggagattatccccctgaagcacaaattggggtcctggatggcagccaatgatcataagagatgccgtagacacgaggagagtctagcttttgccgggctgatttgaaaggattaggtggatgtttagggccagccctcaccagcacgaagaaaagatatcctgacgcttccagcctgactaggtcagagcctactacaggttacagacagtgtagagaaacaaaacaagacaaaaaaaaaatcacagtacagtacatggtgaactcacacacgtgttcacacgcacagccaaacaagaggaccgcacacaacgacacctagagaagccaccaggattaacgtgctttcttcatatctgctcattaaacaaaaaaattatcacgcatagcgtgtttgaaagttaacagtaacatttcatactaccacagggttgtgatatgcaaatttaaaatattttaaacagaaacctttacaaaataatcctattacataagcaatatttgcatagaattatacaagtaaattatacaatatttaagcagcagcaacatatgctgaaatttaagactaatgaagcttggttgtggcacggag

SEQ ID NO: 4303 - DNA, 3029 bp, Homo sapiens
gggcaggcagctagggagtgtgtcggccacgtgatgagcctgccatggtgtccagatggacatgtggtatttggtttaaagcccacgctactggggcataaacagctgaggataaatgatcagactcaattgttctctcctttcccaggaaaggccaggaaggaaaaggccccagtttaagggagaaggcattgtcctcagtggatgaagcatagtcaggtagcccggtctggcagggggccagtggggagcacgagattctcatggctgctgtggctggtggccgcctttacaacaatagcatattggactcctgtccttcccatcccacctctgaaatgatcacacccatgttaaatctctgataagatactatcagatactccaaagtccagtttggaactacagtctttgcttgactcaatccagaatcctttctctctccctggtcctatctccccatctaatccccctcaattcttctttctatccagctgctaaggtccctgggccatcagaagcgaatagaacaaacctaagacatcactctccatcaagaggcctgcatgactctttatttacatcatcttccaggaagaggaggaggagctgctttggggacacccacttcctctccttacgtaacaacacactgcatttgcacaagtgtccttggttgtaaagggttccacactcactttcttattcagggcttattacaagcctctcaggtagctatggtcatggtaccctgatcccttgtcaaagatgagcccactgaggctcagggtgactaccgttgtgccaggagttgctaagtggtggatcacagactccagttcagggggaggtagggtggtaaagaagcagctggatgaacctgggtttgaatcctgctcagaaatgttccatctgtgtgacaccacaggcaagtgacttaacctgattgagcctcagcttcctgatctagaaaaaagggtgatcatgcatccctcatagagctgtggtgagcatttacgaatcacgagtgaaacatgcatagcatggggtttggcagatagaagtccagtaaatgtctaagcccatctccagcgtttcttctggttccaagctcaggactatcctttaagctaagtggtagatactcaatgaacgtgttttggatgatttagccctctcctttcccccatccctccccaagtgagaggatgtttatttgcagctctgtgctgcagagagctctgcaaacaaggattggcagcagtaactttctccagctggcacaacaatgaaaggccacaggccctggggctgctccctatggatgtccagggaacagaggccaggcagcaggctgactgctccgggcactccctgtggcttcttcactctagctggctacccagtatactgagtagcaaaatggcctttgaaaaggcccaccctgtggccatgatttctagcagaccaaatgagagtgttctcctgggagcactgtcaactcctcttgctggagacaattctctgggagctcctcagaccctactggagcactgtgtgcttggctttctgaatgcttagaggtgacaggtgctttagcagacatccaatccacagcggttgcccaggcagcactacaccccccactgtcacttcaaccggagtaactccaacctcatctgctttagctatgggtccttcaggtaaatgtggctggaatggctggaagaaagggtcgggtctcaatgttgtttcaaaataaaagctgaagacaactgacctaatgcaactcgctcaatattcacagggggaaccgaggcgcggacaaggcaagtgacccccaaggtcatacaattctgccaagtgctgagcaaacactgcggactggacttctggtctactgctttccatggcatcagctaagatgactgctctgaacctggggctgcggcagcctctgatgatggccgtgaacaaatagaagctgagggtgaaggacctacagctgtcaccttcatctcttctcaacactgccaactgtctccttggatctcccagacagacgactagggacatctctggtttctcggtgctccctagaaacctagggtcatttcaaggcattatgcaaatgagctttccttctcttcacctcatctcctgatctgcacaaaaatgaccgtaggacccactgtaggtaccaatgtaggcaccaatcctcagtttaccacctgctctctacttgcttccctgccataactttctaaaagggatgtgagccatgtttaaagtcacctggtcactggagggatcttgttctacactctacatcagtggttgccaacctttttggcaccagggactggtgttgtggaagacaatttttccacggactgggggatggggggagtggtttcaggataaaactgctccacctcaaatcatcaggcattagattctcataaggagcacacaacctagattgctagcaggcacagttcacaatagggttcgttctcctgtgagaatggcatgccgctgctgatctaacagaggcagagctcaggtggtaatgggagcaagggggagcggctctaaatacagcttgccgctcacctcctgctgtgcagcccagttcctaacaggccacagatggtactggtctgtagcccaggagtttgggaatcctgctctacagagtttccaacctcagagatgaagcatcccctctgtaagtcagaaagaaattattcaagtaggagaattaaaacaggatcacagagagggaggctgaagaatttgtctttctgtgtttacttgtatgaggaaaaacggcacatggaggcatccacagtatttaatttgtttgtatactagttacagataaacaggtacaccccatatacaattaccaatactttttatacagttcatatttcggtacatcaacactattttatttacactctatttatgtacattaacatctttctaaagtcagtgcattgtcaacaagttttatacagtaa

SEQ ID NO: 4304 - DNA, 4441 bp, Homo sapiens
gatgctcccagaacctgcgcagctagcggatcccgtccgacagctgtgctgggcgcccgagagagcgcacggctcagcccaccccgtcccttccccggccaggagccactcacaaactcaaagatgaagagcaagtcgggcaaggtggtgaagaccgagaagccactgggcagggtgctgccccccgtcgccgctgcgggggccatgacggcgtgctggcgtcggccttgggacgggacgagcgccgctcagactccgcgcagacctctcgctggctccgcggagcccagtggcctgggcgcccccgcgcgcgggttaagagcaggggagcccggggcagaagagggaggagccccggccgccgcccaaccccgccccccgccccacgccccgggagacccggcccgagcgccgcgggcaccgccctgaacctcttcgaggccccgctgcgggcgtccagagctggggactgtgggtctgactcctgcgttccagccgtgggtgccacctcttgcgggaagcagggcaaaaccactttggtcaggcgctcctcgtgcctttctcccttcgtaggtgaccagcatctcgtaagaatgataaccatcagtaaccgggaccccaaaccttctcatcaaggcacctctcgggtcaccattactttaactttgaatttgggtctccttcatttttccgctggatgcgttaatgtgcgcgacccacagctccaggcggcggtttcctggcggaactggaccaccgccacaggctgggggtctgcagtgggggatgggaccggccgcggccgccggccccttccgcgtccactgagccggcgctggttcggcgctgggatcctgcaccgggcctctctgcttggtgctgcgcgtctgcctgagagtaggaggttgctcccagctgtgccggccccagcagaaggctgctggtggtggtgctggggcaggtcggccttgaatccatgcgacaggaagggacgttaccagaagagattcatcgctttctcttggtctgggcagcccgggccttttgagggtgggaccgctgctacccccacccccaggttctttgcctgcctgttgactgccggtgtttcatgttttgtttctctgtttcactattttttattttttgccttaaaaaaaaaagtattaccatgcagcagttgcccatttattttaatttactattaatagtgtgattgctgtgtttcctcctacaaacactgaagcctgaaatccgcccgagtccggattctcgcctgccaaaagggaattggccccgcaacctccagcttagactcccaactcttctttctttccattggcagctgctgcaggcaggacaaggggctccccttctctccagtggggccttcacctctccctgctgcacaattcttcctccttcccagtccctagggagagaagtatattcgtggacgcattttccaaagcaaaagtagcacgcccatcagctggccattctaagtgcctctggaaaggggccaggcatttgaaatgagaaaaccccactgtgcctctgtgagctgccagcccggacggctgcaaccaaggtgccattgtgtcgggtccccagggcagcatctctctggacacaatgggctgtgggactttaggagcccaggtcctcatccaccttgggcatctcatagctcgttagttggacctgctggcctctgagaggacatcttcttcctccccaggagaccgtcctgggaacaagccttaaagcaaggtggccacaggaagccgcagcctgaagagaggtgagatgaccctcaggcagtccagcgaaagctgcttggagatttcctatcagcacatactaattaagaacaagaagatcctatcaactcctaataatgtccttacctggcctggagggcttttgtttgtggtttggtttggtgatttcctacttatttcaagcctttgttgctaactcattcctacttgggcctgagcctttggggaaagctcgctcccaggggcaactcagtggagctcagcagtcccagccctcctttgataaggcagaggggcagcaatctctgaaagaggcttcagaggatgaggaaggcagcccggccagggtcaagggggtttgtccctatctctgtgaccccctcctcccacctggagttctccgctcgacgttcatcttcctgaccagactctaccctcggcagggcatcctccagccacccccatctgcccctctccttccccaccctagcatatgctcagcacccaagcagagcccagcctctggtgagtgctcattaaaccttagccaatggtggatgactccagctttgtctgtgcttgaccaccagaggaggacatggaagtgccctgtttggatgtaagaagcactggtgaggagtgaggcactggtaatagagagacattggtaaatagagaggcattggtgagagagaggcgttggtgagacagagagaggcactggtgagagagaggcactggtgtgtgagagagagagagagaggcgttggtgagaggaggcatttgtaaaacagaggcattggtgagagagagagacattggtaagagagaggcattggtaagtaaagatgggcctgtcttcattccccagcacagcttctgcaggtgctctgggccacctgctggtgaatgaggtggttgatacttatcagaagcccaggaccatattttggtttccagcaggatatgaaaaaataatttcagccaataataactcagtgagtatccttggtcttcccagtgggtgtgaataagagggtgggtctggggcttctgtcaaatattaataacgtggccttgggtgggtttccacaaagtaggaattggaaagttgccattgcagagccagcctggggaaggaagaggttaccacctccagtttgtgtgtgttcagggggagggaggagattgtggggagagggacgtgttcagggaaagattaatgggcaggagttgcccatccgtaacagtaggtgcattggtttttgaggtaggtaagatgactcccattttactgatgagctaacagaggctcagaagtgttaagtagctgcccaagggcacagagttgctgagcaccttgaacctgagtgacgctgcacctctaaagctccgagccctcgatgaaaaccctgctcaagatgggcaattgccagtcaaatgccagctccatgcagacatcggcagcctcccaaatccagtcttcatggtcatctcaggtgtggccccaggcacctgccctggtggacagggcttgggaccttcacctctgggaacacaaggaagtgggggtcatcatccccatttatggatggcgaggccgggtgccgacatgagttcagagagctaccctgaacgcgcacttccccctagggattttatttttctcacagacacagtcacccacagccctgggttccatagaaggcatgaagcagtgagggcacctgctggcggatgggggaatggcagccacagctgccatggcgtcagcgcaggaggggaacctgttactgagggcttgctgagtcccagcactgccacaggcactttgcctgcatggcttcatttaatcccacagaggcttgctggtgggtgtcacccaacatacaggctaggaatgggaggtaatgtgcgcaggccacatggctggtgactaggcctcttgattccagcaggcaggctctgtgtctactgcacaaaatccacaaactggaaaatctgaagtggtggctgctcaccagggcactgtcctttgatgggccatgggctccgtgtgcccactgcctccagggacaatgatccgcatgtgctcttttccccaccctcttgtaggatcatgttttctagaaccagggagatgtggcactctgccactgtccgacaaagtcctcatgatattctgagcacaaaacaggctggcattgtctgggtgacttgtggatggggatggagggtagagggtgtgtgagtaggaaagacagagtccctgctccctaggagagctctttccaagagggacagcacgtgaggctgagaggcacctggtcagggcctgtgctgggcatgctttgtccatgactgcaggcaaagtgctcagagacggtgtcttagtctgttcgggctgctgtaataaactacggtagaccaggaggcttgtcaacagcaggagcctgtttctcactgttctggaggctggaaatcctagatcaaggtgttgcagattccgtgtctgttgagggtccactttctggttcacagacggcaccttcttgctgtgtcttcacagggtggaggaggtgaagggtctctctggggccacttttctaaggacactgataccattcatgaggcctccatctttatgacctaatcac

SEQ ID NO: 4305 - DNA, 1084 bp, Homo sapiens
ctcttcgctcaccatcacttgccaacccgtgtcccgccagcctcctcgccagcaccatagagcgccttacaactaaataaagacccgagacctcgcgcaaaccagggtgctgccctttccaggcaagagggaaggcaggcagagatgaggacaggaacagagacagagtgagatggaaggatggagctaggcaaggatgggtggaaggagggaccccggaagggagagaaagagggagggagggagaaagggaggaaaaagccaggggagggagggtagaacagatggaaggatggacggagagacaaaaggagcaagaaacagagaacagaaggcagagacaaaaaatgtcttatgcctccagaaccaacaggacccagaactccgggaatatgttgggtgcccagtacaggctgagtgctgggcccacagccccgttggccggcggggcgctcagcggccctctggatcaccagcctgggttacttcatcccggagcaattcagaccaattccgtttccgaaggaatgagcgaattccccagagagcaatgagccgagactcaggtagttgtctgtttttcatccacatggttcacagatgacatatccccacgttgagccctgcaacagagctcgaggcagatagtcccatccacacaggagtcacacccaggccaactgaagcgtgattctggattccacgtttctttgccctctgtaaaggtgcctgttgctcaagtttctgccccccgaaagcgtgaccatgttgactgtttgtttcgcgagctctgtggggccccagaaacttccaggaatgcgtggaagaccagcatcgtgtcggtgctctcctttccagttttcaaacaggctatattggagactccacattgtacaggaaacaggaatccattgtcaggccgtgatgcacgggatgtttcttttctctgtggtttcgctctcgttgtctacgtgaaaatgaacgagatgaacacacctgcgtgtgtgagactatcacggcaactgtgacacccaggcgttggcaatagagttggcagcctgatcctgggacaaaggtggtatgg

SEQ ID NO: 4306 - DNA, 1534 bp, Homo sapiens
agtggaaagtgtaccaggctggtgtccaggtggcatttggccagaggggctgagctgggagctcctgggcctggggctggcagatagtggtgatttttcgccccccaagaccttgggcttgccttgttccatgaaggtcccaaatctgaccaaaggctgtaaccagatggtcactgtcccagaccaccccagggcgctttctcacctcgagagcaccgtttctccccacctccaccctggccgcccttgctgtcacctactccctctggtccctggcacccctccctgcctgcagtggtgtttcctagcaagtgcagcagcccgaggctgggctagaggcaggagggcctggcctcccagtgtcttgctggatacttggtttcttgcccctccgtttccacacctgtaaaatgggagcaatgacaggtcttcctggcaggacagtggtgaagcttggtcacacgggtgaacatgtgtgaggtaaaaaagacttcccatccctccttctgacctggaccggctcgcaggacccataggcagggacctgggcaaggtccgagggccgatgagccccgtcctctctgcacagttcagagttgggtgggagtggctgtgggctgcaggaggaggtactgcacttcgcacagttacgtggtcgggttggcatcgccgccgcctgacttcggcgccccgcgagttgggtgtgtgcggttgggggcggcccagagtgtgccccacgcctgccagtcgggtaggccagcctccctggagagaggggggcctccccaaggtggacgggtgcttccttccacccaggagcctgagcagagggtggagggtcctggcagctacctacggcagctgagagctgcgctctttagccgagcgggatcagggctacgtggacacagcccgtgccagtgtgggtggggcacgagctgtgggttccgatggcccagtaggcgttcacctggcagagagtgtgcgcgtgtctcccctccttggggcgcctcaggtcaggaccctgagaacctcacttatcctttgagctgcgccaaggctgttgtacaaaagacagttcagaaaataaggacaggctgttcctcccagccaagggtgtggccctaaggacccctaggtggggcatcgcttcccgccaggcacgtgccactcagtcttgggctgctttagtggcagcctcctggtttggaagcggaactgagggtcagggatgaccacatggctcagggctcagctggggtcctgagagtgggccctcaggtttaccttcctcctggaggggaactgggggccattgcccagtgcacccccacttccccttaggtgcgtgggccacccctcaaccggccccattatctgggctgtgggtgccattggtcaggaccgtgatggactcatacgtaaaacttgatgcattttaactcccttcatcctagaggattgagacctctggcgggtaagtgttcatattaccgtcctgccctagagccagggaaggaccctaggggagaag

SEQ ID NO: 4307 - DNA, 656 bp, Homo sapiens
gaacaccttggtataactttattcacaaactccagacacccaggcctggcttagcacagagggcatgttcttgccagtggcaaaaaaacccgatacagcatgtttgttaatactaaccattttaatttaaattaatagcatgtctggaagacaaatgtagttgatagaaaatataaaaactttactgtacaaattttacatcacattcaaaaaaagcaagtgtgtggcttgtggccacagaagatgctaggtttgcacgctgatgagatcctggctaacactgctgcatagcacaaactccaactggcttcacatttacgtctccaccctccccccacaccaaatcaacacagaataacacaggtttccagggcttgccattcctctctgtgacctcaagaggaaatgccgtaggatgacagagggtgttttgatttggtgacatggagagatcaactttgctacacactgctcacaaccccaaactagctaggattcaagacttcgagttagacagaaacccagggggctgcggctctggtggttaaaggcaggcagtgcagaggtggcaggctgagagccagctgcccccagtccttcagttccacctttggggcccagtggcttctgggttccttgaagacaacagggcccca

SEQ ID NO: 4308 - DNA, 11386 bp, Homo sapiens
agagcgccgtcgaccccacgccacgcagaggtgaagatacgcaggacgtcctctaaagcaacttccgtgggtgccaggttgtgggctgggggcggtgctgaccttgagagagcggaggaggcgcaggcgcagcacaggtggcaattgaagccggaagaacatctaccaagagcagagaacccaggaagaaaattctgcctctttaatacgttccaatatggacgttttccatatagatacctatctatatagatagatgctctgggatctgacggtcctggacaccttttaaacttgattttgtgaggggacgaacagcgtgacaattaaaagaagatctgggaatcgtaagtactgacagaatacctggagggaaggtgggactggagaatagtttgtgaaacagatcctgctgaggatgaatccagaacttcctgaagggttccgcttctgctgtgtagggacaaggttgtaaatagacaagccacaggcacctgcaaatggtaagtgtggtagagaggggctggaattgcctgttggtgtatctgtgggaagcagctgctatccttgaggaagaaaagatggagaaggtaagtggctatcaacctgtcagagacaacacattctgtgaagttgtactctttcatttctgacactgtggttcttaatatctgtcctaaacctggcagtcattgaggttcgcaaagtatctccttctatgtgacagtaaaactggaattactatcagaatggaatccattcctgctagagtaaaaccatgaaaagaaatcgcagttttgattatctgcttatcatttttaatagatcacagagtgcagtgttccttatttgttgtatggcaagttgatgaataactcttgattaatatcttttaatgttctgtttcacacagttctctcaattacatgtgaaaaatctgttatataagtaatgctatttaatgattaaaatggatatatgttttaaggtagtgccacccagtcttttttttttggtagaataatattattatctattggttgcctgccttgaagtacagtaatttctctgtttccattatttaaaataggtgagtgtctttgacaaagatacaaagaaaggggacagttatgaaagggaagaaaagatagatggagatgaaaagaaattcagtagtttcagcaagggaattaggagcataatctttgagaaaagtcttggttgcttaccattcgggctttgtgatgagttgaaatgtcctgaatgagaactgttctcaaatgctttcaagaccaacaaaaagtacgatacccacactgacctggaactctttaaaccattaagatatatcactttttcgcagttcagtccatattttttgcaaaatgttctgcttagtttttctgctaagaaattactgtttctgaacaaggttaagtgtcgtatgctttcattgtagttttttttcccctaacatatactgttttcctaattagactataaattcctccacagctgggaccttgttttgttttctcgccttccccataacaaatatcatttaagtgaatgttgtaaacagttacttcatttaaattgcccttaaaatgctttatgacaaagacgttatttgtagtaatacctataatggtaaaaagtttgttgcagtcttacagacgataagattgatcaattgttatatatgcttagtggaattttatctagctgttctaaagagccattagactagtctttctaatggaaaatgtttattgtctaagttaaaacagcatttgaggccaggcacagtggctcactcctgttattgcagcactatgggaggctgaggtgggaggatcactagagcacaagagttggagactagcctaggcaatatagtgagacctcttctctacaaaaaatttaaaaattagctgagtgtgatggggtgtgcccgtagttccagctactcaggagactgaggtgggaggatcacttgggtccaagaggtagatgttgcagtaaaccaagatcatgccactgcactgcagcctgggcaacagagcaagatcctgtctcaaaaaattaaaaagcattttatagactgcatgtttgtgtcccccctccctccgcaccagaattcatatattgaagccttaatctccaatgacatgatattagtaggtggggcctttggggggtgattaaataataagggtgaagccctgcatgggattagtgcctttacaacaagagaccctagacagcttgcttccactctttctttgctcttcaccatgtgaggacacagcaagaaaacagacaactacaaatcaggaagagggcctaatttgtgccaaccatgctggcactcttctctaacttcccagcctccagaactgtgagaaataaatttctgttgtttaagtcacccagtttatggtagtttggttatagttgcccatattaagacagcaggatgcaaaattgtggccagtatgattgctttgacatgaaacaaattttaagcacaaattgcaaaaagtaaccaaaatatatcaatccccactgctggcattaacactctaaaacaaactttgtatattgggggattttatttatttatttatttattttttttgctgaccatagtgactcatgcctataatcccagcactttgggaggccgagttgggcagatcacttgaggccaggaattcaagaccagcctggccaacatggcaaaaccccctctttacaaaaatataaaaattaaccaggcatggtggcacacccctgtagccccacctacttgggaggctgaggtgggaggatcgcttgggcctgtgaagcagaggttgcggagagctgtgatggcaccactgcactccagcctgtgtgacagagcgagactatctcaagaaaaaaaaaaaaggatgaggattttttttgttttcaacatgctttttaacatccactatattactctcatctttctaggctggaaaaaaaaatgttttaaatgttattctgaagtatattgcaacctttaacaattcagtagacttctgaatttttattttcatgtagcttaccacagttgtatctaggaatatatcacatagctgattaattggtgaaataacccttgcaattttacacaggttgtacagtgcacattttcaaggaccactcacatacatccatttgatattttttggtatcaagaaagtctttaaacaatcagtaccaccaatagcagtaaaaagacaaaactgtctgaaagtacctatctgtttaaaactttaattagctttatccatccattaaatagttattgaatataaaactgtatcattcactcttctacactctgaggaaatagtggtaaataaagcagatattgtccctactatcaggaaatttacattttagtagtaataagccataaattaacaaaaacagaagacagtggtaagtactaggcatgaaattcaaacatgactattttagattaggtgattaaagaaactaaaataccatttaagctgctgtgtaaatgacaagagaatccagctttgtaaaaattggtgaaccctttgcttgcagaagggacaactgcaaaatctaaggcatgatctagcctggaatatttcaggagccaaaagaaggcctgcatggttagagaatagtgacttaagacgcaaatactgtaactttggagggataggaaagggctagatcatgttacctttgaaagacaggaaagagtttagattttattctatgtgcaatggaaaaaaaaatgagagcattttaatccaaagagtaatataagataatatatttttaaaatccactttggtaatttgttaattggcataaagagtcagctttcatgtaacataattactaacatacttggatttaaatttgtcattattcttattttatttgtcccacctcttatatgttcattttgtcttcttttgcctttttgatttttttttttcttaattaggccatagcacctgatattcccaggcagactctcatccaagtgccaatcagccccagccctgcttagcttcccagatcagatgagaacaggcatattcagggtggtatggctatagaccttttagattatttttaattattccattttttctacctcataagcttgacagatgtcttttagtatctttttactgttcacctcaggtattaaaacatggaaccttggtttatcatctttaagataatttggtattatacttcttccaggacaatgtaaggacctgcgaacacatcaacttcatttactgccacacctcatgttatatacattgtatattcttaatatgtatttcctaaattctcaagacattttttatacaatatgaatttacatttcatattgtataaaacatttactttttctattgtgtttcgtggttcctggaatctgagcttccatctaagaccttatttcttcttgaaggacatactttaatatttcttcgaatatctactggtaacaattcattcagattttctgtcctgacactgtcttattttactttcattttctaagaacgtttttgctgaattagcagctattttatcattttgaagatatattttattccttctggcttccattatgtcctctaagacataatgtccattttgtttttttctcttcaaaggtaatctttttttggatggctacttttaagaggtttgtcttaagtttggtgtgcccacatgtgttttgtgtttgtttttttgtgtgtgtggtttttttctgcttcgagattgataatgtttcttgaatctggctgtgatgtccttaggctgtttgagaaaattcttagctctgtttgatcagacattgcttctgctttcactctcctttctcctcttcttttgatactccacttacatttgtatttgacaattcactttgtcccttgtattttccatttattttcttgtctgtttcatcctgaatatttcttcttaactttcagttcactattttctcttagtagtctcgaatttgttaaatctctcttgaagcatttattttagttatatttttggttatcagttcaaacatttctacttgattctgttttattgtttccagttgtttatccaatatctcaatcttttatttcctcaaacatactaatcataattactttaaaacctgtatctaataactatggtgtctgctattatctgacacttttcttgtttcttgctgttatcacattgtcttgcttttatgtcccttatttttatgttattttgtattatttattttataaacattataaatatataaaacttggcttaggttatgttttaattgaatgtcagaattgttttgattgaactgtatatgaggaaactatactttgaagtccaatatgatggtattttctaaagaaagaatttatgtctcctggcaagacctttggacactagtaatctaagatcttcttaatctggttagtgatagagacaattagaatataggcaggtctatttcctgttcatactttcacaatgtagacctctgaagtcccaactcaagcatgcagagtttaccagatcaggccctaaacttcagtttttgtctttttaattctatgggttagaaactctgttcaacttttcagccatcacctcaggaatcagaagatactccagaggaaaagctaatgtaaatgctggattcaacaactctgttttttccttctgaatatttcattgtctctaatgctgtcagatgtttgttttatattttgtccaagctgagtgtggtggctcacgtctgtaatttcagcaccttgggaggccaaggcgggaccatcccttgaggccaggaatttgagactagcctaggcaacataacaagacctttgtctcttggaaaaaaataaataaataaatattattagaagtgaaaatggggatgttgttacaaatgctgtggagattgatgagaaattatgaacaacttaataataaatgggaaaatataaatgaagtaggcagttccagaaaatgtaacttttcaaaagccatgtaatggaaaatataaatggtgggatgttgatgtaagaaatcatgatgcccagagacttttgccaaaccttcaaaggacagatcattacaattttacacaaaccattccacagtatattccacttatatactgtggaattggcccttactgcccttatcaaatttaacatcaaggttacagaagcttaatattactgccctgattttattagggcagtaatgatttgataagggcagtaagaattacagccctgtcatattcgcaaagacaaaaatcctaaataaaacagaccttagaaaatgtgtttttaagaaaagataataaaacatgatcaggttgaatttaacccaggaatgtattttagtatattaagagattagaaaaactatctggctatctgaacagatgcaggaaaagaaaactatttgaaaaaattaacagacatagataaacctttgggcaaattagaattgtgtagaacttccttgagccaataaaacctacaacaacaatattttaagatgaagtatttgaagcagtccattagaatcaggaacaagtactatgttggagatcctagccagcattataaggcaagaaaaacaaaagattaaaaattgtaaataaacataacttagtctacagataaattattgaagagctttgcaaggattctgaatatactattgatatggtttggatctgtgtccctacccaaatctcatgttgaattgtaatccccaatgttggaggtgaggcctggtgggagattggatcacgggaatgggtttctcattcgtggtttagtaccatcctcttggtactgtccttgaaatagttcttaggagatctggtaatttagaattgtgtggtacctctcccctctctcttgctcttgctccccctttgccttccaccatgattggaagcttcctgaagctgcctcagaagcagaagccactatgcttcctgtacagcttgcagaaccatgagccaattaaaccccttttctttataaattactcagtctccagtatttatagcaatgtgaaaacagataatatgactatcaatatacaaaagtgaattgcatttctttccagcagaaatgaactgttagaaaatgatttttgtaacataccatttactatattcctttaaaaatataaattaggtaacttaacaaaaggtatagaagacctctgtagaaaattacaaaactttattgacaggcatttaaaaatgtctaattttaaaattgccatgttcaatgattaaaagactcgagttaagatggcagttctccactacacaatgaaggtaattgcaatacaaatcccaaatgagtttttcaaggagcttgacaaactgattctaaagtctgtatgacaaaaagcagaattcaggatactccagaagcagatttaagatagaattgacttgtagatattcgtaacagcaaaaaaataaaaacaactcaaatatccatcaaaagataaaatgtttatccatgaaaagatactcaaaaagtgacacctttatataatgggatatatttggctgcaaaaaggaatgaactgctaatacctgctataatgtggataaaccttgaaagcctgctgaaataaagaagccagtcacaaaggaccacttatgattccatttaaacaaagtgtataaagtagaaaatgtattgagacaatagattgtggttgtttagggcttacaaagtttggggtgatgggggcccgaggtagtgacagctaaagggtgcagtttctttttgaggcaataaagttctaaaatgtatagttgcacgtttctgtagatacactaaaatcaattcagttgtgcatttaaatgagtaaattggtatgtgaattgtacctcaataaatctgttaaaaccatagtaattaggatattgtaatactggcttagagatggaaaaattgatttataaggaatcctgattgtaaggaatcttgacttatgtcagagatggcattgcataccagcagggaaagctagatcatttcaatagatgacgctgcatattcatatgggggaaaaatgaaattggtcctccctacctaacaccatacagaaaaagtagtttcagatgactttaagatgtaagtgtgaaaggaaaacatagtaaaccttcaaaagaaagattgcaaaatatttttatgatcttatggtagggaaatgtaatatgtataaaggaaaacatgtatgtccaatatgttaaagttaaaaacctctgttcaagactccataaaccctcagaatagcggttaatttcagtcatgcccaggaaacatacaagatgagcctggaataccttgtgcaagatagcaaggaagctattagagactacgagggtgtcatatcaaatggactcaggagacaactgaaaagcatccttctggccatagatgagaccatttgagtgtcaataaggacagtaaatgcaattgattggaacatatcaagtgtctttaaatctgagtacataatgattgtaaaacaaacagcatttagttggtcaacagtagaagatgctgttgcatcaattcattattttgaaaatcagttttgttttgtttttaaagtaattaggcatttgtcctgccttttgtatgtgaactgtaagtaaccacatagtagatgaggagagggttctctttgtacatgtattctagctaataaatggaggaatgatagaaaattgccattttgaaattcctaatgaacaaatggatttatttattgcatttcaacagctgctaacatgacagacaagaaaacatatgtttcttaatggaaaaacaccactactgatgttaaaatcttatcaaaaatttgaccctgatactaatcaggtctttagatccatccaatttgcagaaaatataaacaccattaaaactttaagccaatgaaacctaccacaacgtaatattttggaatggaaaatataaatgaaaaatccaattttggagaatattgggacaaattaatttcaacaaatatgttgcaggagaaaaggagacgagaaggacaagtggagaaaaccgtagattacaagagacttagttcaatatgaagcaacctgtgaacttggattagttatcttactgtataacaaatcaccctagcttaaatctaaaaatatttatacactttcttaggatccacaggtggtttagctagatgttctggcccaaggtctcatgaatttgcagtcaagatgttggctgggctgtagtctgaaagtttgactggtgttagaggatccacttcctagagggctcattcgtagagctgcctgtgttttctcacaacatggcaactggctttctctagaacaggtgatccaagagagagacagaaaccatgatcattcagagtgatgtaacattacttctactatataatgttagtcacacagacatttccctgacaatatgtgggaggagattacacaagagcatgaatactgggaagctagctgtcacaatttggccccaatgattgatagttcttgatttgcaaaatatattcatcccctccaaaagctctccaaagctctcatcctatgacaccattagttcaaggtctagaaatctaaatcagttccaattgtggatgacactcataggtgtacttaagtacagctcctcaagaagagttctttttgatctgaagactcatacactaaagacacagtctctgcttccacatgtaatagaaaatgaataggataataaatgtggacatgtatatttaaaaagagggaatattggaggtacataggttcacagaaattctgaaacccacctgggcacagattggcagttgcttggtcaagtttcaaggcctagaattctcttagctctgccttctgggatcttggatctactcactgagtcaccctttctttttcttgtttacacttctgcctgctttctgcctatagaagcttggatgtcccacaagcttctttccatttggttctctctgtgcctttcagtccaggctggccatgtttctgctaatagacttctcttaaaaactttgtggctcacttgtgaattttgagttcactccatcagacaaaagcaacaaccacacatctcgtcccacataaactctgcctcaagcttttgctgatgaaaatacccttaaactttttaaaaacctgtgatgttattcagagattttctgagacacatcgtttgtctgatgaaaatactctgaggcacaacttaagatctttctgagctattaaaggactttataactacagcctcaactttatgttttactggcagtgccctagatttgctttttgctcagagatattccccaattttagcacatttgtcatctgcacaggctgggaatcttcaaatccagcaagttttgacttgtttttgtttgtttgtttgtaatagagtctgttttttgctgtgttggccaggtgatcttggactcctggcttcaagcattcctcccacctcagcctcccaaagttctgggattttaggtataagccaccatgcccagccatggctcctttttgtttaacagtccttactttgatggtctctcttctcacacattttactatcagcaacaagaaaaaatacacatgaaatatttaacacttggccggcaatctcctttgctagatcaatgagttaattaggcattttttctactttgtacatatctgtggataacaaatttgctaaactttctgccattatgtaacaaggatctccttccctctagtttccaagaagagttttctaatctgttaagatgtcacctgcagcctcctcaaaggttatctattatgcttctataaaaaatttcttcaaagctcttcaaactttcattaacactctcctccaagttctaccttctgttcactgccagttttaaaaccacacttacattttaggtttttgctaacaccccacttctgagtaccaaaatgtatactgattttctattgctgcataataaactgccccaaaatacaacatgcaaagcaataaatattcattatctcatgtagtgtctgaaggtcaaaaatccggaagcagcatagctgagtggttctgattcattgtctcttgtgaagttatcagtcaaaccatcagctgagactgtaatcatctgatgttttaactagtaccagaggatacactttcacatgctattggcaggacactttagttcttcactagctgtttagcagaataccgca

SEQ ID NO: 4309 - DNA, 284 bp, Homo sapiens
aatgatgatttcatacaaaggacagagaacacacagttggctgtctagtgtaccggtggctgttctttggaagaattctcatatgtgtcgagggaagaatcactattaaatgaagcattttggctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagt

SEQ ID NO: 4310 - DNA, 469 bp, Homo sapiens
agtgttatttctgtttgggcccatctaccctggccacggcatgatgttcatccgcaacgactgaaaggtgttcagattttgtaaatctaaatgtcataaaaactttaaaaagaagcacaatccttgcaaagttaggtggaccaaagcattccggaaagcaggtggcaaagagcttacactggataattcatttgaatatgaaaaacatagaaatgaaaccatcaaataccagtgagagctatggaataaaactactgaagcaatgaagacagttgaagagatcaaacagaaacgccaagctaaatttataatgaacagattgaagaaaaataagagctacagaaagttcaggatatcaaacaggtcaagcaaaacatccatcttatctgagttcctcttgcaggcaaagggaagcagttggaagagaaaacagtacagcagttacaagagaatgtggacatggaagatg

SEQ ID NO: 4311 - DNA, 3943 bp, Homo sapiens
atttgaaaaggcagagaaagaagggtacatcgggctgcttcaggaagactggaatagagaccttcacagaagagagaggccccatatcagaaggaagtgtgacccagaaggatggagctcttcagagacaggcttctttgagaatcaagaaagattcagaacagcaatgaatgaaggttcctgttgctccacattctcaccagcacttggtttcatcagtgttctgacttcagccattctaacaggtttgaactgcatggactgcttatatgtgaattttcttccacttctgccacccctggaacagcaagaccaacccatccttttcctcctcttcttcagcatactcaaggtgaagacaacaaaggatgaagatctttatgatgatctacttccatttaataaatagtactatattgtacattccactgtaaatgagcaaacattacactggcagcagggaccagcatcctttatcaagaggcagttgtagctcaagagttgcatcttggtagcatcaatacagaatttaaggattacagaagatatctcagtaagttacactactggtttgaagaaaactgttttgacctctaattttttctcttattctaatcttcctgtcattttttaaagaacaaaagatggcctgtgttatcttatttggttatatgattacatattattatgatcaataacatatattaaaacttattaatcaatgcttctttaatttcagaaagttctctatacttggaagaaaaataaagaacgatttgcacttcatttccttagcatggagtagagcattaatcattatcattttttcatgccactaaatctttgcaatgataattctttaatagtattggtctacatccactagataaacattataggcttataatgtgccaggcactgtgctagacactggagataacactttgaataaaacagaaatggaactcccatcatggagctcagaaataacactgaaatgctcctggattttgagccagcaataacagcaggaagaaaactgcactcaaaacactatgaatttatttccgccatttaaaaaaaaagaatgaagaaggtatttcaaatccagaaaagatattttctcatcatgatagcagatgttaaagatattggaaacagtgcaatttctcctagtgtagaaggaggaggaagttggtagacacacagctgaaataaaggaagcagaaggaagaacacaggcagtgctcatcttgcaggaggcttgagcaccctaagtctatttataaatcagttgttcaaaactaacaagtagtgtcgcacatcatgtttatattttgaggtagccgcaacagccttttaaatgcacaatgtaattgaaacactagcatcggaaaagagtacagttgccaatataaatggtattttagtgaccaatgtttcctcggctccagaagctcctggaagattgtctcagctattcctcatggatccaaaagcctaatttcacctataaataatcaatggatattttatctatcttcaatttccaatgaggataaatcagcagagaaaagacaacactggcagccttaaagagaaaagcagtaaaaataagattatttcattgccatttttttaaagagatgggttctcactgtgttgaccaggctacaatgcagcagctattcacaggcacaatcatagtgcactacaaccccaaacttttgagactcaggcaatcttcctgcctcagccttcagagtagctgggactatagtcattgccattttagaaaccattttcattcactgcaactttcaccaaatatttattgagtgctcaccatgtgctagccactgtttggtatgctgacaatacatgtcagtgacccaaacaatgttcctcatctcatagaactcacatctactggagaaagcagacaataaaaattgtttaagaaaagcagaaacactttgccaagggttgataaactatgcaattcccatcaaaataccaccatcattcttcacagaattaggaaaaacaattttaaaattcatatgaaaacaaaaaagaacccacagagccaaagcaaaactaagcacaaagaacaaattgggcagaatcacattacctgactttatactagaaggccatagacaccaaaacagcatggtactggtataaaaataggtacagagaccaatggggggatagagaaccaagaaagaaacccacatacttacagccaactgacctttgacaaagcaaacaaaaacataaattagtaggtaaaggacaccctattcaacaaatggtgctgggatagctggtaagccacatatagaagaatgaaactagatcctcatctctcaccttatataaaaatcaactcaagatggatcaaaaacttaaatctacgtgctgaaactataaaaattctagaagataacatcagaaaaacccttctagacattggcttaggtaaagacttcatgaccaagaacccaaaagcaaatgcaacaaaaacaaagataaataggtgagacttaattaaacaaaagagcctctgcacagcaataggaacagtcagcagcgtaaacagacaacccacagagtgggagaaaatcttcacaatctatgcatccggcaaaggactaatatctagaatctacaaggaactccaacaaattagcaaggaaaaaaacaaacaatcctatcaaaaagtgggctaaggacatgaatagacaattttaaaaagaagatatacaaatgaccaacaaacatatgagaaaatgttcaatatcactaatgatcagggaaatgcaaatcaaaaccacaatgcaatactttactcctgcaagaacggcaataaaaaatcaaaaaatagtagacgttggcatggatatggtgaacagagaacacttctacactgctggtgggaatgtaaactagtacagccactatggaaaacagtgtggagattccttaaataactaaaagtacaactaccatttgatccagcaatcccactactgggtatctacccagaggaaaaaagtcattatatgaaaaagatacttgcacacacatttatagcagcacaatttgcaattgcaaaaatgtggaaccaacccaaatgctcgtcaatcggtgagtagttaaagaaactgtggtatatttataagatggaatactactcagccataaaaaggaatgaattaatggcatttgcagtgacctggataagactggagactattattctaagtgaagtaactcagggatggaaaaccaaacatcatatgttctcactcataagtgggagctacgctatgaggatgcaaaggcataagaatgacacaatggactctagggactcaggggaaaagggtgggaagggggtgaggaataaaagactacgaatagggtgaagtgtatactgctcgggtgataggtgcaccaagatctcacaaatcaccactaaagaacttacccatgtaaccaaataccacctgttccccaataacctatgggaataaaaaaataaaattttaaaaaaaaagagagaaaataaagcaaggtcaatagtcagagttctgttagatagaatggttagggaatttatctctgaaaaagtaacactcaaggagagattagaaggaaagatagaaacaatacctgtggctctctgaaggaagggtgctccaggaagagggaacagcaagtgcaaaggcctggaggaaaaaggatgctcttcttgttgccaggacagcaagaaaaccaaggaaattagaatagaatgagggagaatagtggcaagaaatggaatcagaaacacaaatagcagccaattcacttgaggactggtgggtcatgaaaagggctttggcttatattctgagtgaaacagagacccattaatggttttaagcagagg

SEQ ID NO: 4312 - DNA, 6316 bp, Homo sapiens
atcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaaaaaaaaatttttaatagctacatgaataatgtagagatactatcttttgatttcaacttcacatacatggaaatgaaagtcttgttatttaacacaaaaggaaatttaatttgcattatttaatgcagttaatattacctaaaatgttgaacttaagcttttctactttaagtgcctttaaaagttttgtatttggaatctaaaatataaaggaaattcttatgtagctctatacagttgcttctttattatatagttttgagtgttttgtagcaacttttttttttttaaccttagattgcacagagcagcatattcatggattcttcactattccgctagtgaatccttgagaaatgtatgttaaagattagctcactgagcaggtaagtaagtgctctgtcttgggtgggcaacaaatcttcatacagagtaggataaagaactattcagatataccagtatttgtatttagatattcccatttagatggctggtgttctgagctagtaaatggttaatgttacagatcttaaatattgctttggtagcaaatagtttattccctgagttttcaggttggtaaatgtttctgtaaaagaccagatagtaaatattttgggcttcacaggccatatagtcaatctaaactgcaaaaagcggtggtaagtttttgccatcacaatcctgtcttattttgatgtagtcagattgactggttggagtgttatttaggatcataaaggtaagtgggaaatgggtatgggaaactaagaagtcttggaaattagtgttgaataactttgaagcccttttatttgctggaatccattgggaggtttactttgctgcaataaactaatcaaaaaagtgatcggtggagcttgtgattggttgttgcaaattctttaaattattctaagtgcttggctacctagatgatagcagaagctagatcagatgaacctttttacctgagtattttaggacactagaccaacatttttaaaaaggactgtgaaatgtaaaacttaattttgccgtgtaaggacttttgaaaagacaactactatcttcccttaccattttattttaaaagtgactcccaatatttaggaaggacttaaactcagagtaatagagtaatttaacttgaataactttaagttaatgaaaaaattactacactggtattttctcatttactctgcatcactgaaaaatttatcgagttaattagtccatagactggcatttgggaagtgctataatacagttgttgaaagaactagtgtacttacaaagctgatattgactagtagattaataagccacatgtacactgttactgagatttaagacgtttttattgtgttaaattgtaagtgccatgtattaaaggggacactaagaactatagtgtctataaggaatgataaaaggctttgatagtctagagagtgagatgtggttgaagaaattggtgagtcttatttttgagaaggtaagtttaaagatagggagttttcttcagattgagtgaccttcatatatgagaaagaatagtatttgttctgtgttgttctgggtagaaaaattataagaaatgggagcttctggttttacgttgaatattctctaatgagaattctttcctttccttttccttcctccctttcccctcccttttctctcccttccccttcccctccccgttccctgctaaaaaaagctagtatacaagtaaaatggaacttatttgtataaaactgttgagaagttatttttaaatcaaaattgattttgaccatttaacactaactttaaacacagagattataaattgatgattattgctttattgttactagggtaacactggtgtaccagttactgggggaaccttagaataattaattattctgttttagttaaaacatttaaatatagggcagagttctaccatttcctaaaataaagttggtctttgaatgaatgactcaattaaacagagctgctttttcaatctaaaacacagccatataggataacctggagcagctgtcacataagacgttttcctatctacttcctgttctagtatcccaccacataccagtacatacagctgagtggcatggcatactgtcatctatagctatgctacacattttgacaaagctctctcaagtaatgctgataactggaacctctacctctttaaagtcactgttgaggatggatttgtttgcctatcctgtcttcaagtattcattagtactatgtaaagaactttggagtttcagatttgtcatttattctagggttctctgatgattccagagtggtttgtatccaggatgtatcacatttactgtgtatgtgtgtgtactctgtgtgtgtgtgtgtgtgtgtgtgtgtgtgcgcgcgcgcgcgtgcgtgcgcacatgtatttaattctaatgcaaaattttggtgaaaagaattttaaaagccagtttgtcatttttgtagacatggggttttgccacgttggccagggaagtcctggcctaaaatgatctgccccgctccgcctcccaaaggcaggggattacagacaagcatgagccaccacacccagcctgaacactaaatattttctataaggagtgttaagatagaatttcctcttaaagtcttagctggaagctgaatctatgtattaaatgtgaacagtcttatgataacttgtaaaacaagcctgaaaaagtctattcttttacaaatatttcatcaccacaggccacttatacaatacctctatactaagtattgaagtacaaccaggtctttattatgtttaaaaagtgcctccttccttttattaatgtcagttgacagtgatgtatctgtgaataacaaacaaggttagtctattcctagaagctctacttggtacagttgtcagagaaaattaacttggatgaaaccatggtgcatgttttaacagttataatagtttataaatttatatttaaaaaagcagacctccataattgctataggtaaatttctaatttctggttttctttgttatttttgtgttagaaaaaataccataccttgcggtaatctagtccctgatattgtgtgtgtgtgtgtgtgtgtgtgtctgtgtgtgtgtgtgtgtgccatttaaaaaaccttcacatttatttatttttaataacaggcaatttttaactaaatgtttacattattgactaaagatagttaaaccaattgttagtactaaaagaatttatgctgaaatgtaggtttggggactcagtgtctacaggatatcatgtttcactcaggtatttacagtagagctattattagattcaaaattgcccgattctaatttatattttaagtgtaacttagagatttttgcattatttacagctttattttcacaattcatttatgcttattttttaaatggagacattaacttttaggtgatagaaatgtaggtaaacgtgtggtatttaagtcattactagtttattactagaaaggcactttggtacaatatgtgatatctgcttttatatggtacaaccagatgttcttttgattttccttggaatttcacctttttaaaccagacctttaccaagttgtgtactcatttgcaaatcagctgaggagcactctcaagaaagtaacagatggattgttttaaaaaaagagagacactgaaatttttgatcatgggaattttgtcatgttcaatgaaaagtaatgttctgtcaaatgaaaataatgaggttcataaatgggaatatataagacaaaaatatgaatagccaaaatacgtttaaaaaatctaaactattgaacataaattaaattggttatccctgggaaaagatactgtatattttaatgatctctgtgtatttgggaactatagcagtaaatgcaaagatacatcttgcctgtctctcccggttttaagttaattgacacagatatttcaatagtagtattactcgttaaaattctgcaatacttattacctggtatcatttaaaaagatattttctctaagataaaagatactaatgaagatagaagacaccaatctgtttccatcctccttttctctcttgcattttcccttctgtgtattagaaacaataacaaaggcctgcttttatagtcttgacaaatcgtttcttacctgaaaggaacttgggttttctctttttaagctagctcttagtctgtagcttctgatagcaagtaatctcttcattctctagtatcctttgccatgacttaaaaatggagactatagcttaattgattgaatactctgacctagcagtcccatgtttgagtgcagggatggtgttgggcattttatcccctggtagtgatattctagaatgctttatgttcctaccccctaaaaaatcctccaaatccttcatattctcaagtaattatacaaatacttagagattatatatgtgaaagtcctagacagttcagtgaaaactgatgtgatataaaactacagcttttgaaaatgcaaaattaaaaatttttttttttgggtaactactagaatcccttaggaccactatgaaaatttggtacaactgtgcttaaatgttttgagaacctactttgtcaacctcagcattttcctcaggttttagtttggaattggtttcatgttcttgattttattctaattggtttatgtcacatacttcttacaaatcttaatactagttacaatctgataacctactctgggagagtgttttagtcctgaaaataatcataaaaagaataggtaagtatcctcactttacacactttagaaagtttaagtaactgatttgatgccacttcaccgataagtggctgaaccagtatataaatttagatctttaagagctatatagaaaacatggtgccctctggtaagatttttctttttaagtgaagttcattttcttcatggaataagatagtgtagttcagcaaatattgagtacctgccacatgacaaactgtatgttctttaagaaccgtatgaaattgctgatatttaactgttgtttacttatacaaactgcaacttagtgtgattcaatcttatactttatgttatttaattcttacaataatcccatttttagatagatgttttcatggcttagaaaacatttctgagcatacgatgtgtgtgtttctatctttttaaagtagaattccaccatgtatacagttttgcagtttctaaactcagtttttatctgggttttctttcctgatgtcagcttattttagaaaaaatagccaattcaaagttttctcagtcaactcaagaaagtgttctcagtcaactcagagactgtcccattcattctttctttctacatgataactgtatacaaaagtataatgctacttactgtataattctacttacacaacgtttttgaaaaggcaaaactatagtgatagaaagattagtagttactaggtgccacaggtagaaaaaaagtatttgctggcaaggtggcgaggaattttgggggtaatagaaatactctatatcatttttgtgatgcttacacaactgtccatctttgtcagaaatcatctatcctcccaacttatgaattttattctatataaattatatgtctataaagatgattttaaaaaacaatttatttttgcttttcagggtcagtgccaggggttgttcagcctacgtttagtaccactattcatctattatattcctgtcagcttgagagatacagtcagggagcacctaaaatcccgcagtgtttcagcacaaatacccgggcaa

SEQ ID NO: 4313 - DNA, 3981 bp, Homo sapiens
acatcctctttatgtcctgagagccatgtgcagatgaggaaaaatgacatgcaatgcatttttgcctgccacaatgactttgcaatcataacaagcaaaatgttctaaacagtaagtgaatcgaggaagatatactgccaagtcaggaagaaaaaatccacctgttcagtgatttcaggaactgctgaagaaaatcaccagaaaatcatactggtagccttcaagtggccatggtgggagcattgacccagggaaatccacatttcccaacacatgctggatacctgaggactccagagctactatctgctcatatctgctcaacattaaaaaaaaaaaaaaaacctcacattgttaagtgaaaaggtttattggcagatttgcttaactcaatttgcaaagataccttagaccaggggtcggcaaactacattccacagaacgaagctgcccattacttgtcttttgtttgtttgtttgttttgttttgttttgttttgagatgaagtctcgctcttgttgcccgggctggagtgcaatggtgtgatctcagctcactgcaacctcaacctccctggttcaagcaattcccctgcctgagcctcccaagtagctgggattacaggcacatgccaccatgcccaactgatgtttttgtatttttagtagagatggggtttcaccatgttggccagactggtctcgaactcctgacctcaggtgatccactgcctcagcctcccaaagtgctgggattacaggcgtgatcctaagtacagttttataggacaaccatgctcattcatttccgtatcgtccacggctgctctacagcagcagagtttagtggtcaggacagaaccggcacaacctgcacaacctgcacaactttcaaaggctgaatatttactctccggctctttagagaaagtttgcaactcctactttagactgatgcttctccaatgctaacgcgccagtcaccaaatcaccggcatctggtcccagcctccaaccataaaccacagctgaatggaaacttggtagcgcttgccttcaatagcagatgctgtaagaggaaagcaaggtgaccaagaaaacattgcaaaactctgggcagaatctggggcctgaagactctgagtcagaggcctctttttttgctctaaacacatattagcaagagtccaagaggcatcaaagatgagttagcagcaaaatgaggctttgtccttcatgtagaaaggattaaatgatagttgaaaatgcaataactttcaccctgtgggattcagtgatgttcagtgctgtgattatgtccaacttcaaatcttgctgtcccaactgggacagcccaaacatagggagccactgcactaagatgttatgatttattaagataataaagctagcgggatgacaaatgtttcatttttcccccatgtgtttcccccaaaggaccgtctgcttttgcatgtgatttgactatgcgctgaggacctagcgtggtatatcagcaaagtggaaaagtgactgaagtgactgtttatcatcttgtaccaagttacaccactttaagctttaactccacagctcttgcattattttaaaaccgtctggcagatctctaaaactaatggtacaaaccactctgtgatacattaaaatacatcccactctgtcatactgcaaacaagtagctgctccccagtctttgaaaaagtactttcaagataaaatatgtactcatgggttctgcaggtttttaaaaagtcttgaatcttcacagatttactgggggggaaggggcgtttcatgtaaaatgtgtttttccttgacatttagaggtcttgcaaagtggtttattatagatcttgtggacatctcgctatttaattaaatttcagaaatatattctctgcactcataagaaggaatatgaagagtgtatttgttcactgtctatttattattcgttttctgtttctaacacaaaattatcagttcgaaataagtcatcagaggcacttaaaatttttcagggtcagaactctaattaacctcagcaactctgcttaaaatgttgaataatataagacaagtccttacaggaatctttggtaatattcagtcttggtgatatatttacaactattttttaaaaactgaccttcaatgtctattttcaaaagacgtgagggaatggaaagcagattgagaaacaagtcacttgtgaggtctcatccaacacatttcagtaaattattgctggatgtaagcagctgaatttgtaaacgatttcattaccttacattttatagagaaaattaagagtaagttcacagtaaatgaacctctagtctgaaaatagctctttctcctcatttaaacctgaaatcagaaggatacaacccaaatgtgttccacccaacacattttgagataaatacatttcacaattgtcttattggtggatttgcttaacacaatttgggtatttgttaccctctgatgaattcagaggagtttttcagaggataacattgcatgtttgcaaaaagtttgcatgtttgcatgttgcgtgcaataagtttgcatgctcacaataagtttgcgtgtcctttagtgctatcttttatttttctgttagggattctagtttgcagtagaacaatttcctcctgcagcctcattcaaagtaccatcaggattcaacctgtttctctccatgagactgttttgctcctaacttatcagaataagagctcacgagatcagcagctgacggaaattgtcggaacaggagctgctggcacccgtgtagaaagcacagaaaatatgaacagttggaggcccctccaggcaagtcacctgggaaggctggtgacaggtgagaggaattggcacagcaggtaggaaggtggtgggcaggcaggtaggtgggcaccttacccattaagagctggaaaccttggccaggctcagtggctcatgcctgtaattccagcactctgggaggctgaggtgggcagatcacctgaggtcaggtgttcgagaccagccttaccaagatggtgaaaccccatctctactaaaaatacaaaaaattagcagtgtggtggtgggcgcctgtaatcccagctacttgggcagctgaggcaggagaatggcttgaacctgggaggcagagattggagtgagccgagatttcaccattgcactccagcctgggcaaccagagtgaaattccatctcaaaaaataatgaataaataaatagctggaaaccttgaggggaggcaagactgagaagggagagcccagggcagacattaatgtccagtgggctgactgggtaagaagtgaggaagtggaagccagagcccagggaaagaggggagggaaagtgctgatcccggggccactgggcaccaggctcgtgttagtttcctgtgtctcctgtaaaaaatgaccgcaagctcagtggcatcaaagagtgcggatttagtatcttacagttccagaaatgggaagtgggaaatgggcatccctggctagaatcaaggtgttgtcagagctgtgatcctcttggaggccctgaaggagaatccgtttcctggcgtctctggctctgaggggctgcccactttccttgggtcacagccccaccctccattcctaaagcccgcaaccctgggaagagacctgctgctgctgtcttccacttataaggacccgtgaccacactggacgcccctagacagtccaggatatgctcctcatctccaaaatcagcttaacaaatggaaaccctcctgtaaccctaagccctctgtttcatgtatagtgacatagccacaagatgtggttgttaggctctaggtatctttggagccattattccatcttctatacaccagtgcagaacaaaggcttattactcatggggaatttgcaagatctggtaccaaacaggatgtgg

SEQ ID NO: 4314 - DNA, 882 bp, Homo sapiens
caggcggctagcggggagagaggggaaagtctggggcccactgtcccaaggcagggagctgactctaggcataaggaggaaaagccccagatggaaggggtggaagggggctatgctgcacagaggaccgagggtggtcgctcacccaggcaggtagctctcgatgactcatatagagagttttcgcagtgagctgctcctcgtcgtccagtagctgcctcgctgctcgaaggctccgttctttctcgtcgcggacccggcgccagcccaggtagagggcgaggccgaagagcacgaaacccacgctgagtcccactgccccggccaaatacacagggtatttttttcttctaaaaccagtgctggaacctgtgctgtgcagaagagaggacaagacgagggatgttcccaaattcccataagaggacacagcccctcagtcagtccttcctctctgctggcttcagtctgcactcctctgcaagcccccactgtgaggcttgaagatggacaagaggaccctcataaaagggaggtgacggaacttgcacttggctcctctctgacagtcacccttgagaaagtcacggcagatagggacctcctccttgccatttggtaggtcagccggtgaaaggccaaggccagctgctactttctgcctcagccgtgggggaagctctcctgtcttcttatagccatcctcatcctccttggagccatggatgaaacggcaatttgggcggctacactccttgttctggaagtcatggcagaagatgaactcgtttttgctcacccccaagttggacacctcgctcatgtctgggtggcgatatcggcaacgcttgcctcgcttgcacacattcctcaagaagtctc

SEQ ID NO: 4315 - DNA, 746 bp, Homo sapiens
agaggcaatagtcactcttcgtagagaagatggctaccagaaggaggaaaatgtacatttagaaaactctcaataatttatcattatatgcaacaccaataaatatccttgtacatgcatatccgtgtacttgaccacagctgagttaaacagacatatcttaaaggatcctcttgtggccaaattgtcttccagaaatattttaccaatttatattccacctaactcaatgttggattattataatttatgccaatctaacaaatatacaatttgtttaggtttgtaattatttgtcttctagaaacattgaacatttctttttatgttaaataatcatgtatttatcttctctgagaaccacctgtttaccacctttgtctatattaattttgtttatattgaattttgtctaaattgaattttcatatttctggcagaaattttttgttgttaatccagccaaatctattcttctcttttgctaccattgcttctgtgcttagaaagatttctcccaactcaggaggagataaatatgcacctacatgtatagcttttttgttcatggtttcatttttttccatttaacacatttaaggattttcatgatgttttaatgaatgaaagtgtttcttgagatttgtacagaaaagcattatatagtattatgtggttcttaaggtttaaataagtacatcaggataaatttttaaaatatgtaataaataaactaatttaagggg

SEQ ID NO: 4316 - DNA, 1824 bp, Homo sapiens
agtcagtctattttgataaaatcaactgaaaaaacatttgcataaagactcaatgtaggggaaagattcttgacacaaatcttacattaaaagtctgttaatatttttattaacttttacaagatcctgttgtttttcatttactataagtcctaagtcaaatatgcctcacaccaagcatctgaaaagttaagtacagtttagtgtcacatttgcttgagcacatttgagtttcagattcatttaccattgtggaatctgcttttggatattagagatgtttgttcaaataccagaagacagaataatactatcttctaggctaaaactaattaattactttcatataatggacaggagaaattcacatcagatagatattttaccagttaatggtgcagcagaatatcaaactattttcttaaaatgaatcagataagaacattgctcataaaaaataacttttttgtttgatcaaaattatttatagttttatatgtataatcctagtttatcctgagatgtatttgcttttgctttttaaacttataatttaaaaaaaaagagagagagtcagaaggttgtttagatggagaccataacaaacttctgtttccctaaactcaaattgttactctagtctattgaaatacctgatccacttgagatctgccagttctgacatttgcaattccaaccttggcctactgagaatcatttggtgaactttttctaaaagttgccatatataaaaagatgtatattattatttcttctaaataatgcattatttcttctaaaaatgtgctgatgccataaaatgtattattgatatttttatcataaagcagttgattttataccttttacatatctcaaagcaagagggagatttgagagactcaaggtaaaaggtatttttagagagtataaattggtggttgactttagacgaatgcttcccaatgcatatatatgcacactacacatatatatgcatatatgtgtgtatacacacacatttttataacgatacctaatttaaattaacgtattcaagaagataaatgactaaaatagaacagaggcatctctgtctcctgagataaaattatcagcttgactaatagaataaagcactataggcatgattttttgcttccttatatatgcataactgatatgagtaaaacctgaaatcaccacactactcttctctctaaaagcttatagtaagtgcttgattatttaagggcatgggcaggatgttatatatattaaattttgagtatatgttaaattttttgatataaaattaagtcactggttgactgtaaaagattgttgttttttctattacaaataacagatctttgttttatatccatctactcctgccttttttccccaaatgcaactggagaaacttgtgtgtatgctagcatctagtcaatattagtcacactctgtggtgctagatgctatcaaattactatattagtagtagtgacatagcaactactataattagaaaaagatgaatggcagattttatgtaggcccaagggcattatatagtctaggttagtgttgtagatcatagataaagcaaaagtcatagattataaagggaatgttgaaattcctttaggatggtgcctttgcaccacttctctataactccaacataaccagttttccctctatagagttggaacagattatagtttagtagctcaccaaataaagtacgtagcttgtatttaccagctatggtatataaaaatatgaatcattaaatgctagtataaagcagttagtctt

SEQ ID NO: 4317 - DNA, 445 bp, Homo sapiens
agagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaac

SEQ ID NO: 4318 - DNA, 3052 bp, Homo sapiens
ttaacatccacaatgtgatttaagatgtaatcaacataaagcttgattgcattattttgcatgctgttttccaaatccagcttcgtgtcacacctacagcacatctcactcaagctggccacatccccgccatccagacgtaaaacagtcacaagacagggcaggcagggccgcggaggaggctggctggggccatcacggagtgcccatcctgcactgtggtcccagcaagtttctttctcctggcaagaagcctgtcccaggctggcaggggacagcgtgaggtgcagcctatggactgggaaaggggtgtggaagggccacacctaagtcctaaaatccaggcccaaaagtggcccaactcacttctctgactttaatcacacagccatacctggtggcaaaggagtattggaaatggagtcaggctgggtagccacgagcccaggaagaggggagaacagacttggagagggcaggagtctctggccaccaggggctaaagagccttcgatgaggcagtgatgtggggtcctgggctcagacccagggtgggtggctaaggtgccctcgccagggcttagccaccccaacagagatgggtttcgtgcccacgagagtgcctgtgccttgtgacgagaattcaccatgtttttgtctctgcaggcagagaacagcattgacttcgtcagcagggagctgtgtgcgcattccatcaggaagctgcaggcccatgtcctgttgatcaagtgagtctggacccatccccttcagtcaccccccaaggagacatgggcgccaggaatctctgggagggggccctggcatgaggctccaagttctctgcgtgtcgaccacatcgctaagactcaagatcttttttgggaagcccccctggcagcagggtcatggaaggaggaaggtcagaggaggggagggctcaggcagcaggggatgggccggggctgtcccatgcctttccacaggtgtcagcggggggcatgcccaggtaaggctccataaccagtgagcccagtctcgactcactgcaacctctgcctcctggattcaaacgattctcctgcctcagcctcccgagtagctgggactacaggcgcccgccaccacgcctggcttatttttgtatttttagtagagacgaggtttcgccatgttggccaggctgctctccatctcctgacctcatgatccgcctgcctcggcctcccagtgttgggattacaggcgagagccaccgtgcgtggcccaccatagacgatttttaagccataaaaagaaacgaagcactgacatgggctccagcatggatgagccttgaaaacatcgcactaagtggatgaagtcagacacaaccgtctacgtgttgtatggctgcattcacgttcaagtccaaataggacacacggcagagacaaagccaggtcatggttgctcaggaccggaagcctgttgggggtgggggggtggggtgtgtgtgtgtgtgtgtaagctcagaggtttgcgatttctttgggggtgatgaaaatgtaattgtgacgatggtctcacaactcaatgtattaaaaaccacgggattgtagacttttttttttttttttttgagatggagtctggctctgtcgcccaggctggagtgtagtggtgcaatctcagctcactgcaaggtccgcctcccgggttcacgccattctcctgcctcagcctccggagtagctgggactacaggcacccaccaccaagcccggctaatttttgtatttttagtacagacagggtttcaccatgttagccaggatggtctcatctcctgacctcgtgatccacccgcctcagcctcccaaagtgctgggattacaggcgtgagccaccatacccggccaggattgtagactttcaatgggaggattgtgaagacataaattctctctcagagcaagtgtgggctccagcgcctgttcagatcccagctctgctgttcagggctgactgtgaccaagtcctgaactccctgcgccccagcaaggctgtgccttcagcacttgcttgcgcctggcttgtgccagctgagcgtgagctgagattaactgagcctcaaatccaacccagggtcaagggacccagctgtgggagttggggtagcccaggctttggtttctcctcagaggcctgaacccagggcaggatgggggcaccgctgggaggcggttctaagatgaaccccaacaacccccaactcctcactttccagagcagtccacggatattttgatccaagagagaattactctgacaaggagtccctgtcgttcatgatagacacaatgaaatccaccctcaaagaggactacttcggatacaatcacagcaaccctggcctcggccctgccctgtccctgccatgcaacttcacaactcagctggcctagacccctgggaggcctccaagtccctaaggttagacatctcctggggtgctatggactgtcggggctccaaggagccgagtgtgggggaaactcactgtgggaggcgctcctgacctgcagggagctggaatgctgtgggagggccctgaccccggggcccatggagctccctaggctcctctggccacatctcactacccaccccctcccctctccagcggttccagtttgtggaagtcccaggcaatcactgtgtccacatgagcgaaccccagcacgtggccagtatcatcagctccttcttacagtgcacacacacgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctgtctcctggctaataatctccagccagctggaggaaggaagggcgggctgggccca

SEQ ID NO: 4319 - DNA, 792 bp, Homo sapiens
ggaggagaagccacagaaccctgggacctccgttcaccgcttcggcctccaccgcaggcacttggggaaactgcacagatctctgggtccgcctatctcccactgccatccctgcaaagagatatcccccggatactcacatgggctcgagagtcttgctgagccaggacttgagtgcctcgaagttttcaatgatcattttagaaaccatccacagcggccctaaggcccgtcacactcctccgcccgcccaggtcgcggccgctacagccgccgctgcccccgccccctcctccgcgcgccgcccgcgtgggccgcggtgggaggcgccggtggcaggttcccgcgggccccggtcggcgaacagctctgcaaggaccgccgcaggccacaagtgcacggggtgccaggagctccccgtccccggcccccagcccgggctgaaacagcaacggtttgcccgggccctcccccttccctcttccccagcaaatctacccagaccggaagcgcgacacgcgcttagacccgagccttctctcagcctcgggaccaggtgcttgttggctacgtcgaaaaggcaaaagtaaagaaagcgaaggcgaagggcagctcaatgggaacgattcagggggtcttcccggctcccagcacccccaagaagatggctgccggtaaatctcgcgagaattgatgaagtctcgcggtggctcccggagcctgctgggagagacgtaaggtaattcaagaggaaacgcttgagcaattactgatgttgtaaactgggatcag

SEQ ID NO: 4320 - DNA, 734 bp, Homo sapiens
attgttcttgctggtgtggtatgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacagacgaaatcttgctctgttgcccaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacaggctgaggaattaccaaggaggcaggaggtggagcaaaacacaccaagcctggtgccaatcattgacaatattatgaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgca

SEQ ID NO: 4321 - DNA, 375 bp, Homo sapiens
ggctgtgcagctcctcctgcccagggcttcagagcttgctccagcttactcctcgaagccacaggaccagtctatgttattgtcctggccactttcagactctcattttgcagctactggaattccggaggtgagcgctgcagctgctgatcaggcccattcccaggttctccgggaagggagcaaagcgggaggcggcacgctcctttgtcttccactggctgaatgccaaaatccttcacgctaccagtctctgcgaactccaggtagaagtagccacacttgactgcccggtgcacctcaaagcagaatcccaaacaagaatcctctatcaggtctacgtaaatctcctgagcgatggcctctagcttgtta

SEQ ID NO: 4322 - DNA, 1511 bp, Homo sapiens
tcctcctccgcacagctccggttgcggggaggcccgggtgggtacccggcgctccggctcccagtctcctgggcttctccagtccttcagcgccgttctccggtcacagggaatgaaagcgaggaagaaggaaacggtgtcgagaattgcgaagagagaaagcatagaaaacccacattagaggcactcccagagcagaaacccttcggagcatcccgacttcctcggcccgcgtgcaatccaggcaaaattgaggttgtctctgagccgccctccctaagcaggtcggaaagcccccgaatcatcccaggtcccgccgcgctgcactcgcaacctggggtggaggtccctctagtggttggcaccaaacaaaagttctgtcttatgaagagccgaggtcaggaagcatttccctgtgcccagcgccaaggtctgggaccttaggtccaagaaaagcgttggcaatgtctgaccacaggaatgggttctcgaactggggaggactgaagctggagatctggtccagcccctacctccagcgtgtggcctgaacccgttttggttgtactgctatgttgtggccctgcccaggcctccaaggactggctgctgttaagctgtttaaaatccctgtaggcctcagatggcagcgacaccagggactcggcatagtccccagctctggcaggagtcaccacagccctagcctttagttctctacaggctggagtgtcgacaaactccacaggacacaactttttcaaaccaaatttaccctcgcggtctgaaatgaccagtaggcccaggagaattttacatgtgaacagaacctaacccaccctggcaaatatgagacgtgtggtcactgcgggaacctggccagcagcagaccaaagcacagccagcaggggaaggctggggcccgcaagagttgtgttacaacaggacacccttcagttctctttcacttccttaaaatagcagcagagcgacttttgtagacgcaggctgccacagttcacacaaggtcatggctgtttccgaatcccaccctttattgccctagcggagccactccccttacctccgcccccagaaactgctagcctgttcttaaattgatacagttacctttttaaatgttctaagtcaccggctctggagcttctttgcactttggaaccaacttgcgggaaggaactttaaaaatactgatatctcgatccatccccagaggttctgatttaatggtcttggggatatggccacggcatgaggactgttaaaactccgcaggtgattcttatgtgcaacaaagtttaagaaccactgatgtaggccatgtcgatgtcagtcttcacttaaatccaacaagaccccagagctaaaacgttcacctgaaagaaaccccattcccaggcctgcatactgacctgcgctggctcacaagaagcaaagtggtcccttaacaggggcttcctggagaaaatgtcttgacctaaaagagtgat

SEQ ID NO: 4323 - DNA, 548 bp, Homo sapiens
ttagctaacggcacccaggactgtggtgtgatgtagcatccatttcagagagggaaaaagtgctttggctgtcccctgctctaggcacgtaggccaaatggacaggattgtataagagagaaagaacttcatgtcacgacactggcagagctgggtagacttagagcaaactaactagaaagacgaacagtgtcccttgaaatgcacaaggcttcctctctcgagggtgaaacactcacctagtgtgtccttcaggttcttcacgagggagcccttcttcaggctgttcttccgctccacgtagttggacggtacatagcccgtcctgttggccgcgttcctcacccgccaccacgtcttggagtcgtccagcaaccacagccgctcgttcttcttgatgtccagctcctggtcctgctgggcggtgtagtcccacttggctatcacaataacttcttctgtcatctttcatggagtccttctgccagcaaaacatttggagatgctcattagagaactacccggacacttcatcctttgcaccaact

SEQ ID NO: 4324 - DNA, 1905 bp, Homo sapiens
gacccttctcaggtgcagccagagagacactagcccactgatggacggacagacgtgggcagggtccgtgtcactaaaccacccaccactgccacagctgcctacaacagacacatcagatgacactccgggcatataaatgattttcactgaggacttactggttttaataataggtcctggtgtagagaagtccctcaacctattgtgcaatgagttttgagaagcggagaggtgcccagtgaatgcaggttccagacaaaaggtggagcctggcatcctgccctgcatgggctccagcctgctgccatctggggaaactgagtcatggcgaggctcaaggatgtttctcagaccacaccagtccctgaaggtccgctgacctcccaatcttgacggacagtgagaagaggttcccaggccacctgcaataggttctggctcggcctgggttgggccccgcagcgcctccaccccagagacccggaccaagttcacacaggacaatctgtgccacgcccagcgcgagcgcctggactcggccaacctgtgggtgctggtggactgcatccttcgcgacacctccgaggacctgggactccagtgtgacgccgtgaacctggccttcgggcgccgctgtgaggaactggaggacgcgcggcacaagctgcagcaccacctgcacaagatgctgcgggaaatcacagatcaggaacacaacgtggtggcactgaaggaggccatcaaggacaaggaggaacctctgcacatagcccagacccggctgtagttgctctcacaccggcccaacatgcagctgtgccgcgatgcagcccagttcaggtactgcctgggcctctgaggcagtcccaggtgcccccatccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatccccc

SEQ ID NO: 4325 - DNA, 896 bp, Homo sapiens
ttctttaaaaaaattttgccttggggtatgggagaaagagaaagagaggaagagagagagagagagatcagttgatgtaatgaacagttcattgtgagcatgatttcatttcgttcctttgtcctccttctatgagtaagagagtgggaaaagtcaaaacgcagctccatggagataacgtctcatgcggttccaggtgtggaacggggtccatttgacctagaagctttggcagagggagcagacacagtattcactatgttgatttcatcatcaagcaactggcaatcggttttacatgctaaatcacccatttctactttctgctttcactttttttgttcctttttgcagtcacacttttcactgacttggtatgaccttgactgagaagctcattttactactgatgaacaatgctgatgattctgatgttttttaaaagttagtattttgatttaagaataaattaacaaagggtagtttcatactatttttgcatattgtgtcaaagttttggtgcaatataattttcacctgaaatgttattagataaatttgggttcaatcacttaagtgaaaattagtcacaggcttgttatagggaacactgtgttaaacaaaaaaagcaagttcaatttttcaattcatctggcaactttaacagagatcctcagaaagaagttctggatattcaaatgcttactatagagaggatataaatagttggactctctaaaaagattattacaggcattatttctgaagatggacacctttacctttggcttctagtgaggaagtaaacatcaaagtgagaagaagtttgaggcatttcctatctgcctcttcccttccctcccaggggacatgaatgtcacactgatatacttctg

SEQ ID NO: 4326 - DNA, 1628 bp, Homo sapiens
accgcctagctcagttccccagatgaaacattgtttttgttaagtctttcctgaaggcatgaggataatggaggcacctccagacagttacttacgactgtactattcaccatcatccaagtaaataatggtttcttaagttgaatttcctaaatttttttaagatttcacatcattgttttcagtgactagtgttaatttcatattaaaagcggctctaatgttagcccaaaagagcccacgtttgcttttctccttgggccactgcaaataagtccgctgcgtcatgagagccttcagcttgtggtacttgttgggaatgctgttctgtggaatgggttccagtaagatgaggattaagttattagatccttcatgaaagagattgtgatgggcaaaatagagttcgtaatggcaccactcactctggacaaagttgggagacaaaacaaagataagtgtctccaatttaactaacgtggaacatttttcaaaaatactatctgtgaaaacgttctgggtaaagttcaaaaacttgaatgtgcttggtgcatgaggacacagcatgtgtataaaaggtgtatctgaaatggttaacatcataatgttcatctcagaaaacacggtgtacaaagctgtctgtgaaaacagaaaaacttggttcgtgatatgttctattgtcaatgctttcaatgtcgttttagaataagtaaaatcttcttcacgaatgctttcaattattgttaaattgtaaatattgagatattccacaggtttgggccaaagaaattgaaagactctgaccaggcatttccaagtcgtttctatgtggttgagggtaaaattcagtaaggttgaacctctggtgagttctgataaaaatttaatgaaaacttgacagttgtcatcattcaatttaatattagtcagttgtaagcaccctaaagtattaactgatatgttcacttggatagcgaataaactagttgggtgaaaaacaaggtgaagggtttttgcattcagaatttgtagactttctgtctcattttcttttatataataatttcttaaatccagaaggatataacttagatgcaagtgagcaattggcagcaaatctaatttttgcagcttcatagcactcaatcccaagaaattcagttgtgataagttgccaaattccttacagatgggcagggccttgaaatcattgaatgagagatctaaatgcctgaaactcacaataggatggcaggatatcttttgcaactgattatgagataaatccaaatattctaaatcctggttgaacttgaaaacacttaaatcaagtagctggattctgttatgggaaagtctcaaaactgtcaactctgatagaaagctcatgtcagagacctgaagctcagcgatgtagttctgagacatatctaagactttggttttcagcggtaggtcttttggaacatgaataagacctctttttgacttgtctactgcaaattcatttccgtcggagaactggattctggttccaactattatgatcataaggcaaacaaaatggaagcttttaacaataggttctttgtctttggtcatgatgttgcagtggctatcctaaaggg

SEQ ID NO: 4327 - DNA, 7291 bp, Homo sapiens
acctcctcagcagggactctccgcccagccagtctggaatggcctcgtcctgcctcccccaccttgaagcctctgcttttctcttccagcatctgcgctgcctgatttgctgagcacctactatgcatcagacgctgtgttctaggcaagggggatacacctgatggaagaaggtccttccctagacgtagctaacatcccagtgtgggagatgacacgaaacagcaaactccccacaacagcctcctcaacgctgcctcccacagtgcttggacaaaataattacagcaagatgcgggcactgagctgactccttatgtaggacatcccagtgcaggtagagaaactgagggacagttggaggttccttgcccttggtgatgcggtgagagggcctgcaggcaccagcccggccgcccgcaccgcttctcgcggaccccagcggagccgcgcttctcgtgccgctcctgagggtttccgcggcgccggcgtttttgttcccggcgcgtttaagtcgttgaggccgaatcaagcgaaggcggaaaagcggcgcgcagcccgcgtcagctgcagttccgtccccctggttcccggtgcgctaacaaaggcatttgcatgaaaacaggaaccccgtctgcagaaaggactcgttggcggggtgcatcgtgcgctccagtgcccctaccgcggcgccccgctccccaggtggggaagaagcggggtgcggggactggccccaaacacggctcggccggcggggaccggcacgctgcggcccgggcgacccccttctccgcccctttcccaggccggcggaaacggccgtctcgggcgtgggcgcgcttctgcggactcctcgggaccttttacccaggcgtgcggccggggcgcccggggcctcggggagccggcgccagcgtgcggagcgcagcggagcggagggagcggcgggagcggcgtccgtggctggtccaggtctggggcgcagcctccaggctcgccctgcgccgctctgggcctcggcctcttcgcctgttcgaccggggcgcaagcgtgtcacagcgcctgtctgcagggggaagcgggcttcccagaggggcgcgtggctcgcagaggggctccgggaatatccgctccgttggccctttccagagcttttccttagctgcttctcctttgaaatccgcctttttcccagcagcccttggaggcaggataaattaagtggtaaaagcagaggattaggaaccgggaaccctggattcaaatcctgcccgccgctgaccagctttgtaaccatgagcaggttactccgcctctggaggcctcagcttccccgtctgtaaaatggggcctaacacagtccagaaagtgcttagtgccgcagtgtcacacaccgagtgcttaattcattcttaaaattatcacttccagctgtgggacaggcgcagggtagaaaggggttttcttaaggtcacaggcggggtcaaaggcaaaccctccgggtcctcacaagtaagacttgcgaagcagcaagttccccaaagggtcttatccagccgggtaaggagcgccggggcatctcccccctctctctccgcgaagacgcacaagcaatggctggcgaacctactgcctggaatggggttcttgggtcgagacctttaaaaaaataaagaagaggaagaagaaagaaagaaaacaaacaaacatgcacgcaaaaacggaatgccagagcctttgatctaggagccagcttgctattcagggccgaccaccgtctcgccgcagttcctccccgggaaggaagcctcgcgctgccctccggtggcaggcgaggtagtgtcgcctgggcgcaactcacaagcaggggtttaccggagaagccagcttcgctctgcgcgggtgggggctgtgggggagagaggagggaaaatcggaattgttccctgactgctgttttttggtcccggtggatcttgggagtcttggaaagagaataataaggctctctgcatttgaaaggcataggagtttttacattctggttttatttatttttgaatggataacacatttacacgattcaaaagataaaaaagaggatagcgtgaaaaggaagtctcgcttccactcttgttccccaggcacccagttccccttcctagagacagccattgttacatgtttctgtgtacccacccggagacagtccatgcaaatgcaagtattttacaggatcaatagtagcttgctctgtatactcttctgcctcttgctgcttcgcttaaaaatgcatcatggagtttgttccatgttgattcacatagggctgcctcgttcttttgaacagctgcataatattccattgtttggctctcctgtaattatttgatcagtgttctattgatgagccttgaggctgcttctaatcttctgtaatcacagtgtgttacaacaaataagcacctacatgcattgttatgcctaggtgccagtgaggcacatagctattgcggtataacaaaccactccgaaattcagtggctttaaatagaaagcttttggtattgctcatgtgggtcagctgggtagcactgctgatctgggccaagctcagctaactttgcatttgctccttgtgtctgggatcagaaagggtgggtcagctggggctggtttatttaggatggtctaaatcacatgtctggtagttgactggctatcagctagggttagaggggtgttcaggctatgtgtccgtcaacatctgataacatgcagtgcctcctgagactgtataactggtgtgaatttacatccattacattctgttggtgcaaacatgtcacaagccagcccagattcaagaggtggggaaatagaaatcacttctcccagggaggagcagcaaagtcacacggcagagtatgatgcaagggccctgaggtattgtggccatttaaaaatatatttataatgttatagttagcattatggtgataacattacctttggatataaacattacctttgccattacctgacagacgttacctcaagcctcaaggctcatcaacagaagactgatcaaataattaacaacaataataattaacaacaacaataatttcaacagaagactgatcaaataattaactaggccatcagggttgacattaagtgatattgatattgatagcatattctcttgatataactttttgagaatgacactgtacctctgtggttttcctcccccaaaccagtctaataataaccccagtctaataatgagaatagcctcacagaatagccgctatgcacagcctccacttaagggatggggagttatgcttcacttccttgagggggcagtatgtaataagttatttggaattcttctgctactggtttattcagtcatttattctatccgtgtgcactcatggatatttattttgtacttttcattataatccaatactatgttatttatattgttgcttaaattgttccagttttggcgcctgggagctctctctattggctcctgtttccctttgccataattttttgttatgtttttgagcccttccttactttctggcactaaagctgctccagactcatcttgcatattttcttcccagccctagaatcagccgtttctccagggagcccggttcctttcactggagaatgttcttagaaacagatctggatggtgggtttgcatgttgctattggggacccactaccagggggcagagctaggaaatacatgtatgtatcctagcccgtgtattcacataactgtaatgattctgtatctatcattggtatctatattaagttaaacatgagctcatgctaccgtctctgactctaacacattcatacagttcattctatccttctccctttgcttatctataacctcccacttcagcagtgaaaaacctggctcctaccatctgccatccatttacttaattgttcaatgttagtacacatgtactggggtttcagaattgtcaaaccatacccctgtgagacacagctctaccaactggagggcagtgcttatggacagctcttttcatcttgagtcttcttgtttccagtcatttccaaagttgtttaggtcagcacctctagtctccatgcccttcaatgagatccctcgtacgtttgtaatacaattagattctgttgccatcatctgcattttatcctgtgattccccatcctcctagtagatttttaaaaattggcatacattaaggtttactttttttttttttttttttgagatgtagtttccctcttgttgcaaggtcgcgcaatggcgcaatcttggctcaccggaacctccgcctcccgggttcaagcgattctcctcctcagccgcccgagtagctgggattgcaggcatgcaccaccacacccagctaattttgtatttttagtagagatggggtttctccatgttggtcaggctgctctcgaactcccgacctcaggtgatccacttgcctcggcctcccaaagtgctgggattacaggtgtgagccaccgcgcccggccaaggtttactttttgtgctgtaaaattctatggttttgacaaatgcatagtgacaaatggatagtgtaggacctctttatatgttctagatatcaagcccttagcagatatatcaatcactacagtaccacacagaatagtttcatggctgtaaaatatccactgtgcttcacttagccacctgtctccttcttctcagtcctctggcaaccactgatctatttcccatctctatcatttgcttttttaaagaaatcatataaacggaattatcatatatatatatacgtatatgtatatatgtatatacacacgcacacacacacacacacacacacacatatatatatatataaaacatttggaaactggcttctttcatttagcaatatgcacttaagattcatccatattgttgtgtgaattaacagttccttttatctccgaataatgttccatagtatgactgttccactgtttgtttatccattcacctattaaaggacatcttagttgcatctggctttattatgaataaagctgctataaacattgtgtgcaggtttttgtgtagacataagattccttatcagttgagtaaatacctagggacataatttctagattgtatggtaaatcaatgtttaactttataagaaactgccaaacttccaaaccgtacttccaaagtaccatttttcattcccactagcaatgagtgacagtttctgttgctctgcatcttcatcagcactggtattgccagttggttgtaatttagctatttttataggtgtgtagtagttgttttaatttgcatttctataatgacgaatgatcatttcttcaaatgcttatttgccatttgtatacattctttggtgagatgtctgttcatatcttgtgcccattttttaatgtagatgtttgctttcttattgttgagttttagacattgtttgcatattctggatatgatctttgggatggttaattttatgtgtcaacttctctgggctatcacaagggatgcccagatagctggtaaaactatttcttggtgtgtctgtgagattgtttccggatgagattagcatttgaatcagtacactaggtaaagaactttgccctcagcaatgtagatggacattatctaatccattgagggtctgaatagatcagaaaggcagagagagtgcaaattctctctctttccttgagctgagcatccttcttttcttcttcgacatcagagttctcctggttcttaggtcttcaaactctgggtcctataatagctggtaccctcccctcaggcccctggcctttggaattaaaagttctgattctctgagaagccctgactaatacaatctttcattagctatgtgatttgcaaatatttactcccatcctgtgtcttatcttttcatccttttttttttttctttttagtgacagggtcttgttctgtcacccaggttggaatgcagtggcataatcatagctcactgtagcctcaaactcttgggctccaacaatcctcctaccacagtctcctgaataggtgggactacaggtattctacaatgcccagctaatttttttttagaggcggggtcttgctatgttgtccaggctggtcttgaacacctgaattcaagcaatccttccacctcagcctccaatggagggcaatggtgggatctcagctcactgcagcctccacctcccgggtgcaagtgattctcctgcctcatcctcctaagtagctgggtctacaggcacgtgctaccacgcccagctaatttttgtgtttttttagtagagttggggtttcaccatgttagccaggctggtctcgaactcctgacctcaagtgattatgcgcatgactcagcctcccaaagtgctgggattgcaggcctaaaccaccacacctggccaacagtgccttttatagagctaaagtttaataaagttcaactatcaatcttttaaaattatgtttttggtattgtatctaaaaactagtcagcacatccaaagtcaagtagatttctcctatgctttcttctagcagttttattgttttgtgttatatgttaagtctatgatctattttgacttcatattaattttcatgtaagctgtaaggcctatgttaaggatttttttctttgtctataaacatctaactgttccagcatctttgtcaaaaatgagttgactgtatttgtgtggatagctttctgggccttccattctgttccattgatctatgtgtctgtatttttgaccacactgtctttgattactgtagttttatagtaagtcttaaaatcgggcagtgtgagtcctccaacttggttgtttttcacaatattgttggctgttctgtactttgccatcccatgtaaaaaaaaaaattttttttttttttttttttttcttttgagacagagtctcgctctgttgcccaggctggagtgcagtggcacgatctctgctcacttcaacctccacctccaggcttcaaatgattctcgtgagtcagcttgcaaagtagctggaattacaagcgtgtaccaccatgcctggctaatttttggatatttttcatagagagggggttttgccacgttggccaggctatttagttgtttgagtttcttatacgttttgaatattaaccccttat

SEQ ID NO: 4328 - DNA, 629 bp, Homo sapiens
atacggccaatcagacatcaaactcaatttcaaaaatcctgaatttctttaggcttctcagatgcttgagagtttataaaagtcctcaatgccctagcttttggatactgcgacaggactggggtgggaagaaaagtcgggaaaatccctgctaggtttttcttaggcgggaaataaattttgaccatttaaacatacacaggtccactggttactaatatttatctcatacagatatcattacttttatttttatttatttttttgagacaaagtcttgctctgtcacccagtcctccctcacctaatttatttgaaaccctatgatataaaacagattaaagaagagctgctcagcttaaagcacaagtaggaatcagaaccctttttactctttttttctccctgtctgcttgagccatcttttcctactctcaatccttgaggaacataaaaaatacataatttgaaaagaactgattctgtttatcaatagggaaaaaataatttcatttattttatccatactaagtttatctctttttgctgaaaaaggtatattaatattaatgtccatattaaatatgaacattagccaggcatcgtggcacgctcctgtagtcccagct

SEQ ID NO: 4329 - DNA, 879 bp, Homo sapiens
attccgagtagcgggatcccgcgcagcctcagggctgctggcagtgaaagtggggggatggaggaggtgtccagaggaaagacctggagatctggagatacaggacggtcagggtggtcagagaatttggatcttttgcttgttggaaatcgggaccgctccgagaaacgtaagcagctcgatgttgttagtgccagtggagacacttggcactcacaatttgcagacgtttgggaaagcatcgtttctcaagaggaccccgttcccgtgtctgtaaatcagagatggtacccacttcgtagttcgctgtgaagcctgtgagcgaggaggggctttaaaatacagaactttgcactggagcgctccccgtcctcgcagcctgcttggtgtgcaggtggttcccaggcggcttctgcttccgaaaagcagatcgtccctttatctcgagtcttctccccgcctctccctcttctccctaccctatttgtcttcttgggaacaaatggcacattcatcagagtggagatccataaacgggactggcgagccgaagatttaattctgaagaataggatctgctctgtgctttcaggttaaaaagctgtaaatatctttgtaattctagcagtactttgccctcttctgccatctgaacgcgtgctccctgctgacctcatcggctcccataaagatacgccgggcgtgatagtgcacgcctacaaatcccagctactcgggaggctgcggcagaagaatctctggaacctgggaagcagaggttgcagtgaactgagatcacaccactgcactccagcctggaccacagagcaaaactctgtcttaaaaattatatttttaataaaaataaataataaatgc

SEQ ID NO: 4330 - DNA, 9585 bp, Homo sapiens
ccacagacacccagggcaatgtgatttgtcacttaaagaggacggcagatcaagagcatctcatcctccggctgctgagtcatcctgctctggcagttatttaaacagaaggctccaggagacatacaatcaacactccactcagacaatgcccagacctccagaaaccatgtgtcaagctcggattgccttagacagaagctcacccagctggaactcttatgggaccttggcaccagagaccacaaattcctctttgaagttttctaacagcaacaatggagtttgtctagcagaggagtctgtcatgtaatcaggaaactccagtacacaacgtgatagctctaagacaggtatatacaagatgatgttctggaccttaactgtttggggagtactactgcctttgtctaaaagccatcaccctttttatatgccatttgggaggaactggggggacgtgggaggcttcaaagggttatgggaggatggacattttaaaagggcttttcttttctttttttttttttgagacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaagggtttttccttaagcctcacaacaatttacagcattgccagcagcattcagtacattcagaacaggataatttcacccgcagctgaactagggccatgcctgggacagacagagaatggccttccagcagacatgccaagaagcaagccagggtcagtgagtgaagaggagggcaggcccatttgaagcaacacagtttatgtaagtgtgatctaactgctttcactggaaatgggtcagactccagttgagagaaccaggggcctgaatgaccccagcaaaatcactgtggcaattctttcaatcacctctgagaatatggccctgtgacgacataatgacgtttggattaattccagtcggctgtgttttcccctcctttcttgcctccccgtagttgatttgccaaattttttttgtttgcttaaatacgcggaactaaacaggatacattatatgacagtctgtgataaatttaccactgggaatagggaaaaagtatgggataaagaaataggtatttttcgcctctcacagctgtgattcagttctgactcaaaaggaagtgtgccacctactgaatcacagaaaccacttcctgtggctgtttggtttattctggaggagcatcaggccaagtgctgccctgccctgaccctgactggctcttcagagccaaggcattcacagcttgaggtggtttggcctcagactcttgagaacattgcatattaaattacaagtgtttcgtttcctagcaaggagtctttagcaacatgaaaacgaacgtgtgttatttgcaaaccaagtatatcattactgaacctgaatatccttactttttcataaggtacgtattccggatgaccactcttaagatctgaatgtacactggttctgtttttcctgaggggaacttgggcagtctgcagggtggcatttaccagctgagggacttcaagagcaccctttaatcagtgtggcagcactcaacttgtattcactcactcagagtatttttgagcatgtacttattgccatgtgctgtgctaggtaggggtagagggtacagtggtgaacaagaccccacagctcctgacctcatggctcatgtgttctacaccataagggaatcaagctgtgtctcccggggcaggggccttcctctgttcaccatgcagccccagcatctagcacctggcgttgcataaaggaggctctaaatcaagcttgtccaacccaaggcccacgggccacatgtggcccaggatggctttgaatgcagccaaacacaaatttgtaaactttcttaaaacattataagatttgtgtgtatgtgttttagtccatcagctattgttagtgttcatgtattttatgtgtggcccaagacaattcttctatgtggcccaaggaaaccaaagattgaacactcctgctctaaatacttgtttgttgaatagatacatgaaaagaaagaaggagagaaggaagaaaggagggcggaaggaaaggaagaagggagagaagaagagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcgtgcctgtaatcccagctacctgggaggctgaggtaggagaatcgctggaacccgagaggcggaggctgcagtgagttgagatcatgtcactgcactccaggctgggcaacagagtgagactctgtctcagaaaaaaaaaaaaagaaagaaagaaagaaagaaagttaccattagttttttgttgtatttgcaagcaaagacaaaagcaccaaggtacttgtttccttctgtaattagagtttcaaatagactaaaagtttctgctcttaggtgggtctagagactctccagtacctcaggacctcaggacacatggggtctcttggttgttttcttttcattgttgttgtttattttatttttgtttttattttttaactttaaaacaattttttgtagatgaatatgcttacatatgtttgggggtttttttgagacagggtcttgctctgttgcccaggctggagagcggtggtttaaccacagctcactgcagcctcgacctcccaaggtagggactgcaggtgtgtacactggggtgcaccaccacacccagctaatttttaaatttttttttgtagatattgtctcactctgttggccagactggtcttgaaatcctgggctcgagcaattctcctgcctcggcctcgtaacgcgttaggattacaagcgtgaacaccgcacctggccagcatgtggtctcttaaccagaggaggcctcttctgaactaggtagaggtcctgagaattgattctgagagtaaaaggctctttgttctcctcagagtagattagaatccctaatgatagagcatctattattcctctagtggtccatgcccaacagattcatccaagaatagatgaagatctttgtaatgttgtgcaagtaatctaatcaccccacagaagagctgtgacttaaattatcccagagtcggcccacctgttttcataaagatcaatgtaacttgtaaatttcttcagttctcctcacctatcatcatttgactaacaaaacccagaaaactaggctagttatggtggcctatgcatataatcccaactctttgagaggccagggtgggtggattgcttgagtccaggaattcgagaccagcctgggcaacaaagggagaccctgcctatatcccagctatgcaggaggcgaggccagaggattgcctgagcctcagaggttgaggctgtagtgagccatgattgccccactacactccagcctggatgacagagtgagaccctgccttaaaaataataataatagtaataatatttcataaagatacaggaaactagattataattgacattttcaaagtgaaatactgtctagaatggtgcttggccaacagtaagctttttgtaagtggaagtcattactactactatttctttcattattattaccattactacttttttttacaaaaaaaaaaccctggacaacacactgaaaccattactacttctactactataacttaggttgcacctgatagagccagcaatttttccaaggtatgacaatggccatatgtttaatgatataattctatggctcagtgtatctcagcctttttaaaccctgctcttcttttgacaattgtaaaaatcttaaactgacctccagttgaaatcctctgtcaagaagatattgtcggccaggggcggtggctcacacctgtaatcccagcacttttggaggccgaggtgggaggatcacttgaggttaggagttcaagaccagcctggccaacatagtgaaaccccatctctactaaaaatacaaaaattaggcaggcatggtggtgtgtgcctgtaatcccagctactcaggaggctgaggtaggagaattgcttgaacctggcagggcagaggttgcagcaagccgagatcacgccactgctctccagcctgggtgagactgtctcaaaaaaaaaaaaaaaaaagaaagaaagtaagaaaaagaagaaatcccaatctcttcttttatgtggattcttcctcacttgaataatacttttcttccccagtattctccatattatcccagagtcagcccctctgtttttgtaaagatctacgtaacctcctctaagtttcccagttctcctcacctatcatatcatttggctcaacaaagggcaggaagctagattctaattgatattttgaggccgggagcagtggctcatgcctgtaatcacagcactttgggaggctgaggcgggcagatcactggaggtcaggagttcgagaccagcctggccaatatggtgaaacctcgtctctactaaaaatacaaaaaattagccaggcttggtggcttgtacctgtaatcccagctactcaggaggctgaggcaggagaatagcttaaacctgggaggaagaggttgcagtgagccgagattgctcaattgcaccccagcctgggtgacagagcaaaactccatctcaaaaacaaacaaacgaacaaacctgatattttcaaaattgaggcaattataacagctatttagccaagcattatgatagcaataatagcaagaaaataaattagttaacaaatgagtctcagaagcccaatgatttttattttatttttattttttgaacttttattttagaatcaggggatacatgtgcaggtttgttacccgggtatattgcatgatgctgagttttggagtatgcatgaatccaacctgtcatccaggtagtgagtatagtacccaacagatagtttttttaacatttacttcactcccttccccaatcttgtattcccctgtgtctactgttcccatttttatgactgtgccaacaataattttttttcttttttctttaaatagagatgggggtctctatttaaagagcctcccaaagtgctaggattacaggtgtgatccattgcacctggcccatgccaacaatatttgaaacccttatctgcgtgtacaagtttgctactggttttgttttgctcattaatacatcccaagcatctatacctggcttgtagtaccagcatgtagtaggtgcttaataaatatttattgaataaataaattagtttgacattagtttaacatctcaagtaaaacaaaataccattcaattaattctcttcttctacttttttcttttaagagagacaaatagtcacacatacatcagcaggagaggatacaatttcctgtgtttaagtttttatgagttactttagttcaaatgtcacagaaaattatattgaactcttgaccaatctatctattttttccattggagtattgacccaaataagaaatagcataaaggaaaaattattttttggcagaaaaatattctctctaaattcttgtgtgttttgttttgattttttccttagtgactggaggccagtttcaatccactgaagcacagattccaaattttcaatctggttttcttgagtagtgactgagtgccaaaaatgaagcaatgacacaacatcaccatcaagacactccccagcacgcacacacatgccagagtccaacaccaagatactccccagcacgcacacacacgccagagtccaggccatattcgggtggcttgcaagcttcttccccccaagtatttactctcaaaataatggtttttgttttgttttggtttggtttggtttgtttttttccaaatacatttcttccctatatctttaaccaattctcataaaattttgtctaatacactggtcagtgtattccagaccctaaaagataacataatgaaactatctatgactaaaaggtaatcaggatcttctacttatccttttttcctccctcttaaactttaattttgatacatttgggagtgaaatgatgacaataaatgcaaagtaattattgaagaaacagtaattttgtattagcttactgaaaaaaaaaaaaaagataaccaaatatattttggcagccccaaacgagtcacatgtgaaatgcagtgggagagcagtgtcctgaaggaaaaggtggcctgctggacagccaagagaacaaacatccactgcaagtaatatgagctctaagtttggactaggcctatgtctgctctgagacttggggcaattcacttaatcagagccttaatcagctacggactagcaatatccatacccgctacttattttgtaaatctcctttctaaagttaactctatttattgttccataatcccataaattctagaatcttttcctgttatagccaagttgtctatcattgacagagatattcacctggttgttttggcttctctaatcctcctggtgagaacacctccaagggagctttcagtggcatttaaggtcacttgtgctcttggtcctagaaactgccttgatagtggttttagctcacatgaggtaagtctttattatatgcccaacctctttatgcattacttcatttaattgtatactaatcctttgtcataggttatcagagtgtttgattataagttacaggaagaaaaaaaaaaacaaactccaattgactaaaacaatggggcattttttgactcacataacagagagtctagagagaaggcaccttcaggtttggctgatgaatcctgtatctctgccttgtctccaggcccccaggttctgcctctgtcctgacatccagtgttggattcctcttcacatcaactcctctctgtaggttgggccatcagaccctacctccttatttatgttgagcaaaggagagagaatgcctctacaaacaatgaaaaaagtgaaaaaaaaaatctttctcctccttataactttagttagcttaactttagtcagttgcttagctactaaacagtagctattgggaggtgggaaggaatactattgtgtaatcaactaaggctcatacagaggattagggttatctgaattgatttgaattaattagaatttactctcagagctgtggcaattccttgaaccacactgattgctataaagtggaagaggaatagattgaattttggggagtcaactacaatgtgtactacaggaacaaaacccatcagaagatgtcagaagataaggatttttgtcctgatgctacacttaccagctgtccctcagtgttctacttcttaaaaaaagagagatggataaacagaggcaacccgaggataaaggccttgctcagtgtcacacatttcagtcactaaataagacacaatggatgccagtattctcatcccctcacaaataaagagccttcaagctcttgcagtcaacaagaacttttggaatgatttcactgcctgaaaaggcagatacataggtgacacccacaaataggaagaaaatcaacctgaacctgagtgtgtgggctcactgactctaagcagtagagacagaagaaaaagttttagcaaagaagggttctgaaagaaaataaatatagctcgttatcaagtgctgtttttacacagtaaaacatgggcaaaattactcttctttaagtagtaattcttatctcttgattaagtcacctactcattcatttaataaatacatactgattgttttctatgtgttgagcactcatctctgtattggaaatataataatgaccaaagttgacaatagtaataacaataatagctaatatagcaggcactaataattatttgttgagtaatatgtcaaaattcagtgtgaacagcattctatttggggctgcatccactgactataacacagctaatctatctgaaatgttccagctttgggcctctctaacagaagaagctgttgttgggcctgcctctagttggcgatgcatccaccaatgagaatgaatttatgatcgaccactcttcctgtaaaggccgctggaactgacagcattgtgattttcttttactgttagttttaaattactagaaccaactcaattactagaacgaactttacttctttgtttcctacttatcaaaacagtaaaaacaacaagtaaaagaaatgccatcttaatattgttttgatgacaaaacagtattccttttagttgtgcttcaaatggaataagatgcaaacaggcttggtatggtggctcacccctgtaatcccagccctttgggaggccaaggtggaaggattgcttgaggccatgagtttgagaccagcctgcgcaacatagcaagaccgtgtctctacaaaaaataaaaaattagctgagtgtagtggtgtgtgcttgtggtcccagctacttttgaggctgaggagggagaatctcttgagcccagaaggtcgaagttgcagtgagccgtgatcgtgccattgctctccagcttggacaacaaagcaagaccctatgtcaaaaaataaataaataaaagacataaacatatctgagattaactttcagtggtaaatttgttccatatatgatttttaaggttaaatgctttggaagctttaaaaaccatttcagcccttttaaatgccaacttacactgatgatgctctcagatgttaggaaatcttttgagcagaaaatggaagtgggggtgttgaggcagggaggagagtgatgcaatattccttagtgtcatcctgtgatttcacaatttgtttttcaatctgtttggactttcaaaagggaagactctcatatgtcaacaagcccatgaactgaagcttaaaacactggaaacaacaactgtagagtttcaagtatatgtacatttatgtattcatgttccttgatgggaatgctggctggtgtgaatgttcaatctcctgagaaatgtaaatttttctctgacagatttattagcttgctgtatctgagcacatgagcaaaaacaatgcctaataagaaaactttctctctccttcaaagtcaaacttgggagaaatgaagggaaatcgagttttctttgcttgacagtgttcaacattcttgtagtcagtgtgctcatgaagattgcaaacttt

SEQ ID NO: 4331 - DNA, 10331 bp, Homo sapiens
atcagtacagcagcccatgctgctgctctgcctatggagtagccattcattcttcctttactttcctaataaacttgctttcactttactctatggactcgctccaaattctttcttgggtgagatccaaaccctttcttggggtctagattgggacccctttctgataacatcttcctggcaaacttcaaaggggtgatactgaggagacccaccccccaacaacaaaggaaacaggtcgcagcaccaatcagctgactttggtaataaagcatgaatctgagctatataaagagaagggggagctgcagattcccagcagctatgagttactcagcatcaaccttacccctcctgcaaggcttctcatccacatcacagttgatccaccttgagctctcctatccggtgtttcctctttcctggactatgatccataaggactgggtccatcttgagtagttgtgaccctcaatggccaacatagtggaaactcaacatacatttatggtatgggcaaatgagtgagtgaatatatgcatggatgaatttctactacttataatggtctattgtaattgcccattttcttttctgttttccccaactcaactgggcattctgttaggcagaaactgtgtctgctttcttcaccagtactatgcatcccagtgcaaggggtagtgccagatcagtaagtatttaaaatatggaaggaaaggagggactgggggaatgttgatcctctaaaagcttgtcatctagttggggaggccagattagcacatatgaaataatctgagaatgagaagcaactaaactgatagctgtaacattctgagatcttaagatacccacagaagctgagttggtgtgagctggaaatggagtgcctggggactgaaaggccacaaagctctgtctaggaaaggctggtaatgggaccaaccattcaggcagaatttggctgggacagtattgtgaatttgaaggtttctgagggaagggaagtgttgataactgatctaaggtgattgggcttagattatacacacggagtgcttagaggtgaatcggaattctaggtcccttcttccccaaactcactattgggctatgatgaaagtgcaggggggagtttggcctcacagacaagcctgtcttacaaggcaggacaaccatggccacacctttcctggtaaacacttccagctctctaatctttgggtacttgacaagtgcattgcatgaaaggttcactcaaaatagatgtaacagcattttagtgtcaggagaatatgttagacttttagttgaatcaggagacagatctctccgttaagtgataaaatacaaacccaaagggagtcctagcccaggaatgtccctcacaaagagagttaggctacagtgttcaccaaattcttaaattcttaattcatataagagcaagattctagccaaagcttaagtactaaagtttcaccaatgaaacagtcttcttttcttttcttttcttttcttttcttttcttttcttttcttttcttttcttttcttttccttttgagacagtcttgctcttgttgcccaggctggagtgcaatggtgcaatcttagcttactgcaacctccacctcccaggttcaagcaattctcctgcctcagactcccaagtagctgggattacagtcacctgcctaatttttgtattattttggtagaggcagggtttcaccatgttggccaagctggtcttgaactcctgacctcagatgatccgcctgcctcggcctcccaaagtgctgggattacaggcatgagccaccacacccaggtaattaattgcatatttctatacaagcagtgaacaattggaaattgaattaaaaatcgcatatagtttactaaatttattgctaaacgctttgtttttttgatgcttttgtaaatggttgtgatttttaattcaatttccaattatatgcatcataactataaaaccttgctgagaggaaaaagaactaaataaatggagagatatcctgtgttcatgggatagagaactgctaaaatgctgtcaaaaatgttaatttttccaaaattgatttatagatacaatgcaatactaataaaaatccaagcaggcttttttgtatatattcatagattgattataaaatttatacagaaagccaatagttctagaatagacaagcaattttgaaaaagaagtgcaaagttggagggctcacaaaacctgatttcaagacttaactatgaagctacagtaatgaagacagtgaggcgtttgcttaacaatacaccgatagttcaatggagcagagtagaaggtccagaaacaggcccttacatatatagtcaattaatttttgagaaatgtggcaaagtaattcaatggagacaaaagtattttcaacaaattgtgctggaacaattgggcatctatatgtctaactatatctccatcatattgattttattcataattatcacaaactgaaaacaatctaagtctcaaatggtaaatggataaactatgaaatactattctataataaaaaggaatgaactactgatacaagtaacaacataattgaatcccaaatatattatggttaagtgaacagaaccagactcaaaaggctacttgctttgtgacattttagaaaaggaagaaaacaaataggtcaatggttaccatgggttggtgggtggggaaggggttcactataacaaggcccaaggaaattttaggggaagatagacccattctgtatcttaattgtggtgatggttacacaactggatgcaagtgtccaaattcagaactatacatacacatttaagtgtccatcaacagatgaatggataaggaaaatgtgatatatatgcacaatggaatattattcagccataaaaaataatgagatcctgtcatttgcaacaaaatgggtgaaactggaggtcattgtgttaagtgaaataagccaggcacagaaagacaaatgtctcatgttctcactcttttgtgggagctaaaatttaaaacaattgaactggagatagatggtagaaggatggttaccaggggctgggaaggggaatagagaagtgggaggaagtgaggatggttaatgggaagggaatgttggttaccagagtttgggaaggggagtagggaagtgggatggaagtgaggatggttaatgggaagggaatgttggttaccagagtttgggaaggggagtagggaagtgggatggaagtgaggatggttaatacaaaaggatagttagaaagaatgaataagaattagtatttgacagcacaacagaaagactatagccaatacttaattgtacattttaaaataactaaaagagtataattggattgttttgtaacaaaaagaataaatgcttgaggtgatgtattccccatttgccctgatgtgattactatgcattgcatgtgtgtatcaaaatatctcatgtaccccattaatatatacacctactgtgtacccacagaaattaaaaatttaaaaaacaactgtacatgaaaagaatgagttgtactgtaactaaattacatctcaatacatttaaaaagaatttaagaaagcgttcttttagtactttcatgatctcagcaactacatgagcactgcacttaagcccttaattaactttcacaattcctttgaacttgttggaggtgtccatttgctaatgattagtttgttcatactcatttgactctgatctgcaaggataaaatatgaaaattattctctccctctcattcttttcttttccttccctctgatttcctctctccttctcattgtctctccctctttctttaccagtaaaagtatacctctatatgttgctggcagtaaggcatggagatggatttatgtcacctttgacaaaggcgctttttgtgaactagattctatggagctgcaaggccatattggcattgaaaactctaggatgagctttaattaatcaagtatctgcttctgttagccccataatgcatatggagatttccagatctttcttagaatgctggcaaaggctgccctatttcctctggcaagccacttcttgaatttctattatacaaaatgtggaaattggaggcagccctgggcatcaagggtgtggctatgcaactgtgatcttggggagtagcgtttgaaatcagagaaaccttatattagatggatcaaggagggagccaggagattgatatcctcagaaggtgttacatgtttctcttggaattgcagttgctcaaatttctctctttctcaattttttttggcaatgaacatttttaaacttttacaaaactagacagaatagtttggttgacccctgtaaccatcatccatattcaaaaactatcagtttatgactaaccttgtttcagcaataccctcagtaaccccttgccttagtcattttgaagcaaattccagacatatcatttcttctgcaaatatctcactatttatctcaaaaatataaatattctattttaaaaataaccataattctaccttagaaagtaacaataaatttcttgatatcattaaatattagtattcaaatttccaattcttttataaatgattttattttgttatgttttgtttgcataaatgtgtttaaaaacagtttgcttgaatcaggatccaaacaaggtctacacatttcaattcagttgctatctcttatgcctttttaaatctgtttcccctctatttcttttttaaaataaactttatattttagaatagttctagatctatagcaaagaaagttagtacagcaatttctcatataccccatacccagtttccccactattaacatctacattggtatggtgcatttattataatgaatgaagcaatataaatacattattaactgaagtccatactttattcagatttccttagtttttactaacatcctttttctgttcccatctaggacaccacattacatttagtcatcatgtctccttcggctcctcttgcctatgacagtttctcagagtttctttgtttttgatgaacttggaggctttgagaagtactgatcacgtattttgtagaatgtccctaaatagggctttgtctgatatttttctcgtgattatagtagggataggggttttggagaggaatcttgcagaggtgaagtgccgttcctatcacactgtatcaagaatacgtactattgacatgacttatggttgacattggccctgtttgtctgaggtagtttgtcaggtttctccactgtaaagttactcctttctcaccttcctcatactgtagtctctggaatgaagtcgctctgtgaagcccacatttagagtgaagagttatgagccacctccttgagggtgtaatatttgcataagttatttggaattcttttgcacagaagatttttctcttctccctcatttatttatttattcaatagtctatatatatggggactcatgggtatttattctttgggttataatccactattattttattttgttgctcaaattattcctgattatatgctaactcatgtatatatacatatcaatattttcatatgtaacatctgtatctacgttaagtttaatatgaatttatgctactatctccaactctaataaattaccacaaagataattttagcctccacccttgcttatctctaaatttccaatctcaaatttctcaacagtgaaaaacttggctcctaccatccaccatccaattgcttaattgtccaattccagtatacatgcatgacagtatccgaattgttaacccatggcaataactttatcaagcagaatacagtgcttatgtgcaattctttttgtttttagtcttacagactccatttatttccaaaattacttaagtaagttggcacttaagttgaacatacacctatcatatgacccatccattccattcctagctacttacccaaaggaaatgaaatcatatttccatacaaagacttacaaacaagtgcttatagagcctttatttgtagcagcccaaaccaaaaacaacccaaaatgtctatctacaggtgaatggatgagcaaatttgatttttccaaacaaatactaattagcaacaaaaagaaatgaggtgttaatatgtgcaacaatatggatgaatctgaaaattattatgctgagtaaaagaagccagatacaaaagagcaaatactgaaaaaaaaagagtacatactgtatgagttcatttatgttaaattttaggaaatgtaaatgataatgacagaaagctgatcagtgattgcctgggaatcaagaggtttggaagagtggcaggagggagcaactataaagacacaaactttggaggatgatggatatgttcactcgcttgattgtgaggatgttttcatggataaaatcatatgcaaaagttatccaattgcatggtttaaatatgtacagcttatgtccattttaccccaataaaaaagtctgtgcttcctatcctttactgattcactctagagcagcttctcaaactttaatgtacacatgaagaaggtacaattctctctcccctgagagctgtgttaaaatgcagattctgattgctatgcctaggaagtgacctgagattctgcatttgtaacaagcacctagatggtgccattgctgctggtctgaggggtcacactttgggtagcaggtgtggtggttcatatactccatatataagaatctcagctcctctacaaataacattctaactttgggaaattttctttccctcttgagtctttatttgtttatctgctaaatggatacaataaagatatttttttccagtttgttcttaaattaggaaataatgcaaaggaagatcaataatcaaccccccttcaataatcaaagtataagaatacatagttctccatttgcttggtagatcttcctccatccctttattttgagcctatgtgtgtctgtgcatgtgagatgcatttcctgaatacagcacactgatgggtcttgactctttatccaatttgccagtctgtgtcttttaattggagcatttagcccatttacatttaaggttaatattgttatatgtgaatttgatcctgtcattatgatgttagctgtttattttgctccttagttgatgcagtttcttcctagcatcgatggtctttacaatttggcatgtttttgcagtggcttgtaccggttgttcctttccatgtttagtgcttccttcaggagctcttgtagggcagtcctggtggtgacaaaatctcttagcatttgtttgtctgtaaagtattttatttctccttcatttatgaagcttagtttggctggatatgaaattctgggttgagaattcttttcttttagaatgttgaatattggtccccactctcttctggcttgtagagtttcttctgagagatcagctgttagtccattgggcttccctttgtgggtaacctaacctttctctctggctccccttaacattttttccttcatttcaactttggtgaatctgacaattatgtgtcttggagttgctcttctcgaggagtatgtttgtggcattctctgtatttcctgaatttgaatgttggcctgtcttgctaggttggggaagttctcctggataatatcctgcagagtgttttccaccttggttccattctccctgtcactttcaggtacaccaatcagatgtagatttggtcttttcacatagtcccatatttcttggaggctttgttcgtttctttttattcttctttctctaaactttttgcttcatttcattcatttcatcttcagtcactgataccctttcttccagctgatcgaatcggctatggaagcttgtgcattcgtcacattgttctcgtgccatggttttcacctccgtcaggtcatttaaggccttctctacattggttattgtagttaaccatttgtctaatattttttaaaggtttttaacttttttgcaatgggttcaaacttcctcctttagctcagagaagtttaatcatctgaagccttcttctatcaacacgtcaaagtcattctccatccagctttgttccattgctggtgaggagctgcgttcctttggaggaggataggcactctgatttttagaattttcagtttttctgctctgttttttccccatctttgtggttttatctacctttggtctttgatgatggtgatgtacagatggggtttcgctgtggatgtcctttctgtttgttggtgttctttctaacagtcaggaccctcagctgcaggtctgttggagtttgctggaggtccactgctggagtttgcctgggtatcagcagcggaagctgcagaacagcaagcattgccgaacagcaaatgttgctgtctgatcgttcctctggaaatttcatatgcacccaatacaggagcacccagattcataaagaaagtccttagacacctgcaaagagacttagactcccacacaataataatgggagactttaacaccccactgtcaacattagacagatcaacgagacagaaagttaacaaggaatccaggacttgaactcagctctgcaccaagccaacctaatagacatctacagaactctccaccccaaatcaacagagtatacattcttctaagcaccacatcgcacttattccaaaattgaccacatagttggaagtaaagcactcctcagcaaatgtaaaagaacagaaattataacaaactgtctctcagaccacggcgcaatcaaactagaactcaggattaagaaactcactcaaaaccgctcaactacatggaaaccaaacaatctgctcctgaatgactactgggtacataacaaaatgaaagcagaaataaagatgttctttgaaaccaacgagaacaaagacacaacataccagaatctctgggacacatttaaagcagtgtgtagagggaaatttatagcactaaatgcccacgagagaaagcaggaaagatctaaaactgacaccctaacatcacaattaaaagaactagagaagcaagagcaaacaaattcaaaagctagcagaaggcaagaaataactaagatcagagcagaactgaaggagatagagacacagaaaacccttcaaaaaatcaatgaatccaggagctggttttttgaaaggatcaacaaaattgacagactgctagcaagactaatacagaagaaaagagagaagaatcaaatagatgcaataaaaaatgataaaggggagatcaccaccaatcccacagaaatataaactatcatcagagaatactataaacacctctacacaaataaactagaaaatctagaagaaatggataaattcctcaacacatacaccctccaaagactaaacgaggaagaagtcgaatccctgaatagaccaataacaggctctgaaattgaggcaataattaatagcctaccaaccaaaaaaaaagtccaggaccagaaggattcacagccaaattctaccagaggtataaggaggagctggtaccattccttctgaaactattccaatcaatagaaaaagagggaatcctccctaactcattttatgaggccagaatcatcctgataccaaagcctggcagagacacaacaaacaaagagaattttagaccaatatccctgatgaacatcgatgcaaaaatcctcaataaaatactggcaaactgaatccagtagcacgtcaaaaagcttatccaccatgatcaagggggcttcatccctgggatgcaaggctggttcaccatacagaaatcaataaacgtaatccatcatataaacagaaccaaagacaaaaaccacaggattatctcaatagatgcagaaaaggcctttgacgaaattcaacagcccttcatgttaaaaactctcaataaattaggtattgatgggacgtatctcaaaatactaagagctatttatgacaaacccacagccaatatcatactgaatgggcaaaaactggaagcattccctttgaaaactggcacaagacagggatgccctctctcactactcctattcaacatagtgttggaagttctggccagggcaatcaggcaggagaaagaaataaaggtattcagttaggaaaagaggaagtcaaattgtgcctatttgcagatgacatgattgtatatctagaaaacc

SEQ ID NO: 4332 - DNA, 10409 bp, Homo sapiens
atcagtacagcagcccatgctgctgctctgcctatggagtagccattcattcttcctttactttcctaataaacttgctttcactttactctatggactcgctccaaattctttcttgggtgagatccaaaccctttcttggggtctagattgggacccctttctgataacatcttcctggcaaacttcaaaggggtgatactgaggagacccaccccccaacaacaaaggaaacaggtcgcagcaccaatcagctgactttggggcaaccatcttgcccagagaccgcatgttgaaacccctggtagaagatcattccaacacactttgaatggatcaaagtaataaagcatgaatctgagctatataaagagaagggggagctgcagattcccagcagctatgagttactcagcatcaaccttacccctcctgcaaggcttctcatccacatcacagttgatccaccttgagctctcctatccggtgtttcctctttcctggactatgatccataaggactgggtccatcttgagtagttgtgaccctcaatggccaacatagtggaaactcaacatacatttatggtatgggcaaatgagtgagtgaatatatgcatggatgaatttctactacttataatggtctattgtaattgcccattttcttttctgttttccccaactcaactgggcattctgttaggcagaaactgtgtctgctttcttcaccagtactatgcatcccagtgcaaggggtagtgccagatcagtaagtatttaaaatatggaaggaaaggagggactgggggaatgttgatcctctaaaagcttgtcatctagttggggaggccagattagcacatatgaaataatctgagaatgagaagcaactaaactgatagctgtaacattctgagatcttaagatacccacagaagctgagttggtgtgagctggaaatggagtgcctggggactgaaaggccacaaagctctgtctaggaaaggctggtaatgggaccaaccattcaggcagaatttggctgggacagtattgtgaatttgaaggtttctgagggaagggaagtgttgataactgatctaaggtgattgggcttagattatacacacggagtgcttagaggtgaatcggaattctaggtcccttcttccccaaactcactattgggctatgatgaaagtgcaggggggagtttggcctcacagacaagcctgtcttacaaggcaggacaaccatggccacacctttcctggtaaacacttccagctctctaatctttgggtacttgacaagtgcattgcatgaaaggttcactcaaaatagatgtaacagcattttagtgtcaggagaatatgttagacttttagttgaatcaggagacagatctctccgttaagtgataaaatacaaacccaaagggagtcctagcccaggaatgtccctcacaaagagagttaggctacagtgttcaccaaattcttaaattcttaattcatataagagcaagattctagccaaagcttaagtactaaagtttcaccaatgaaacagtcttcttttcttttcttttcttttcttttcttttcttttcttttcttttcttttcttttcttttccttttgagacagtcttgctcttgttgcccaggctggagtgcaatggtgcaatcttagcttactgcaacctccacctcccaggttcaagcaattctcctgcctcagactcccaagtagctgggattacagtcacctgcctaatttttgtattattttggtagaggcagggtttcaccatgttggccaagctggtcttgaactcctgacctcagatgatccgcctgcctcggcctcccaaagtgctgggattacaggcatgagccaccacacccaggtaattaattgcatatttctatacaagcagtgaacaattggaaattgaattaaaaatcgcatatagtttactaaatttattgctaaacgctttgtttttttgatgcttttgtaaatggttgtgatttttaattcaatttccaattatatgcatcataactataaaaccttgctgagaggaaaaagaactaaataaatggagagatatcctgtgttcatgggatagagaactgctaaaatgctgtcaaaaatgttaatttttccaaaattgatttatagatacaatgcaatactaataaaaatccaagcaggcttttttgtatatattcatagattgattataaaatttatacagaaagccaatagttctagaatagacaagcaattttgaaaaagaagtgcaaagttggagggctcacaaaacctgatttcaagacttaactatgaagctacagtaatgaagacagtgaggcgtttgcttaacaatacaccgatagttcaatggagcagagtagaaggtccagaaacaggcccttacatatatagtcaattaatttttgagaaatgtggcaaagtaattcaatggagacaaaagtattttcaacaaattgtgctggaacaattgggcatctatatgtctaactatatctccatcatattgattttattcataattatcacaaactgaaaacaatctaagtctcaaatggtaaatggataaactatgaaatactattctataataaaaaggaatgaactactgatacaagtaacaacataattgaatcccaaatatattatggttaagtgaacagaaccagactcaaaaggctacttgctttgtgacattttagaaaaggaagaaaacaaataggtcaatggttaccatgggttggtgggtggggaaggggttcactataacaaggcccaaggaaattttaggggaagatagacccattctgtatcttaattgtggtgatggttacacaactggatgcaagtgtccaaattcagaactatacatacacatttaagtgtccatcaacagatgaatggataaggaaaatgtgatatatatgcacaatggaatattattcagccataaaaaataatgagatcctgtcatttgcaacaaaatgggtgaaactggaggtcattgtgttaagtgaaataagccaggcacagaaagacaaatgtctcatgttctcactcttttgtgggagctaaaatttaaaacaattgaactggagatagatggtagaaggatggttaccaggggctgggaaggggaatagagaagtgggaggaagtgaggatggttaatgggaagggaatgttggttaccagagtttgggaaggggagtagggaagtgggatggaagtgaggatggttaatgggaagggaatgttggttaccagagtttgggaaggggagtagggaagtgggatggaagtgaggatggttaatacaaaaggatagttagaaagaatgaataagaattagtatttgacagcacaacagaaagactatagccaatacttaattgtacattttaaaataactaaaagagtataattggattgttttgtaacaaaaagaataaatgcttgaggtgatgtattccccatttgccctgatgtgattactatgcattgcatgtgtgtatcaaaatatctcatgtaccccattaatatatacacctactgtgtacccacagaaattaaaaatttaaaaaacaactgtacatgaaaagaatgagttgtactgtaactaaattacatctcaatacatttaaaaagaatttaagaaagcgttcttttagtactttcatgatctcagcaactacatgagcactgcacttaagcccttaattaactttcacaattcctttgaacttgttggaggtgtccatttgctaatgattagtttgttcatactcatttgactctgatctgcaaggataaaatatgaaaattattctctccctctcattcttttcttttccttccctctgatttcctctctccttctcattgtctctccctctttctttaccagtaaaagtatacctctatatgttgctggcagtaaggcatggagatggatttatgtcacctttgacaaaggcgctttttgtgaactagattctatggagctgcaaggccatattggcattgaaaactctaggatgagctttaattaatcaagtatctgcttctgttagccccataatgcatatggagatttccagatctttcttagaatgctggcaaaggctgccctatttcctctggcaagccacttcttgaatttctattatacaaaatgtggaaattggaggcagccctgggcatcaagggtgtggctatgcaactgtgatcttggggagtagcgtttgaaatcagagaaaccttatattagatggatcaaggagggagccaggagattgatatcctcagaaggtgttacatgtttctcttggaattgcagttgctcaaatttctctctttctcaattttttttggcaatgaacatttttaaacttttacaaaactagacagaatagtttggttgacccctgtaaccatcatccatattcaaaaactatcagtttatgactaaccttgtttcagcaataccctcagtaaccccttgccttagtcattttgaagcaaattccagacatatcatttcttctgcaaatatctcactatttatctcaaaaatataaatattctattttaaaaataaccataattctaccttagaaagtaacaataaatttcttgatatcattaaatattagtattcaaatttccaattcttttataaatgattttattttgttatgttttgtttgcataaatgtgtttaaaaacagtttgcttgaatcaggatccaaacaaggtctacacatttcaattcagttgctatctcttatgcctttttaaatctgtttcccctctatttcttttttaaaataaactttatattttagaatagttctagatctatagcaaagaaagttagtacagcaatttctcatataccccatacccagtttccccactattaacatctacattggtatggtgcatttattataatgaatgaagcaatataaatacattattaactgaagtccatactttattcagatttccttagtttttactaacatcctttttctgttcccatctaggacaccacattacatttagtcatcatgtctccttcggctcctcttgcctatgacagtttctcagagtttctttgtttttgatgaacttggaggctttgagaagtactgatcacgtattttgtagaatgtccctaaatagggctttgtctgatatttttctcgtgattatagtagggataggggttttggagaggaatcttgcagaggtgaagtgccgttcctatcacactgtatcaagaatacgtactattgacatgacttatggttgacattggccctgtttgtctgaggtagtttgtcaggtttctccactgtaaagttactcctttctcaccttcctcatactgtagtctctggaatgaagtcgctctgtgaagcccacatttagagtgaagagttatgagccacctccttgagggtgtaatatttgcataagttatttggaattcttttgcacagaagatttttctcttctccctcatttatttatttattcaatagtctatatatatggggactcatgggtatttattctttgggttataatccactattattttattttgttgctcaaattattcctgattatatgctaactcatgtatatatacatatcaatattttcatatgtaacatctgtatctacgttaagtttaatatgaatttatgctactatctccaactctaataaattaccacaaagataattttagcctccacccttgcttatctctaaatttccaatctcaaatttctcaacagtgaaaaacttggctcctaccatccaccatccaattgcttaattgtccaattccagtatacatgcatgacagtatccgaattgttaacccatggcaataactttatcaagcagaatacagtgcttatgtgcaattctttttgtttttagtcttacagactccatttatttccaaaattacttaagtaagttggcacttaagttgaacatacacctatcatatgacccatccattccattcctagctacttacccaaaggaaatgaaatcatatttccatacaaagacttacaaacaagtgcttatagagcctttatttgtagcagcccaaaccaaaaacaacccaaaatgtctatctacaggtgaatggatgagcaaatttgatttttccaaacaaatactaattagcaacaaaaagaaatgaggtgttaatatgtgcaacaatatggatgaatctgaaaattattatgctgagtaaaagaagccagatacaaaagagcaaatactgaaaaaaaaagagtacatactgtatgagttcatttatgttaaattttaggaaatgtaaatgataatgacagaaagctgatcagtgattgcctgggaatcaagaggtttggaagagtggcaggagggagcaactataaagacacaaactttggaggatgatggatatgttcactcgcttgattgtgaggatgttttcatggataaaatcatatgcaaaagttatccaattgcatggtttaaatatgtacagcttatgtccattttaccccaataaaaaagtctgtgcttcctatcctttactgattcactctagagcagcttctcaaactttaatgtacacatgaagaaggtacaattctctctcccctgagagctgtgttaaaatgcagattctgattgctatgcctaggaagtgacctgagattctgcatttgtaacaagcacctagatggtgccattgctgctggtctgaggggtcacactttgggtagcaggtgtggtggttcatatactccatatataagaatctcagctcctctacaaataacattctaactttgggaaattttctttccctcttgagtctttatttgtttatctgctaaatggatacaataaagatatttttttccagtttgttcttaaattaggaaataatgcaaaggaagatcaataatcaaccccccttcaataatcaaagtataagaatacatagttctccatttgcttggtagatcttcctccatccctttattttgagcctatgtgtgtctgtgcatgtgagatgcatttcctgaatacagcacactgatgggtcttgactctttatccaatttgccagtctgtgtcttttaattggagcatttagcccatttacatttaaggttaatattgttatatgtgaatttgatcctgtcattatgatgttagctgtttattttgctccttagttgatgcagtttcttcctagcatcgatggtctttacaatttggcatgtttttgcagtggcttgtaccggttgttcctttccatgtttagtgcttccttcaggagctcttgtagggcagtcctggtggtgacaaaatctcttagcatttgtttgtctgtaaagtattttatttctccttcatttatgaagcttagtttggctggatatgaaattctgggttgagaattcttttcttttagaatgttgaatattggtccccactctcttctggcttgtagagtttcttctgagagatcagctgttagtccattgggcttccctttgtgggtaacctaacctttctctctggctccccttaacattttttccttcatttcaactttggtgaatctgacaattatgtgtcttggagttgctcttctcgaggagtatgtttgtggcattctctgtatttcctgaatttgaatgttggcctgtcttgctaggttggggaagttctcctggataatatcctgcagagtgttttccaccttggttccattctccctgtcactttcaggtacaccaatcagatgtagatttggtcttttcacatagtcccatatttcttggaggctttgttcgtttctttttattcttctttctctaaactttttgcttcatttcattcatttcatcttcagtcactgataccctttcttccagctgatcgaatcggctatggaagcttgtgcattcgtcacattgttctcgtgccatggttttcacctccgtcaggtcatttaaggccttctctacattggttattgtagttaaccatttgtctaatattttttaaaggtttttaacttttttgcaatgggttcaaacttcctcctttagctcagagaagtttaatcatctgaagccttcttctatcaacacgtcaaagtcattctccatccagctttgttccattgctggtgaggagctgcgttcctttggaggaggataggcactctgatttttagaattttcagtttttctgctctgttttttccccatctttgtggttttatctacctttggtctttgatgatggtgatgtacagatggggtttcgctgtggatgtcctttctgtttgttggtgttctttctaacagtcaggaccctcagctgcaggtctgttggagtttgctggaggtccactgctggagtttgcctgggtatcagcagcggaagctgcagaacagcaagcattgccgaacagcaaatgttgctgtctgatcgttcctctggaaatttcatatgcacccaatacaggagcacccagattcataaagaaagtccttagacacctgcaaagagacttagactcccacacaataataatgggagactttaacaccccactgtcaacattagacagatcaacgagacagaaagttaacaaggaatccaggacttgaactcagctctgcaccaagccaacctaatagacatctacagaactctccaccccaaatcaacagagtatacattcttctaagcaccacatcgcacttattccaaaattgaccacatagttggaagtaaagcactcctcagcaaatgtaaaagaacagaaattataacaaactgtctctcagaccacggcgcaatcaaactagaactcaggattaagaaactcactcaaaaccgctcaactacatggaaaccaaacaatctgctcctgaatgactactgggtacataacaaaatgaaagcagaaataaagatgttctttgaaaccaacgagaacaaagacacaacataccagaatctctgggacacatttaaagcagtgtgtagagggaaatttatagcactaaatgcccacgagagaaagcaggaaagatctaaaactgacaccctaacatcacaattaaaagaactagagaagcaagagcaaacaaattcaaaagctagcagaaggcaagaaataactaagatcagagcagaactgaaggagatagagacacagaaaacccttcaaaaaatcaatgaatccaggagctggttttttgaaaggatcaacaaaattgacagactgctagcaagactaatacagaagaaaagagagaagaatcaaatagatgcaataaaaaatgataaaggggagatcaccaccaatcccacagaaatataaactatcatcagagaatactataaacacctctacacaaataaactagaaaatctagaagaaatggataaattcctcaacacatacaccctccaaagactaaacgaggaagaagtcgaatccctgaatagaccaataacaggctctgaaattgaggcaataattaatagcctaccaaccaaaaaaaaagtccaggaccagaaggattcacagccaaattctaccagaggtataaggaggagctggtaccattccttctgaaactattccaatcaatagaaaaagagggaatcctccctaactcattttatgaggccagaatcatcctgataccaaagcctggcagagacacaacaaacaaagagaattttagaccaatatccctgatgaacatcgatgcaaaaatcctcaataaaatactggcaaactgaatccagtagcacgtcaaaaagcttatccaccatgatcaagggggcttcatccctgggatgcaaggctggttcaccatacagaaatcaataaacgtaatccatcatataaacagaaccaaagacaaaaaccacaggattatctcaatagatgcagaaaaggcctttgacgaaattcaacagcccttcatgttaaaaactctcaataaattaggtattgatgggacgtatctcaaaatactaagagctatttatgacaaacccacagccaatatcatactgaatgggcaaaaactggaagcattccctttgaaaactggcacaagacagggatgccctctctcactactcctattcaacatagtgttggaagttctggccagggcaatcaggcaggagaaagaaataaaggtattcagttaggaaaagaggaagtcaaattgtgcctatttgcagatgacatgattgtatatctagaaaacc

SEQ ID NO: 4333 - DNA, 949 bp, Homo sapiens
gctcaccgtccgccggctgctggaagttcacatacgcgtagcccaaggagcggcgggtgatcatgtccctgcagacccggatggagaggatgggcccggccgggctgaacttctcgtagagcatcgcctcggtcacgtcggggtggaggtcccccacgtagagcgaggccatggggtagctgggggcactggggttcatctcggcacggctgcccgcagggccacaggccgcgacctttccgtgagaggaggagagcgagtgccggggctgggggccggagccggggggaggggagcggggagcaagcgcagagggacaaaaatcaaccggaattgaaaactactcaacggccgcagaacggggtcgatccactgccgctggctgccggctgccggcggggagcgagggtggcggtgtcgggtccgggcagcgggaaggcctcggtctcttggttccttcttggagctgctgcggggccgcgggcgggcgggtcggtctcggctgcttcaccgggttattttataaaagaggaagaaaaaaaataaaagtctccggcgggggagacgcggattttttgtaaatttttttggggttttttaaaagatttttttagattttttttggattttttaataataaatgtgtgttccgagcccggagcacacactccgcactctcagcactaaccgccggggagaaggggaagcaccgcctcctgcaccctctacttataccccgcgccgcactcgccccgcccccgcgcgtctgacgccagggcccctacgcgagcgtcagcgccggagtaggaggagacgcggaggccagggggaggagggaagagaaaacaggaggaaagagcagagaggaagggagagcctctcaagagaaaaatggagaagctgaaagccattcccatctaagaactcagaggtgtcagttgtttgcctg

SEQ ID NO: 4334 - DNA, 346 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggtgtgattcactttcggccctgggaccaaagtggatatcaaacgtaagtacatctgtctcaatta

SEQ ID NO: 4335 - DNA, 7358 bp, Homo sapiens
gtaacctcgcggcgggcgtgcagaccggacgccctcccgcttcttctaccgactgctaggcacaccagtgggttcattttgaaagaggcccttgcaccgggctttgcaaggaagccggcaaggttagattgaaggttagaagccaattagactagaatcctgcgatctggtgagactgccgccttaaaatgcaccaaacagtttttgaacctggagggctaacaggcgggaaaaacatctgcaagactgccaccgtgtatttttctcaagtaacaggctatccacagttttggaattccttagtgaaactgtcacacaggcacaaacacatgtcagctttccttctagtttgtaaataatatttgtaatttacaggccactgtattcccaactttgcaccatgtgatttagagaaagcaaagctccctctttaaaaataatatgttacttctgaaataccgggatattccacggcaagtaagccatattgtcgccagagcaaataaaccgcagccccatatcataattcactgggtgctataagatgtaacttggctttgctttgaatggaaagaatcctgaacgtctgtgatgtgatgaagttttggagactgggggcaggatttcctttgaatgtaaggaattcggataacttgttcaaggatgattctagtgaaaaacgtttgtcccatgtttgttgggacaaaaatgctggatatggtacaacattcttcctgcaggttcggttttgttgaagagagtgaggccagctcgaggtgaaggaaaaacatcagaaaggtgctaaagtgcagaaatatcttccagaggcactaatagccgactttagttcttgacctttagctagatccacaaagcactgagttaaaattgtacactgatcccttccagaacaaattaattaattaaatggtgcctcttcccagcgttaatcgtttaaaaggactcaagtacccacacagtttaagcaaactaaaagaacactgacactttctcagagaacagggatgggaactttctatctgcccattagtatctaccccaagctacgaagacttccattcctcttattaagcattcagcaactacatttagtgcctactatgccagtgatgcaagaatggataagacagtccctacactcaaggataacgcctctagtaggtgagagacaaaccgattaattctgcataagggataagtgctgtatgtgggaagcaatccaatgagggctctgaggatggcaaaggaagggttcctggaggatttacatttaactggtgccttgaaaggtgtgtagaagttggcaagatcaaaagggagtagagtccaggtggagaagagaaaagagcagggcaggctggatggcatggctcacacctgtaatcccagcactttgggaggccatggagggaggattgaggccaggagtttgagaccagcctgggtgacattaaaagaccctgtctcaaagaaaacgaaaggagcagggtatatacaaggggtctgccagccttctcagcctttctgtgagaagcgagggtagggtagtacaggagagtggcaggagatgacactaaaagtaggtctgtgttgatctaacgagtctcaactttactgccaaaactaatgaactaggaaagtttaggcagcaagggccagagatggagtctggacttgtattgcagaaagttcctgtgacggcagcttggagggtgaatgagagtgtgggatggaggggtgaatgggtgtggacagactggaaaaatgactcatgcagggaatgaggaagggaggagccttgggagactctcaaatccctggcttagcctactgaattgcttgctacttgcctttttatgtcttcattttgcctcccattgtctgtgatattaaaggcctaacttcttagtagagcaaactttgcatctgctagcaggttggtgccctagctagcttccatgcccctctgcttagaatgcctgcgaaccactaaggactaatcctagtggtagaaatttattttcaattgttctcaaacccttgtagaattccaagttagaactgtagtgttcttttttcatgtgggttagaaaatttgctgtttggagcaacatggtgaaacacaggacttttgaacctgcttatggtgcaaaaggggaaattatatttctacttcaacactggaggaggggggacttctgggagcaaaagagaaatggaaactgagatgagacatgttttttactccatgacagaatacaaagaaatacaaggatgatcctttaatgttagaaacagtagaataaccatcctggtaaataaaaaaggagaaaaaatgttattttacattagatacagaaaaacagaatggctaagaaaactcacaaagcaatggtcaatctataactcgagtccaaataaattgtgatataacactaaattaccactgatttggcctaattgactatcactggataacattataacatgaatgataatatttaaaattttaaagcactgtaacaaacaccagatcatgttaaaactattcaatcatgttgtcagctttcaactgccagtagcatcctaaccacatttcaaactatggaaattactaaaaaatcattattgtaataaaaagttaatagttcctcatttagaataccattgatattccctcagtgccaggagaacattatggtttctcctatttctgtgaagtgtatagtctacaggttcataagtgagtatatccatgagtataaaaagaaggtcatttatgggtggagagggaaattatagaaaacaatttcagatgaaataaactacattttcagataaaggaaagagtgttcactgcaggttcctgaaatatttcagtccattcaagttttaattataccaatgaatctcaataaaaatacagttaaggaatatggtttttatagataatgtcagctccttgtttaccaataataaagataaagataatggcagcatttatctttttcagtccaatggggatatttaaggtacctatgtaagtgtgtgagtgcctgtgtgaattgtgacttacttcttctgcataccacattcatagctcaataagctctcactgcctctgcaatataacttgtctttcctgacacacacacacacacacacacacacacacacacactctcacacaaacaaatcacctaaataaaaatatctcaaggaggtatactcttttaaaatgctatttttattataccaggataaaaataattgattgaaagatggtgtcaaaaccagaacctagtctcatgtcctgtgcttcctaatcaatatttaaatatagatggtcaagagaagatgactctaaaaggcaatcaaaagttgcaaacattcttgtatggagaatcaagtttaagtagatgcattaaatttatcacattaaacttcacaacagggttgaggagagaggtgagaccttcttttgtagaattcaaacttgttcagatatttgaatacatatacttgagagaaagaattacatgaatttagtttatcttcaaggacctttatatatttcatacacaacacaatttgtaatggaagctggagagttggcccttgaccaaagccttgcagctaacaagaggacaagcctcctgccccacagtgtttcacagccagtaccccaagctcctgaattcatctgtctaatgtgtaatatatttataaacactctacctgggatgtatgcgtaccttctactatggactgttgttaaagacaagtaaatatgcaatcgtggtctttcaataaactaaacggatataaaaataaatatagaatacagccagaagatcaaaattgacatattatctatttatgcttataatatgtaattacatgtaatattgtaaaacactttctaccatttcataaaattctgtgttgttatttagcccagaattcccttgcaatcttttaaaaatagtatctaatagggcttttaatataaatgtcgtagtgaaactgttttatgtactgtaacccaaacatttctacgtagtaacactgttccatatagaaaacaaatatgaaaaaatatggccattgtcttatttatttctaaaggtaaaccaatctttgacaatgccaatagcagtgtcaatgttcctaaatgttggctgtatctatctacttactcattgtattcttgaggttcctttcctttggtttctatgatattccacatccctctcttttcattccattgtgtgagttctctctgtggatcttttgttagctcctcttattccttcttgcctatctgagtttcctgaaattaccttcaaatcatgtctcgaaagatgttctaaagagacctttgaataagaacaacatttgtcccattaataaatggtgggagtttcatatatctgtttctttttctcttctttcctctttgccttgtccaaaagagtgggaactgagcagtacagtcataaattaattttaatatattaacttaggcatcagtacactggctattgttccttaatacatttaacacatagtcattgactgctgattatgtgccaagggctgtgcttggcactggggataaagaagttattaagtcttttgcaaggtgttcatagtctagcggttggggacagacgtgagggaaaaatcacagttggaaaagagcgtagcaaatgaaaccattcagttaaattcaacaaaccctgcgtgcttaccatgtgccaagcagatggcaaggaggataggactgggcaaggccttgctcctcacggactcccaagcagctggcaaatggtaaaactacctgatacttgttaagagcttcatggcagaaagaaagtcagaaaaaaagtcatgaaaggctattggacagacaagaggcttgatcagaaaaacacttttaacaaatattgtcctagcaacatgaggagaaagtttgttgttcagatttttcatgctgtcattatggaaagcttactacatgtcaggtttctttcctagaggctgaggcttccttggcttgcctcagtgaatcccaaactggccttgcaactctctctctttgcctcccctaggctttcggtaacaaatcctcaactaggtgataggagattatctgattaaagtcattcacactaaggcgagaatgaggcttaatccctcaagagcgtttgctttaacaaaggatagcttgttaaccctaatgaactgctcattggaagaactctgcagaaggatccctcctcctcaccttcccagacttgccaaccccatgtccttcctttttatttgtctttcatgaagcaaaggagtaatgaaagtgttaaggactctaaggtcacacattatctccttgaacttaaaacaagaggtatgtgaggtaattatgaccccatgctcataatgaggagactgaaactagggcggtggttcttaaccctgactacattttggataggccggctgcaactcagacaaattaaatcaaaatttctgggaggggcatccaagcgtctgtatcttttttaagccccttagatgatttcaaagcgcagccaaggttgccagcttcttgcctaaactctgcaagaagctagagtttaggaaatggaaattaaccagaataggtagcaatccattgacctgttccattttttcctttggcaagtaaagtttatttggctcaatagaaacagaattatctgcaggaaactcgatctcatatagaattagatttgggtaggctggtgcccatatgcatctagaaatgagggagttaggactagctgtggatagctaaactggtggtgcaaggtggtacattttgtcatgcacatgcttggaagtggtgcttcttaggcaaccaaaatatgtttcactttatgccgggtaagcattagtggtccataggattaaaaacagataagacaaagagttaagatcacacaaaggagaatcctacatattctaaaatgcttagtttgctgtttgtttaaaattctataccctgtctcttgctaagaaattgtgattataagcacccccttgagagtgacatcagagcctctgagagataaagtgtgtccttggccacttccttttgaagatatacatatcttcaccagttacatactcatacatgtaattatgtgtattcaacaaaagctattctgtacattcaatatattttataaattcgttcaataaattaacatagttaaattataaacacaaacaagttagcagaacatacctcacttgaaactcatttgaagataatgctagacatcttagtttatggccttcgtgaatgtgccgtcagtccagttgaccctcctggccccacctggatggatctgaatgcccatgtttctgcaatgggcttagcaatgagtaactgctgacagggcctgattccatcgagccctcccagtaatgaatgtgtttttagacaatgtggagcattcttttcctttttcaaacttttctggccataggtcaccagctcaccagttactgctgcattttcattctaaaccttattgctatcaactttcctatccagtctacaatagtcactgagcacctggcataattccagtctttcctagagtctgaggctacatggtaagaaaaactagacctgaagcctcttgaaatatgcagtataacaaggacaatgaatatgaaatggtaaataattatgatcaactaagtaaataatataaatgtgcaaaatttagtgaatgagaaaaatgagagtgtgtatctggtgaatctaaacagataaacaattataattattttattgctctctcccttttttattgaattcaaatgtctcacattatagttgaaagtcttcacagtatttgtactacatgtgcacattgaattcttcttcatttgtaaggacagaattctattactagttgcatgaaatagtgactatttgtgttaagtggcaaggtgtccatcacatagcctctaaaggcagggtcggaagaaatctctgactgatcattagtactatgctcttgctgttgcagtctttggtgttactgtcattcacttcctgggcttaatcttttaagggtatgatatctacagacaaagctagccagcttatctttgataacttcaagaagtacagcatgtcggcttttggattaatatttgaaaataaaataaaaatttaattttattatcacttgttttgtcaaaaatcaaaggctcttttaaaatcttttttggctggatgtaaaatgatttttttctgtttctggatataaggtaac

SEQ ID NO: 4336 - DNA, 5685 bp, Homo sapiens
acaccagacagtagacagagaacaagaggaagcagattccagaagcagcagctgagatccacttctagaggctgcccgcattctttggctcatggccctcttccatcttcgcaggagtaatagtgagtccttctcagatcacctcactctgactctcccgcctccctcttccatttctaaaaacacttctgacggcatgaggcccacctggacaatgtaggatgatctccacatctcaagataacatcagaggagcaaaaacaaaatctccccggctcacttctccgccattatgtaagtagaaattgcaagacttgaaagagatataacatatacttaaaataccattttgattacagaagaggtagttcaggaagctaaacccctatatttaacagtgattctcaggggtgaggagaatttgatagcatttcttaaaggcatgagtgattagtaataaaaatgtgcatgtaaaattgcctctgatttttagccagcagaagaaaaaagcagacatctaggaaggatatcatgtgcgtatcatgtacatcgtatcttgtaaaaaagaaagtctaaatacttggaagtgccaggtgacaatccagatagctgagttgttaccatgcttttcaatttggctttaggaaaataatgacatgttcatgcaatagcagctactacattttaagtggacacataaataaaaataaatttatagcagcttatcaaatgcaattctttttaaaaataacaaagtatacggctagagataaaaacagtaagcaaacatattatgcaaattatttttaaatctgtttaaatgaatcattgagaaagtgttaaaatacaaagatgaatagcactatggattatgaatcatgtggaatatttattgttacacagtaacatatgaattcggtaatattgacctaataaagcccagatagcatttacattagaatctgcaaataaatagcttgttaattcacattatcttcagaaaatgggtttgatttctattaaccttgactcttgtcaagcagttaatatgacagaagaaataacaaatgctcttttaccattaagctatagcaagaagacctctatttccagtatttagaaccatttcacggactgttaggggaatcgaaagatcaccccgccatagatcttcagtttgctcattatggatgaaataaatatacaatccaaatttaacttcactttcaaaggcatataagatggcctccctacttgtcctgcctatttaaaaaatttttatgacggtaaataaaccctggaaaattccttctcagattttaccgcctgaaactgcagctgttggctgccactatcacagtctcacaactacaaactcacgtgcaaacctcatcaagggcagacatttctaattgattccagaagtatgtttttttttttttttccttagatcagggtgcaaaggaagaataatgagcagcttttcagagggaactgggcgtttgggtgttcaggggagggggtggtgcttttaaaatctcaggcttggccagaaatgcgtggcaattttacggtcaattggcgggagcatctggaaccagacattctggccttgagttgatggtagggaaaccagcttacaggcaacagcaagcccataatgagtccctgtcatgtactagtggaaaccacgttgacggtctgccaaatatccatgcgcctttttctcagcgacaggattctccttagagccattatctagtatctgaaatctgtccacttacagatcttcacctgttttcgctattaaagacaatgcaaaaacaaaagctaaaaattagaacgtgtatgtgtttaattccttgtgtgctgacatggctctatatcataagattgtgtttactttcatttggggcatatatttcaaacgcagcggccatcttgttactgcatggggagtgtcggatgcgcaggtcataaatcatagcactgcgcacggcacactcagacgaaaggaggtgaaacgcaggccctttgttatttcaaatgtaggacaggtgattatttttaaaaaggtgggaagggggcagggttcttttttaaatgtccagcagaaaaccaagggtggaaataacttcttaggagtaaatgatgtttactttaagctgctgctcgtaattcaccacgctgacgttggtagattacatccacgaataagtcatgtaataataggacagccatgaaaaatgtagagatgtgtcaacagggtggaaactggttccttggtgaagaacaagccatgcagaaagctggatttctaacattctcaaatctctttttatccaaacaatctaattaatggggattgtattcatgttataactcactcaaaattcctaggcttatgatgttaaactaaattcaacatgtttgctcttagttgatctactcttggggggaatccctgcctgttttcagaccaaagtaaaacaagcacaaaagcaagactaaatgaaacaaaactactcaactaaaagaaaaaagaaatgtatttaaaatacttttttaaaaaactcagtattttttggacgtgaaatttttccgaaaacacctatgttctgatgattgcagtatgtgtgaatcagaaatatatattagtgttgctcaaaatagacataatattaaaatacattaaactgacagtgaacaaatagtagaaaatgacatctacttgaacaaagtattatttgcaaaagcaactgcacttgttggatgcctgtgttggtactttaaaaataacagcatatgggagaagggacaggtgagtaagaatataagctatatttgtgtcttttaattgccttaataaagatgatgcatagaaaactatcatgtattattctcttaggtgtggattcagtattttaaaaacccatacaaagccaatacattttggaaaatttcatgtgatagtttgcaatttactgtgtcaaaactagtcttttataaagcagagaagcaatactatgttctaatattgcttaattttacttccaagtattttgttgttcatggaaagaaaaagtgaccatttttagaaggaatacaggaagaggacaatgtttttttaaaggagaccacaaataaatcaccccaaatggcttattttcaccttcaacttagccccacaactcagtccatcagttattttctatgtaccattacagaacagtaaaaaatgtgtacatgatagatgtatatcacgaatgagataaatatatatacgtgtatacacgcgtgtatatacgtacgcgtgtatatacacgcgtgtatatagacgtgtgtatatagacgtgtgtatacacgtgtgtgtatacacgtgtgtgtacacacgtgtgtgtatacacacacgtgtgtgtatacacacgtgtgtgtatacacacgtgtgtgtatacacacgtgtgtatatacacacgtgtatatatatatatatatatatatatatatatatatatatatatagctcccctcataggacctgcaacagtaaacatttgttaattgcatgtgatggaatgatacatcttgagaaagactatacccttatattctaaaaatattcataagggtggtaagtgaaagaaaacaattttttaagtggcgggatactcaaattgagttagaagttaagaaagaagaagaaatgcaaagctttattatattaacacaaaaatatcaaagaggatctgctaataaccccagtgtttacgttttacgctattccctgaattttttctcgtaattcacgagaatttgttttctaaaaataaaaatatattatatcctataaaatatattctcatatgttacataaaggtaattttcaaatatgttaatttatagcatataaaagggatacaatctgggactatgctaggatgaagtggcttatgctcacttatacatggctaatgaacaggtaaaatgataaatatttggcctattgaagagaagattcctgcactcactaacatagtaccatggacatagattttccaatgtttcagaaattttgatatgatgtagggtgaatttgggattaattttaaatgtgagtatcctcccctatacaagaatagagaaaaatcatcatctgtgcacttaaaattaaaacagtaaatcttgctaaagaagccaatattggctgggcacggtggctcacgtctataattccagcactatgggaggccgagacgggcggatcacaaggtcaggagatcgagaccatcctggctaacacggtgaaacgctgtctctactaaaaatacaaaaaaattagccaagcatggtggcggatgcctgtagtcccagctactcgggaggctgaggaaggagaacagcgtgaacctgggaggtggagcttgcagtgagcccagatcatgccactgcacactccagcctggacaactgagtgagactctgtctcaaaaaaaaaaaaaaaaaaaagaaggtaagatcatggaattaattcaaattatgtattagcttaatatttttgcataattatagcctgtattcataaccctccccaggagttgtacaaatggaaactggttgttagaggaggaattgtagctggatatatcagcactatatggaaaaaattgatgtctatctgaattaataataatggatggtataatagtaccatcttcatacataaaggggagtattgtattatatggaattattctgtggaaataaaaaccatttgcgtgcagtccaggggtgatgagacaaactacaacctgggagaagatactttcaataaacataaatgacaaaggactgatattataatcatacacagaatttctaaaaatcaagaaaaagaaaacaatgggtaaaaggtacaaaaaaatcacagaaaaggaaacacaaattccttcaaacataatgatccacccacttcaatagtaaacagaaaatagtaattagaaatacaatcagatactacttaatttcccaaatggacaataggttagaaatctgacaattacaacttcggtgaggaaaggtccactgatagaaggacattttataatcacttggaaaacaacttggcatcagctaaagaatttaaacaagcacatttgctacaatccagcaattcccatctagatgtataaactagagaaactctacatacatgcaatgtgcactagatgtgtagatgaatttttattgcagcattgcaatagaaaaaaatagaaacaaacactagagaatagacagatatgtatagtcaacagtgaaccaatttacaggaatagaaatggatacaagtacaggcaacaaaaagaatacattttaaaaataaacatttttgcagaaattttatatagcataggaaactatatataagaaaccatatatagtatataagataccattttattgtactcacaaattttaaaaaatgaaataatatattgcttaatgataccttgaagaaaatctgaaaaattaaaatcatggaaatgataagcacaaagtacaaaataactgttctatctgtggaaatatgagtggtatcacacagacagcagataatacagtgttattaatacttgactggtattatataattttatttagaatggtgtttattttatcttttataaa

SEQ ID NO: 4337 - DNA, 6599 bp, Homo sapiens
agaaggagtgcggtccactggaggtctccctacattcttcctccattatctcactgcctccggtggctgctgggataccggaggactcgggtcccggctcgactcagtcctccagccgcccggggaatacctctagttcttcccggccgccgccgcctccgccccgccgcttcctcctccgcctgccggcctccttcgccccgccccgtccgcgcagctcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaagtctcgctctgtcgctcaggctggagtgcaatggcgcgatctcggctcactgcaagctccgcctcctgggttcactccattctcctgcctcagcctccggagtagctgggactacaggcacccgccaccgcgcccagctaattttttttttttttagtagagacgcggtttcaccgtgttagccaggatggtctcgatctcctgacctcgtgatccgctcgtctcggcttcccaaagtgctgagattacaggcttgcaggcgtgagccaccgcgcccggccgagttaaagtactttttctggaacaaagaaacttagcataaatagttaaaatattaagagttgtaattaagggaaatttcagctcaatatgacttcaacagtttaaaaaatgtattatttcacataagaccatggagagaggaattggaagccccagaattgattgggtcagaaattgaaaatgatactatcagtgacccaggtttgaatgtctctctccacagcattgacttcactaatggatgtgacctggttggcagcagtagcttgcacaacatgcttgtttgcagtgagtagtagagagaaggttttgctttcccagaaactctgaaaaaggtcatcaaacctaaatttccttagccttcttcttccatgagcaaatcactagcagatgattgctagcaaggtgttactattacaatgaacccctaagtgtcagagaaagagttagtttggggaaatatcctctccaccacaatcttagtcattgaagtcaatttaacaatatattgaaatatttttcttagaagtttaaagttccattaaagagtaacaattacagaaattataggtagcctttagttctacaagtgacatctcaaaagggagatgattcatcaatttcaaactttccctgcaagtaatactggatgaaaattaacttggccaacataattaataatcatgggttattaattacttctgcaagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatgctcatatgacattaacagacaagacacttttcagaaagacagaaactactctgaaaaactctcttaatgctttttacggccgggtgcggtggctggagcctgtaatccaagcactttgggaggccgaggtgggtggatcacctgagatctggagttcgagaccagcctggccaacaaggtgaaaccccacctctattaaaaatacaaaaattagctgggtgtggtggcacacacctgtactcccagctacttgagaggttgaggcaggagaatcgcttgaactcgggagacggaggttgcagtgagccaatattgcgccattgcactccagcctgggcaacaagagcgaaattccatctcaaaaaataaataaataaataaataaataaataaataaataaataaatattaaaaaaatagtttttactttatttctcccaaaatatgtcaaaaatgggataatggcacacttgctttttctgtagtcaaaaccattttgtaaaaaaacttgaaatgtacagtgtagaatccaagggcagaaaataaaggctgaacatagaactaagaacctgtccaacatcaaggcagtggctttttatcaatttctctcactccagggcaacatttattttcttactcttgtactctttgtatctccattgcttgcctgtggatcaataatattattctttataacattatggaggctatatggctttgtgcatccagtatgcatcattattataaccttcatctcaattagaattctcaagtgaaagaggcttattgatttccaaccaataaatggataacttccacctaaatcaagcgttcattcattgtccaatccactggaccaggtgggcttgaatcatacatggaagcaaacttcctaacatgctgaatgggttggctctcatagaaggtattcttgagtgggcaggtttccttacaaaacatagtatactaagactgtggtattcagacagctcttcaatcttcaagggaactgtggaagtaaaccaggggtgacatggattatcaaatattgtggatcaggtgagctctaggcttctcaatgcaaggtaattaccctgcactttcatctattttataatattgcctttatttttttccatgaaagagtaaggtttggaaaaacaagaaaaacacggttaaaattatttctctagtgaattggttgtgtttataaatctttagcttagcttgagtccccctttgtgaaatgtataaatccttttgatacattaacaaacacttggaaaatgacttaacttattaagttgaattctctaatataagggttataagtgagggcttaattattcagcattactgaattcaatatatctgccctttcagtttgcctagggtgacaaatacatttcccattacagcttgccaatgtaacacagccttatttcatttttgttgtaaatagaatcacattctaatatgttttagctgaaaacagcaaagtatatattcaactacttcccaatagggaaaattttttaaaaaagttatttctttagcccagagctttattttccttttacataacagaaaaatacttggtgtgaaataaaaccttcttacacgtaatgagaccccatagaattttaatgaaagacaattgaagacccatttttaaataagccattgggaagaattaatataattaagaatagaaaaaaactagataaagttacaagaacaacctaggaacatttctatatttcttcctcattttctggagttctaaaagatgttgaaacattttgacagctatagaaaatgacctagggacaaatatactctctattcctgacataaaatgatatgcttattgtgtttctcataaaactcagcataaaactatatacctaatagttatttaaaaggagttcctaaaaataaatatattcattattaatatgtgacatgactgagttacttttgaaaaactacgaattattcaacatactttaacataggatttagtatcaatatggtatccatttcttgattctgtttttcatagtgcacttaaatatatatgttaatacttttgaataagtgcattatgctatgaaatgttttaatgagaaaaatgaatctatacaaagcaacttcatttatattttgttcctgtcacgttacattgctgatattttgtattatactagacatgactcatttttaaatatgtaattgtatatgaagttctcagtgttaatgtctggaggatacggaataaaaacagaagaaaagttaaaaaattaaaagtaaactatattttgcatatgaataagaatattacaaataccatatttatatactatgtttatatatctttacactatgccaaaaggtatatatggcatatatgcatatataccttttttatgcagagaaataatatctctgcataagcataaaatcaagatacataatattttaaaatgtttttcattgaagtgtaattgacataaactgaacatatccagtgtatttttaaagttttggcatattggtacacgagaaaacaccatggcaatcaagatcatgaacatattcacttccctgaagttattttgtgtctttagtaatcgcttcttcccctcttccctactcaatctccatgcaactactaatctatttctgatactacagaatggtttacacttggtagaattttatgtaaatggagtcacaaaatctattcttttttgtctgtcttttgcactcaacataactactctgactttcgcctatgttgatactggtagcaatagttcattctttttttaattaatagattttatttttagaacaattttacgtttatagtagaaactaacaaagcagagagaatttccatacactttcttctactctccatattctttatgattaatatcttggattagtgtggtacattcgttataattgatgcatcaatattgacatattataaatgaaagtccatacattagttttatattagggttcactcttgacattatacatttcatgcgtttggacaaatgcatatgtcatgtaaccactactacaatattataagaatagttttactttcttaaaaatttctgtgcttgatttattcatcccttcccttggagactactggaaattctgatctttttacagttttcccctttttaagaatgttgtatcattggaattatacagtgtacagccttttcagattagcttctttcactaagttgtatgcattttaggttcttgcatgttttgtatggtttgatagcttatttttaaatcactgaatatcccattttataggtatgccagtttattgaaccattactcacctgttgggggcatctggtagctaccaagttttgttatgagaaaagctattttaaggagtcatgtgactcatttggataggagtgaagtttttttgactcatttggataggagtgaagttactagtccatgtggtaagactacatttaactttgtaagaaactgcaaagctatcttctaacgtggctgtgccattttgcattcccacaagcaataaatgagagtttcccttgctctttatcttcaacacaatttagtgttttcagtgttctggattttagccattttagtaggcatgcggtggtatctcgttcgaatgagcgattctctaataatacatgatgttgagcatacttcattcgcttatttgccatcaatatattttcctcggtgaaatgtctgttcagatctcctgtccattttttaactggattatttatcttttttttttctttttgagttttaagagttctgtggagtgctcataccagttctttattggatacatgttttgtaaatattgtctcccagtcttggcttgttttttaaatattaactatgactttcttagagcagaagttttaatttttattaaattcaacttataacattcttctatagtctcacatttttatgtttaaatctattatccattcttgtacattgtgtaaacacagtgtctagattctttttttttggatgtggatgtccaattgttccagtaccgtttgttgaaaatatggttgtgtgtgtgtgtgtgtgtgtgtgtgtgtgtgtgtgtgtgtgtgtggttatatctcacgttatgagtataccgtgtttggtttatttattcacccattgataaactttgggttgtttacagtttagtgttattataaataagtttgtcatggccacttgcaaacacattcttgtatgtatatatgctatactgttttctgcttaaagagcaacagtagaataagtaggtaaaatgatgggggtctatttaactttgtaagaaacagtccattttttttttcccagagtggctgtatcattttactttcctaccatcagtatttgagaattacagttgttctaaatcatcaccaacacaaaagatgatgagtatttttaattgtatttattctagtaggtgtggaatggcatctcatttaatttgtatttctctaatggctaaagatattgaacatctttcgatgtgattatttgctgtctctgaatttcctctggcaaagtatatgtaggtgtggaatggcatctcatttaatttgtatttctctaatggctaaagatattgaacatcttttgatgtgattatttgctgtctctgaatttcctctggcaaagtatgtgttcaagtatattcttttccttattgtttattgttggtctgtaattttccttataattgagtttacatattttggatacacattctttatcagatataatttggaaatgtctattcctagtttgaggcatatagggtagaaatatagaattttttgtttttatgaagtcatatttattgttgttgtaactggtttttttgtttgttctctag

SEQ ID NO: 4338 - DNA, 1557 bp, Homo sapiens
gctgaagcaaaagatttgcatttaaggagagaaatacaccctgaaatttgagtttgaaagattagaacatagagggtctctacagtgtttttctgcaacaccaagtagtcaaatctatttatagaaactctgattacaacagaaattttaaaatgaaattttccacatcggtattttgtaggaaagctcttataatcaatgcttaagctgctttttgaggcttttcttgtacagaggttgcagccaattacattttaattggtaggctgctgaataatgtttttgtatgttttaaaataatatttattttaataggttttttaacattatgcaaatcccaataaagaactgacacgttccataggccattgactgggaaattttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatctccagccatgttttatcaaatcacacactaaaaataaatggaaatgctacagtgaaaaaccaaaagttacagagcaacataagtaaaatgactaggcagtttcttagtaacatgtttgaaatgggaaaggtgactgactgcctttcaccagagtcttagctgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagacccaactccagcagccagaatttagtatttacatttgccttcccaagttgagaatagaatgtggtgttctgtgctttctgtttttattattccaaaatatttttttaaagaagtgttatttttcaacagattcataaattagttcctgatgtacggtaaattaaaactcccactgtgtcagtcaaactgagatgtgctcatttcataaccactcatttctagtctgtcagagctgcactggtggcttattgctggtttttaaaggtgtttttaacttacatgtaacatgtttaggacatgttttttttttctaatttgtgtgtctttacaactgattaaacagtagtttaaaaata

SEQ ID NO: 4339 - DNA, 1006 bp, Homo sapiens
cccgcgtccttaccctgccgacggctgctcggctccggcccgcggcggcggccccagagccgaggaccggggtgggctcgcgctcttcgtcactggagaagtccgggggccccttgctgttggtgccggcggggagcggcggccggttgcgagccgtgaggtgctgcaggtagagctggacgtacacgtctttgcgctgctccccggccggcagcgtcacattgttggcgaccaactcactcttcaacttgtcttttgtcaggaccgaggggtcttccaggaactccggcatctcggggatctgcgaagccccctccccacagcctttgccgccgccgctcacgccggcgcgcttgctcctggccggggaccgcgctgccgcctccgagcctcacggctcctgcccgggaagagcgctgcggagcggaacaaaaactcgcggacacaaagccaagccagacccggacacaaaagaccccagagccgaactacgaaccaactgcggccaagctggaagctcgcaccaaccccagcccacacactacaggcaggaggcgagcagcctgcttcgcccacgccccaagaacgcgcgccgccattggcgggcgacgggaggaagcgcggcggtgattggcgagacggctcgcgcgggttccattagccgccgcgctgagcgagaggaggtagaaacgcagtttaaaaggcgctggggcgggagccgaggctcccggcccgcttctgttttcgttttctccacccttccccttagacgccgataagggacaggtcgtactgcttttgtgcgccgtttcctctccctcccccagcttgagaagcagctttcgtctctggggtcgatcgcctacgaacgcgccgaattccacgccagtgtgaggacccttggctgggcctttcttcctcccgggacactgaagctccaagagtagccgcagccttgccttccccaaacgctagccctgaaggggaagaaaagaagcgaggcttg

SEQ ID NO: 4340 - DNA, 3402 bp, Homo sapiens
cccccgccccctcggcggcgacggcggcgggtggtgcaggctcggccccagcgctgagggagcactgagccgacccaaggtctgcaaggagttcgcggcacccgcccgcccacgccggacccggagggcacgtccgccgggaggggcagttcccacgaggaaagtcccattgatgcgagttggcagtgtagaggatgctcccctccggccgccgcggaagccgtcgtccaaatgcaggcgagcggggaggaggaggccgggatgcggccggcgggccacctgctctcgccggcctgccagtctcctgcttgctctgaagccctgccatagacggccccgctcccccgtgtatccactgaaacatttttttataaaaacgctgcgcacagttttagactcctttcctggaatcgctttgctccaactaagttaacacgtaacaaagtttgttttccagcctcgcccttgatcttcagaatgcccctctcggctaggagggcttctccaagtggaagtggttaggcagttttgtttttggccgccaggcgtaggacgcgagaagggggtgcagcggccggggaccagggcggcggtccccgcggtgggatcgcgccagcgccgggaggccggggagagggtgttctctgccgggagccgaggcgaggctgctgggtactgtgtccggcttttatggctctgcagctcctaggatcgtggctcatgcaggtgttgtggattaatctattttatgcataagcctattaacattagggattttaattctagaaactgcttagttaatacgtatgtgtacacacacacacacacacacacacacacacacacacacacacacacacacacacacacacacacacacctggccactgacccagcagctttctcttgaactacatttactttaaagagaggagcgatttgtcctctccagttcctcagctcatctttctattccatgagactgaaagttaattaaaagtggagatctagccttaaccagttctgttttcccagctcccagttaatgcaatatctggcacaaataagtattcaataaatatctgttggatgagtaagtgccctggatttctaatttattccaattctctgcttactttaaaaaagaaaaaaaaagcaatattggggatatttgttgaagttgttaataagagtgaacatttggaaacacttaaatgaccaaaggtagggattatgtaaattatgtcaacgattaaaagtgaagaggtagacttagtaataggaaataatgttcatgatattaaatcaagcaaaatattacaaatttcctgttttataataaaagtttaaatatgtacgaaattaaaaatatacattataaaatattttatatgtacatgtatgttgaaaaaagtctgaaaatatacatgaaaatgttagctgattttctcccctcatttgtggaattacacgtgcacttttttgttcttgtttgcttgtctctactttttaaatatcctatagttaatatatgtcatttgtaaaataagtggtaagaagaaaaataaaaggaacataaagtagcatcatctggaaaataaaataggaacactgcttccttagaatattgccaattatctatatattccagttctttttttttttttaaaccaagtctacaatcagatatctgcggctgatactgcacttagatttaaggatgtaacacaattacagtactttaaagaaatgtcttctggcattaccagtagtagttttaatgtcaacaagcgtgctccctccgttatagctttaaaaatcttggtgcaatttatttattctagttactgcctaaaacaaaaatcacaaaacttgaggtctggcagagggttggatttcaaccctccatgtatcaccacatttcacccttaaagaaaagtagagatctatcagtagaaattataccagattcttacagttgttctgattttcaacaaatcttttatcatattataaaatccctctatattctacattaactccttcctaatacaatttaacttcattttctctcggtgttttatgaaagttgagtacaactaatctacttttaagttacttgaggtacataagtgcctaaatccagtagtattttaatcattataactgtatgctattaaagacaattattcaattactctatttcttgcaggagaaaaaattacattcaatctttcatcgaaactagttttttctctgttactatttcagtcgtttgagtggttaggttctccatatttgctcttagagtgaatggcaggtctggtgaaaaggaacaagttattagtgtttgcaagtgacactcaactaggaagcagaagtttagataaattttagtaaggaatacattttataatgtgtttgctttttaaacagtagcactactttattgtttatagtcagattgatacttgttaaaacccctaaattttcttctttgatacttgccaattgctagctattcctccttttgaaacttctttttcttccttgcatcttttagccgacccatatgacttactcattttgtttacttcttactacttctccaatttttattttgattctaatctggtcattgagaatgtgacttcctcttcttagttttcgtttcccagctaggtttcatttgctgtgtcagtgactgtttttttttttctggtagtattagtcattgataaaaaatgttctataagaagatcgagtccaggaccatacctttggaagataactgcttaattctgaggatacaattactccattcatagtcactcccttggttctattctctaccctcctgcatgcagttaataattctagtatataactagaattctagtaataattctagtatgtaaaccatattttatcggtttgggatacagttgtaatactgaacagaaacaaaagccttatcaaaatcttagttccctttaatctctctgccttggtacataggccatttgaagataaagcaagtaaaaagccacaaaatttggtcagactatttcttggtaacttcatagttaaaccgcacatttgagacatctaaaggccatttacacgacaagcaatgaattaaatttaacaaatgttacaatcccatccagtgttaattatgtcttggtcacagcagaacagagcccctgagtattgtgtctttaaattttaatctctgtcccaaaatctcatataaatttccttttaaataattctttaaagagactctctatgactaacagttttaaatgaagaataaacctatgtttatggaagatgaagatatgttaaaaaatgaaatctagaagggtatgcagtaaaatttcaacagttattatctac

SEQ ID NO: 4341 - DNA, 1013 bp, Homo sapiens
gtgctccctcccctcgctgctcaccttggttcccaagagccgggcggccgcagtaagtaaagccatggcgggcgatctccgggatctggtggggaggtaagaaagggagagagctgcggcaggaacaggagccgccgccgctgcaccagaggccgcgccgacgggttgacaaggttgaaaggaggcggctgaaggaaagagtagacgaaccggcggcggcgcccagcccggggtcctcaaggaggccccgcccactggccggaacccgagcccgcccctctcaagggactctccccgggcccggccattggtccggtatggaagcggggcgggaccttagcccttgacagcagttgtgacggggaggattggaccgcccggattagggctaattaagggtggatgggtggcgggcggggaagtgcgggtggctaaataggtgcctgataactcagttaacttccctcttggcttttccctttgaccttaacacttttggggttatctctgaggcgaatgctaaaggagacgctccaggactcgacctctgaaggtccttggagccaattccgtaatatgatcatggaaactgatcattgcctgatccttctaccgccttggcgcgctttcttgaggaatgtctttggttaatggcttcacggccatggaggtgacatcatgtggacaacaggctaggatgccagagttagctgctcggtggagatcatttgagctccgactcagattttgaacggatgtttgcatgtataccacagtgctacattaaaaaccagtcatgtggatgtggagaagggtgctgatcaggactccctgtttgctaacaaattctacagcagaaacaaagtattaaggtttgcagccaggaagcaagtgcatggggaataagcctgcagcttcttccaaatgagacagagccaaatcttttttctgagtctgttttcttcatttctattaaaccaaggtcctttttaagcagtcgaatttcatccaaa

SEQ ID NO: 4342 - DNA, 15194 bp, Homo sapiens
aaaggctggtgctcggcaggaggaggacgcgggctggggccgtggggcggcgtgagggtagcccgggagcggtgaggagcgtgcgaggcccacgtgagcggagggacgcggccgctctcacctttcctgagggccctggcccggctttggactcctgattctcctctgcttgccagctgccgccccgcctccgccagtggtgcccgggctgcctgcgcggccggagtgaacgcgtcccgggagcaggggtttctccgaagtgagtgcgccagccccgggacgagctcgttcgagtcctcaccgcccagtgcacttcctgaaagccggcggtgggctgtctcccaccttgtgaaactttgccaggtgtcgctcacaggggactgggtccggacgcgggtggcggcgctggtttgcggccccggtttgcggccccggcgccgcgatcccgggccgcgcccacgcccaggctggaggcaccgtgcgcaggtggggacgcgcggccgggaggtgcgcagcgggacccggccggccgagggtgagcgctgctggggacgctcctagtctgtaacgctctgtgaaaattatttcctggatagtttaggaaaagcctctcccttccccgcccctaaacctctatcttttgggaatcattgatttgctaaatgacatttcggtgcctaacccattttgaatccttgttctgctgtgaatttcatgtgactggaggaatttaataagctaccaacttgacaggctttaaacttaaaaaaaaaaagttttgttacgtttttcagatttaggcttccaagatgtttacactcgcactgttacttttttttttttttttttttttttttagcaacatagtccaaatttttaaaactcagctggatcttttgagggttaattaaaaggtgggttaaaaaaaatcttaagactttaaatttagaagtcctactacagctatgtagtaggagtatgcagaaagataagaatcacattgtaactctttgcggtggtgctggaacatctgttgggagagcatatgctgaactctgttcacctcacaagtttatgtcctaagaggctcattcacagttcagtaaaagggtgaactgaagcctgaatcagtttcggggatgaaagggtgagagggagaactgttttcagcacatttgaggttggcaaaatatataaaagtcactctttcttgtaatttgctagttctttacagtctttagatgtaatttacagccaagaaaactttattatgaggacttatacgtcattgcccttttttgctgtcaccctcaactaccctgggatcttctactcatatctcatctcctgttcccacttttctaaagcttagggtgaaatacttaggcaactagtaataatattaatcttgctagatattcacaggttcatagtgagccagctgtctagatctggatatctagtgagcaaataaattctttacctccgagttgatttttgttttattgatcgattgacacagtcttgctctgtcacccaggctggagcacaggctcaagcagatcctcctgcctcagcctctcaagtagctgggaccacaggcacgtgacaccacacctggctaattgtttgtatttttttgtagagacagagtctcaccatgttgcccaggctggcaaattgagttttatatgtgacgcagtcaaaggggcattttccttggcaataagaagccatttgatatgaactctccacaatagttgatgcatacattttataccagaattcaaatttgtaatcaataatgattacttgggtgtttatagctttggccaacattaaacaatatagtgatcaaagcttatacacataagtgacatataccatgatttaatgattttggttatccatcagctggacaatttgttgtttatctccgtctctgcatactgcagctcacaaggaggcctcaatgttttttccatgttaccataagtgagagaacacattcagtaagagtgaaaaaacgctagtgcttttgagggaggggccccgatggaagtcccactgtgacatgtgagtttttaagctgggaaaactaccctgatgattctagtaagactccctagaaagggattcctcttagccagcctacctgttgagaacacctgctctagattttctgatttttttttgtattccctgcataatcaaatcatgtgggccagataacattattgtgatagtggtgagtgtgtggtttgtatccaaatattttataaagaaatatatcttgtaacaaaaaccaggacacaaagtattattgtctcttgtccccagatgatatatatatttttaacttcccatactacactgatgtacctagatgatgtttaatgcacattcagtatattgttttatttgcctttttaatagtgaaaggtgtcattattcatataccatgccataccgtaatatagctggtattattgtccaagtatttatatgtaaccagaaaactgattccaagtgaaggtttggatgaaggcactagtgacggaggaggcttttcaaccctcctttttgcagctgggttgctgcaagacatttcaccaaaacctcagataactgggtggttcagggcagcctgatacactaaaatatatcaactataaaaaggatgcccagatacgtccacttctacttcagatatcctgaaacaggcagtctgattcatatcaagaatttgttccctatgagacccctctcccactacacctccctgtttcctccattagaatataaatatcttgaagtcactgaccatgttttattcaatgttatgttttctcatctggcacacagtagatgttcatccatatttgttgaataaatgaatgaatgaatgaatgaacagtgctcccgtaacaaaaagtaaaggccagaaactcttgggtcacctggaaccttgttcctacctaccagggaaaagaaaacatgtctcagcattatcagactagccctgagattcactccagttgaattggctgaggttctatggccattcttgatcagtcactggggccaaggcagtgaatcaacttcagaaccatatgggtcccttccaaggagacccagggctgttggagaggggaaagaaaaatatgaatgcagggaggcaccaacatatgtctgatatcattgtactttaatctgtagtttgatcatttaaattgccgtgggtataaggtacctcaaaaataaatttttgtttagttagttcacatacagcatgtattttaaaacaggtgttaaatattaaactgtctttaaagattacacttacaaagctgatctaaaacaccagtaagttatctgctgatatacaacttaaggaaaaaattaattgcatattaaaattaaaaatacaagtttttgttaaggtttacaaaaatacggtgacagacttgagatagaaattcttggtggtgttactgtgacaagtatttccattggtaacctgggaatccatgcccagcactgtggtatatggcgtattttctggaagactagccttggattgaattcacagtctccctggagttgtggttccatttgtcagaaagattcttagggatttagactgaccaggctgtcatgttctcacactcatacatttgtaatttttggaaaaaccataaaacccaccagtctttggagactgtccagaaataaacttgattctaaactggtttggtttggaaaatccttaggctacttgtgttaaaaattaaagaactagctgggcatggtggtgtgtacctgtagttccagctacgcaggaggctgcggcaggaggattgcttgagcccaggagttcgaggctgcagtgttctgtgattgcgtctgtggagcgccaccgcacttcagtctggacaacataatgaaacctcatctcttagaaatgaactggctgatgttaggtacttgccagggtagacgaccttaactaagcccctggggttctgtgagacctctgcaaatagatcttctgcttaactgttcaaaaaggcaagggctgtccccctcaaaaaacaacattgacttctagagacccatggagagatggaagtttctgaagactggcttgctagataggaaaataaccaatgctccagcagtgttcttgggattggaatttgctgattcatgttttttaaaatgcatgatcacatcaaatttgctgagctgttgactatcaacccagcctaaacccaccggctcttaccctttaactttcataaaagagaagcctgattttgttcaggtatctagccttctcccaaagaccctgtgtggcttgaaggatacctttgctggagccatggataggataaatctcgatcagtaaaacaattaggaaatcctgtacttttgcaattggttcggaatgattcgtacatgacaaaggacacacgaggcaatttggaggggctctcattggccaaatctggcaaaatttgagtatcaaaaagataagatggtaccattgaatagaaagagaatcgaactccatagggatttcaaagaaaaagaggttggggagggtgcagagaaaaaaaacaacagcatctttatagaagagtgcccctaaaaaaatgcagaaagagagagtgagaaaagtaccactttgctaccaccaaatgtaataattgattaaggtattttcaccattgagtgggaagttaagaaatgaaacatgtattctcaaagtaccacctcatttaaaaaggagaagaggtacttttacacggataaatctgatgaatacgaccccaaccatgtagtcacaataatgggacaatttaatatgttcttccccatgtcctggatgccactggaagtgcacactgcttgtatgtaatattcttgccaaaatgtttatgctgaatctaatcatggggaagtaagacaaatctggactgtggaacattttattagacaactggtctgaatcttcaaaaatattaatgtcggtcaggcagggtggctcacacctgtaatcccagcattttgggaggccgagttgggcggatcacctgaggtcaggagttcgagactagcctggccaacatggtgaaaccctgtctctactaaaaatacacaaaattagccaggcatgatggtgggtgcctgtgatctccagcttcaggaggccgaagcaggggaatcacttgaacgcgggaggtggaggttgcagtgagccaagattgctccattgtactccagcctgggcaacaagagcgaaactgtctcaaaaaaaaaaaaaaaaagaaaaaaaaaagtcatggccaggcataatgactcacacctgtaatcccagtactttgggaggccaagcggggaggatggcttgatcccaggagtttgagaccagcctgagcagcaagaccctgactctacaaaaaataaaataattagctgggtggggtggcacatgcacgtggtcccagctactcaggaggctgagctgggatgattgcttgagcctggggttgtgccacttgcacttcagtgtaggcaactgagcgagaccctgtctcatttgaaaaaaaaaaaaagtcatgaaagcaagcacaagcagaagactgattgttgagacatgactaccaaatgcaattcataatctgtgattagatcccagattttaaaaaaaaaacctctaaaagacattttgggaataattaggtaaattaagtaaaatttaatatggatttcttattacacactgttattgtatcaatgttaactttcttagatgagataattactttgtggttatctaggaaaatgtctttgtttcccataaatacatgctgaaacactgaaggatgaaatgtcatggtatctacatcttattttcaaatggctcagaaaaaaaattttatagagaaataaagcaaatgtggcaaaatgttgataatgggcaaatctaggtgaagggtgtatgtgtgaacattgtactattttacatttctgtagctgtgatttttataaaagtagaaaaagtaaaagtagcgaaatgatcacaaaacatccacagcgtgaataaaaaaataaataaaactatattatatgaacactgtttaacatttaaagttgtttaactggttttgtaaatgggataaaatattaatcaaagtcccctgagagctattcctaaaatagaataataagatttatgaagggaacttaaaagcttaatggagaactggttttctgaatgtgtcacctccatatattgatatttcaaaaaattagagagtgaaactggttacaatcaacttgtaatggcttgcagagttagtgtcccaagagttagtgcgacagtatgttctgaaggaaacctgagacagtcaagtccaagcaaggtcatcctcagagagaaatgctcctaaaaaaggctgcaaagcaatcacactgaaactgaatgatgtgaaatcacagtggagttccctctaagtgaattctcttatttaatgaatgcttggaatctaaagtaggggcaattgacagtatacacatttgctaaggttgatgcagcacttttcaatgttaacagctactgtatctggtggacgtggccttttatcaccagaaagacctactctgtcctggagaagagttagttctttgggcttttcccttaccctcaggaaaaatctctaagatcatcaaactttctttctgtgatcgtgattcagagccaaataaccttttgattagcaactcactttcccagtgtcttaatgctgggaaacagaatattctaggggaatagagatatataacccacttgcaggaagatgttctgcttggtaaatgaaaccattgacattctgatgtatcagtcccttgcaaatttagtcagaggggtcaccccccacctgaattttatcaatttggaataaacaagattgcctatgtatgatgacttaaacagccccttgttcttgtattttgacatcattttaatttgtacattgtttaaacttaaataactacttagatcccaaacaataccatttcaaggatactgtttcttccttattaaaaaaaaaaaaaaagctcggaggaattatagaaaaaaaattctagtccgggtgcgatgactcacacctataatcccagcagtttgggaggccgaggcaggtggatcacttgaggccagaagtccatgaccagcctggccaacatagcgaaaccctgtctctactaaaaatacaaaaattagccgggcatggtggcacatgcctgtagtcccagccacttgggaggctaaggcatgagaatcactttaacccagggaggcggaggttgcagtgagctgagatcacgccactgcactccagcctgggcgacaaagcaagactctacaattttaaatattacttatcaaccttagagggctggctacaaaccttatgtaaagaagtaaatacatgttagagactcttaaatcccatgaacagctgattgctttttaaaaaatgtacttttaaaacaaaaatgatgtttaaattatgatcaaataaatggtgaatttctttagttcatttaaaactattcaactaaaaacaaatttgtttataatgtagaaatatatgtgtattcgttttcattttttcaactggttataatggagttatgtggatacattctaagcaaattaaaccacactcttaccacattaatctcagagcttatccacatatcagaacactagttttatagtctgactatacttgaaatattcacaaatatttattttgctattaatccttgggtcaaagtttatttttcttgaatgcaatatttgtatttcaaatgttccatcaacatttacaacttttaaagttttcatcataagtctcaaacatcttgctgtttttttttaaatcatgaatgggtattggattttgtgcaatgctttttctggtcttttgagatgttgagatgatgctttttctggctctgtgctttattatatggtgtattatgttaactgataattcagatgttaaaccaaccttgcattcctgggataagttccacatggtaataatatagcattttttttttgtatattgctagattcagtttgctaatattttgctgagaatttttgcatctaacctcatgaggaacattggtctgcaattttcttttgatgtctttggttttagtatcaggttattactggtctcatagtatgagttgggaaatattccttccatctctgttttatgagttcattaaggatggtattaagtattatttaaatgatttatagaatcctccagtgaaaacaactggacctgggattcttttcatgtgggaagacttaaaattacaaattcaacttctttacttggtataggtctattcagaatttatattcttgttgaatcagtattggcaacttttatatttctaggaatttgtccatttcatctaagttgtctagttggttagcataaagttcttcctagtgttctcttacaactctttttgtttctataaggtcaatggtgatgtctcctctttcattatttttggtaatttgtgtcttctcagttttttcttcatcagcctagataaagttttgccaatattttgatcttttcaaagaatcaacttttaattaattgatttttcttattgcttttctgtttcctatttcattgatttcctctctgatctttatgatttccttctttctgatttctttgagtttggttacttttttctagcttattaaggtggaagtttacattatcaatttgagattattcttttctattgaaggtgtgattaaaggtacacatttttcctatatatcctgctttagctgcatcccatatattttgatagtttttttctctgttccattaaaaatattttccaattttgcttgtgcttttttccttggcttatttagaactgtgttgtttaatctctaaatatttttaaattccctaaattttctcatgttgttgatttctcatttaattccattgtggccagaaaataaactttgtaatatttcagtcctctgtttttaaaaattcatttgggcttgcttgatggcctagcttatggcgtgtcctgtagaatgtttcatatgtgcttaaaaagaattctgctgttgttgggtggagtgttctataggtatcagttagatcaagttggttgctagtgttgctctagtcttctatatccctgctgtttttctgtctagttgtttttatcaaatattgagagtgaaatattgaaatctgtaactatttaccatttttgttgctcttcatttcttctcatagattggagttactctttggaacatttccttgttctagagcttcattctctccttccttttttgtgttattatagttatctacgtcacatctttatattttataagctcaacaatagttttataattatttcatatagttgcattttcaattaagaaaaaaaccagtctgggtccaatgattcacacccttaatcctagcactttgggaagccaaaggaggaggatcacttgaggccaggaatttgagacatgatgagacactgtctctacagacatttttttaaaagttagctaggtggggtggtgcatgcctagctactcgggagattgaagtgggaggatggcttgagcccaggagtttgaggttgcaagtgagctatgatcacaccactgtactgcagcctgggtgacataataagatctatatctaaaacaaaaaaaaaagaaaaaaagaaaaaagaaagatatttatactgtcttttattgttacatatatttaatacttacaaaaactacctttgagactgctctgtttctttatgtgaacttgagttatcatctgctgtcattttccttcatcctcaaggattcctttagtatttcttgtaaggcaagtcagctaggaacacattatctcggttttttttgtttgtttagttttttggaatatctttatttggcctttatttccaaagaagagctttgctgaatatagaattctaggttgacaggttcttcttttttcctttagttcttacaatatgtcatcctattgtcttctggccttcactctgatgaaaattcagttgttaacataattgtgggttcccttgtatataatgagttatttttgtcttgatacttccatgattttctctttgtctttggcagaacccagtgaagatgaaaatgtgaagtccctttgttcagaaattaagagtttcaaagtagtgatgggaaaggcagccctgatctttggctttcaacaattttactatgacttatccatgatatgtcagtggttattctgtttggaattagttgagctgcttgaatgtgtagattaggtttttcatcaaattgagaagtttggggcattatttcttcaaatattttctctgcacctttcttctcattctggtactctcattatacacatggtatccttcaggtctgtgaagctctgttcattttgttattctttttcttctgttctttagattgaatctacttccaagttcatagattcttcttctgctatctcaaacctattgaacccctctaataaatttttcattccaattactgtacttttcaacttcagaatttccatttggttctttttaataatttctctcttttcatcagtattctctatttgatgaaatattgttgtcatcctttcatttaattatttaaacattattttctttagttatttgaatgtatttagtctttgtctagtaaatcaaacatctggcccccctcagaggtggtctctattgagtgcttccatcctccccttccactgtgtatgagttatacttactgtttcgtagcatatcataattgttgaaaactgaacattttagataatgtgctataccaagtttgaattctggtccccctcaactgcaggttgttctgatttctgttttgcttgtttgtttagcgatttgcatgaactaattctgtggaatctggctccctcacaacatgcagcagctaatgtttctgctcagttaatattattattgtcgttatcattgttttcacttcatgcctaatttcctaagggttaccctgggccatcatagcttactggtcagccagtgagtggtcagaagttgtgcttaaaacatcttgatctaataaagcttctactttttaactgacagatttgtgtttaggtgaagatcacatgcagtgtacaggcagtttacaagtctaccctgcttttattttttttattttattatttttttgagacggagtctcactctgtcgcccaggctgaagtgcagtggcatggtctcggctcactgcaaccttcacttcccagattcaagtgatcctcctgcctcagcctcctgagtagctgggattaccggtgcatgccaccacgactgagctattttttttgtatttttagtagaaacggggtgtcaccatgttggccaggctggtctcaagctcctgacctcaaatgatcctcctgccttggcctcccaaaatgctagaattacaggcatgagccaccatcccgggccaagtctacgctgattttagtatctgtatcataaagcctcatattcagtcagctacatagctagctaaagccatctctggcctctcctgagcatatgcacaattatgcatatgcaggcagtcttccagacccccagggatatgtgagagcttatcagtgcctactgtggctgtctcagtccccagatcacactgttaaatttctggttggtctgctggtatgttgtttaccctaaacagtgttgcaacctcaggctagctgcaatactggacttccctgattgtttaccactgagatccctattgtttttgacagtgctcctgggcataggtttttttcaagctctggtacaaatgaacgcagccccttctgccagctacctcccatgacctgctctgtcctggtagaactaccacacgatgaagctatgggaaaagggtagataggaacagccccggggtaaaacaccacagacctccactgagcttactaaagtttagtgattttttttcaaaataatttcctttcaagttgttgtatgactttggtcaatttacagtgtactgacatggttgtttttgataattttgtcaaattttatcattgctttttggggaaaggatttgccatgcttcttcctcaggcattctggcaatccttccgtattttttgtaagtggtttctataggggtgcaatagacattcttaacttttcacagtaactttaatgttgtttccactttatgcaaaatgtagaaaccttgtaatagaatatatagattcatttaccacaactcatggtaaacacttcccctgtctcctgttcttttttttttcaactcccagtcagtgaatagatctgctcttctttatgccttagttactgtatatctacctacaggtttcaggatttggattaagtaatgattgggccctctttcattcaaaaaatacaaatgctttgaagagagaaaaaactataacaaaaactctacatgtgttctgcatctttacatgtgttctcatctctttatgtgttcaatatgtatagtacatgtctcatggtttagaattcttgaaagaggaaagaaagcctttatgttttagggactagttactaaaagaatggctgtaattcttttactgtataaaaggtgcaaatggttatttggggcaaaggtattatgtgcagagtgagtgatctgtgaacgcttgcaatacctttacccttgtgcaatcactcagaactgaacttacatatcttttacacaggagagaattggcatccaccaatgttttgctactattgatcccaatcactaaaatctcttagaaatttcaggaaatggtatattttccatcccttactattctagtttaaagcattaagattggggaaaatcttttacacctttgtttctggtttttttttcctttggaatataatttatttacttttcaatgctatcttttaggatatattttttctcttgtcctaaaattatctcttggtggagggcactgttaactttttgctttgtgtgtgtgtaggctcatgttatgctatgtgtatgctattttatgctatgtgcctggttataacacatttatctattttggaaagttaatttttagcaatcagagaacatgtttatctcacttgccaagaatagatactttacgtttctgttgcatttcttgtctgcagtgtttctcatctcttcccaattcttttaaatcttaaccacgcttgagaacccagcttgaatcacggctggttccaggactcttccccggctcttccacctggaaatggtcttttcctccttccttcatttatttcgcaaataaatattgagtgcccactctttgtaagacactgattaggtaatagaagctatgtaaaagttgtgacaaataattttgcactggtagatatgtgtttctatgcagtcatgcactgtataacaatgtttcagttaacctaggtttgtataagtatactctatgatgtttgcacaacagtgaagtcacgtaatgatgcacttctcagaacatattcccatcgtgcagagatgcacaagtatatcatattttctcggttaaattgtgatttacttgggggtacatccttctccttattgtttcttgtattccttataaaatttagcagggtgacttctacatagtaagggttcaagaaaaagctgaatttatatgattatatttgtaaattttctttaaatatacttaggtatgcaagacacaaatagttcttttctttttttcttttgagacagagtcttgctctgttgcccaggctggagtgcagtggtgcgatcttggctcactggttaaagcaattctcctgcctcagcctcccaagtagctgggattacaggcacgcgccaccatgcccaactaatgtttgtattcttagtagatacggggtttcaccatgttggccgggctggtctcaaactcatggccaccttggcctcccaaagtgctgggcttacaggtatgagccatcactcctggcctaggactgagttatttgaatgcaaatcaggaaatggcacatcggaatttattatttattttattttattttattattttctagagatgggggtctctctatgttgcccaggctggcctcaactcctagcctcaagtgatactcatcacatcagaatttagggtacaaatatagtccataacaattggaaattttagtccagtcacctcattttccaacgctatgataaacatccttgtgaatgctgttctcctggtctagaaggctcttctcagccttctgtgtgtctaaggcccaccattcttcattgtcaggttccaccacttccagaagacaataacctgtcttccccaaccatttcagtccatacgggtgccatctccctctgaactactgtagcacttaccacctagttcagcaaccagatttccccagcaactctttctatgtggaattcttgtctattctacgggatatggaccacattatatatatacttctctttatgcctgtgtgtcaaatacattactgattaaagcttggttttaaagtccaaatgtggtcatattggtgaactgctataaaccttgcagaggcattagtaaaataaaggacttcttttggtacaaattagatgtgtgacaggctgcttttaacagagtattggcttcacacaactttaagtagtgattttaccagaaatgtttacattaaacagcctttttagaaagtaaactgttacaactatcttgtaaagtaacctaacaatatgtatcaagaatcttaaaacttttcataccttttagtgcacctattttggggagtttaacttaaggaaacaatcctaaagcagaaaaataaaaagctttgtatgtaaacatgtttataataggatatcagtaatattgttgttcccaaaaaagtgaatgagcaaatacattatatatacgtatacatacacacacaatattttatatgctgattgtttccacttgtatttc

SEQ ID NO: 4343 - DNA, 682 bp, Homo sapiens
gcatctctttcaaagatttctaggtttttgttcactaaattttttcttcattagcccttgtttgtatacaagtcactgttcaatgttagacaccaaggaactatttaaaacaaacaagagaccttaggccagttttaccactaaccagcaaatcttctgctatcttttggttgaatttccttgattataaaatgagaaaaatcgggctatatgacctggatggttcttaaaactctagtattctattaaatataactaattaccatcaaattgcattgtatttgttcccggtttggaattgaaacgtactaattgctctctactcagtttctcactgagctaactttaaatgttcctttgaagcattgtactatgataattttgttcttcctgttgctagtggcagttgtgccaggaaaatttgactctgtctcaagaattaacccattgtaaacgctgtgtggttcctttcctctcactctcttaatatcagctaggctttatcatactttatttggaaagcttgagaaagcagccatttccctgtagagctacagcttaatttgacaatttgtaaaccatttgttctttctactttttgtaaggttatttccttgggaaactatttgacataaaataactattttgctgaattttgtaaaataaattatttgccaaaaca

SEQ ID NO: 4344 - DNA, 813 bp, Homo sapiens
aattgatgggagaaatgaggaaaagaaaatctttttaaaaatgatttcaaggtttgtgctgagctccttgattgccttagggacagaattaccccagcctcttgagctgaagtaatgtgtgggccgcatgcataaagatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatcttt

SEQ ID NO: 4345 - DNA, 1383 bp, Homo sapiens
gtaagccttttcttttcaagatgcctgaggaagtgcaccatggagaggaggaggtggagacttttgcctttcaggcagaaattgcccaactcatatccctcatcatcaataccttctattccaacgaggagattttccttcaggagttgatctctaatgcttctgatgccttggacaagattcgctatgagagcctgacagacccttcaaagttggacagtggtaaagagctgaaaattgacatcatccccaaccctcaggaacgtaccctggctttggtagacacaggcattggcatgaccaaagctgatctcataaataatttgagaaccattgccaagtctggtactaaagcatgcatggaggctcttcaggctggtgcagacatctccatgattgggcagtttggtgttggcttttttctgcctacctggtggcagagaaactggttgtgatcacaaagcacaacgatgatgaacagtatgcttgggagtcttctgctggaggttccttcactgtgcatgctgatcatggtgagcccattggcaggggtaccaaagtgatcctccatcttaaagaagatcagacagagtacttagaagagaggcgggtcaaagaagtagtgaagaagcattctcagttcataggctatcccatcaccctttatttggagaaggaacaagacaaggaaattagtgatgatgaggcagaagaagagaaaggtgagaaagaagaggaagataaagatgacgaagaaaagcccaagatcaaagatgtgggttcagatgaggaggatgacagcagtaaggataagaagaagaaaactaagaagatcaaagagaaatacattgactaggaagaactaaacaagaccaagcctatttggaccagaaaccatgatgacatcacccaagaggagtatggagaattctataagagcctcaccagtgactgggaagaccacttggcagtcaagcacttttctgtagaaggtcagttggaattcagggcattgctattcagtcctcgtcgggctccctttgacctttttgagaacaagaagaaaaagaacaacatcaaactgtatgtccgccgtgtgttcatcatggacagctgtgatgagttgataccagagtatctcaattttatccatggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagattataagaaattctatgaggcattttctaaaaatctcaagcttggaatccacgaagactccactaaccgccaccgcctgtctgagctgctg

SEQ ID NO: 4346 - DNA, 837 bp, Homo sapiens
actaagaggaactggacaccaggagcctcataccaggactgcccagccgagccactcgattcctgacccacatggcccttgagatgacaagtgattgctgcttaaagtcactgagttctggaataatttacatcatggcaatagttccaatattcagtatcaggcctggtcctcctaatctactggagaagagttggttatggcatggcatctaatagtcatctcttcttaatacaaatgataataaatttcactgctaagacgacaatcatctgaaaaaaacagacatttgcttatgttttaaagtcataatagcaaactggggctctcttcaacatctggattcatctcagagcactggcaatctgtgtttaacagcagtcatgtctttaccagatgtagaaagaatgttctcttcttttggacttacctaaatatcatttggaaattggaagaacaggaaagcatatcctttttcactaactataaaaataatttggaaggagaaggaaacaaaaaaaaccttgaagttttctatgctggtctacatggtcttacaatgaatctcagagcaacggtttatgacttaaattatatgctgtgttccttagcatactttttcttcaaaaactagtaattctaaattgtataattcttgactatgataaaagagcccatttcttgaccatgtcatttatactggacttttgttactgatggggaaaaatccagaatttgtaataattatgtcttggatatgcaaatggttgattattttcctaacaattcccaaaatatccacatcataaagcagaattaaagatggtttgcctctca

SEQ ID NO: 4347 - DNA, 3146 bp, Homo sapiens
gcttcctgcccttgaacatcggacttcaagttcttcagcgttgggactcagactggctctccttgctcttcagcctgcagacagcctattgtgggaccttgtgatcgtggtgtcctggaattaataaaactcgaggagtggggctgcggctcctctgtggactaagtgtgtggtatcactgcttaggtcaacaagtgcctgtcagggccggaaatgcccgtggagcagagggcctttgagtcgcggggaaagacaccgtgggctgcacctgaagctgcatgtttgtctggggttacatgagtttaacagaaggatttttctaccggaaaagaacgaagacgcaagccttggttaccccatttcagaggagattttaaagagggatctggaaaactgttttttcctttttttcactcatcatcatgttacacagtttctaaagacctgatctcaactttcctctcagcacaggctataattttttttgctaagacgatccttttctgtcattctcttgaatgtttctcttcctgggtgactgggagaattccttcaaaaggatttctgagactggtgtttcccaaacaacagagaacatcgtacccctagaaatggaggaccaagtggcttttgtgataagcaagacctcacctgcacttcgcagacactcccagcagaggaaaaataccaaacagaaagggaaagtggtcatggaacagattctgctaccaagaaatcagggaataaatggccagggatgagtttcataagacctgaattatacaattcagagaacaaaattcataaatttatctagttgtttcctgacaatttcattcgatctgcctaagttagctaccccatagttcacctagaaatgtttcctagttcccttacctattggtgcataaaagctgctttcacatgtctccagtttccaacctacatatcagccagtgatttgcataatccttaaacccccacccccattccttttttcagccacctaatgcaaacaagatctggctcaggcttccctaaactaatccacggaacaccatttagaagggagactattccgtgtaagttggcacggccgaatgagatctctattgtataaggggcagtcccagtagaaagacattaatgaatatgccagtggggagagcctcagcttcccagttgcttgctggaccctaaagctgtaagaactctgtgaaacttgaatgtttctttttttaaccaaggtaaggaatttaatgccactgccctgtctgaatccttacagctcatcaagacccaagtcataaacaacaacttcaggaagaatgaagcctagcctgagcctccctccaaattctccttttcccactcactgcttcacacttgaactaaccagtctgtcctctaaactcgaatatgcttttctggtaatattttatgacccctaccttgcccataaaaatgtaagttctttagaggctgagactgtgtttaagcatctttgcaaaacccgcagcttgttagcacaaataataaatgcttcttgaataaatacatatgtttttaaaaataacttgttattttaaaacagttatttagtgctgtttttccccagtatctccaggtttcagctcactctttgtattctccctccaaaacccctcccctctcacctttcagatctgctgagaccagcgctactgaacagacacgatggaaatgttccttatctatgtgggcccatatgctagcctctgacctcatgtagttattgagcgcttgaaatgtggatagtggaactcataactgatttttaaattttattttatcttcatgtatttaaaacttaacctagccacaggtagccactaggctactgtattgaagagcacaggaccttgactcttctgagaagtcttgctgaagaaccactctagacacctcccagccatcagtatgaaggtagattaggagcttaccttgtgcttgactttatcataatatttatcacaacatacttagttttctatttatttacctgattttcttattggactgtaagttcttgagtcttaagttatagcttatttatcattgtatctctgagaaccaggtgtaatactggtattttaaaagtgctcaataaatatttcgggaggaaaaggatgaatgaatgaactgattgctcagtggacggctagagacattttttaatatataagaaatctacaaaacagacttgttggaacagtgagctgggaactaagagatgaatggtggtgatgtgacaaattatctttgtctaaggagcatacgcagttctttagctcatctttcctcacaagctcaggccctgccttctgcttcactggaacacaggaacaactcgcttgtagactctctggtcattaagccatgactttgtccagacttgccctttaagaaaattcccaggagataaagttcactgcaatgacggagtgagataaacatgctttttgctgtgatcccatgttctcacataccccatactggtctaccgaacagctgaactcattcatcagatttgaaaataatcaggttttttacactctgttatcatgggtacggttgttccagagggtgtgttggcaaagagcctactgaaccatgtcctcgagaccgaaccacatccatccaagggcctggggagttcttgctcctttgctagctttattccaagtacacttgcaaagcataagggaaactcttatgcaaaccaaaaatgatcctaggtgtttaggaaaaaataatgccaaaagttggcatggcatgattcatgtcattttagggtacctagataattaagtctcagggctagacgtattccaaatatttggataattcaaagtaatttgcacagacatagtaaaaatctattttaggtggtggaatttaatatatatttcttggtgagaatttagtcttctgtgcaattttagccctaatattttaacattaacaggtttaatgttataaagtgtttttgtacttataagcttgtgaactaacaaaccataaaacaataacatgtgtttacaatttgaaaatatactgcactgagctctgttttctaaaataaattttgaactatttgtaaaaaa

SEQ ID NO: 4348 - DNA, 700 bp, Homo sapiens
tagattagcaagatttctcacacttaaaccacaaatatatgtgggtgtttagatacatacatgcatattaaatatcaccagttttttagattagctgcaagtcttttgaaacaagggaattcatgattcaaacacaagtttaatgacaaattatttacccatgtaatcaaacaaatggatatcccttataagtagttacatgatcacttcaggtattcttcagtaagtgatacatacaatcaatcatgattgcctcagacagcttctggcctttatgtataaaatcacaactagcacttaacgttactgagggacatttaataaatgcaatggctcctagttacaaagtagcagaatgaagcagctataagccctgtgcagttactatatgaacacaagaactagctcttggcagtagcaatgaactagactttctcctcaagcagaggtgtattaaaagctgctcagcaatgagaagtagtccctggatatattcataagtataaataaagttacagactcctttgttacaaaaatgtaattaaggtaaataataggacgttaacaaatgctttgtcaatctctcaaaggagaaagcacaggaaaaggaaaatagctggcctaacacccggctcaaattgtacagtcttctatctatatataaaactgtgtgaaataaaagtaaggatgttttatgttc

SEQ ID NO: 4349 - DNA, 3130 bp, Homo sapiens
gcagctggctaagcgctagcccggcctgtggcgagtctgcagagctcgcccggaagtagcgttgcgcgcgcagaggatgggcgctgagcagcacacagcccgcggcggggtctcaggatccgcggcgctgcccggggccgggggaaggaagccagccgaggagacgcacgtgccctgagtccgggagcggggagcctcttcatctctccatcctccctccgcgcgcgccctcagccgtcctcgtccgctcaccatgcacctcccctccaagaaagggccacatgcgtgccagggacgcgagccccggccacagggacatagcagcctagaaggtataccaggaacacttaatcaacatcctgcatggttccagcaaagacattaagacagttgggactgttggtgaggacagatgatcttcacaaaccctctgactcttaagaacctgggagacctgctggagtttaccccacattcccttaattaaaaagccattaaaatagtcaactttgctgggcacggtggctcgcgtctgtaattccagcaatttgggaggtcaaggcaggaggattgcttgagcccaagagttaagaccagcctgggcaacatggtgagagcccatctctacaaaaaattcaaaaaattagcaaggcatgggaccacacctgtggtcccagctacttgggaggctgaggttgcagtaagccgagactgagccactgcactccaacctgggcaacagagtgagaccctgtctcaataataataataatccctttagcaggcttgtgcctgagttatttaatgtaagggtaaaaagtcttctttataataaattccctataccttttaggtttactttttttttttttttgagacagagttttgctcttgtcgcccaggctggagtacagtggcatgatttcggctcactgcaacctctgcctcccaggttcaagccattctcctgcctcagcctcctaagtagctgggattattggcatgtgtcaccatgcctggcaaattttttcttttgagacagtcctgctctgtcgcccaggctggagtgcagtggtgtgatcttggctcaccacaagctccgcctcctgggttcatgccattctcctgccccagcctcccgagtagctggtactacaggcgcctgccaccgtgcccagctaattttttttttttttttgtatttttagtagagatggagtttcaccgtgttagccaggatggtcttgatctcctgacctcgtgatcctcccgccttggcctcccaaagtgctgggattacaggcgtgagccaccgagcccggccgatttttttgtatttttactagagacagggtttcaccacgttggccaggctggtctcaccacgttggccaggctggtctcgaactcctgacctcagctgatccacccacctcagcctcccaaagtgctgggattacaggcgtgagccaccgcgcccggcctaggtttacttttcatccatccaaactctcattcttaatattcctgttaacatttaacaagggagatgtgatttatcagaaggaaaactgaaattgaagccacaagtaaaacaagaaagcactcgtggactccaggtgacagagcttgagctgaaggccaagtcacagttctgctttctaagaattatatgcatgactcttggaagaaaaatgctaatttgtaaaaagttcctagttaaaagatatactgggttttcccccttgagtatattatcaaattctggcaaacaataaataaataatacagctttttactaaaaatgccacaaagtaagctattctcacccaaagcgtccagcttaactaaggttttatttaaatgtacttttctttttatttttatacaggtgatagagaacaaaatttatgaacctacgtacgggagggactgatgacaaaaaaaattggcaaaaaccccattcgcacagttttcaattattatttttttttttttagagatggggtctcactgtgttgcccaggctagtctcaaacttcagctcaagtgattctcctgcctctcagcctatcaaagtgctaggattactggtataagccaccatgcttggcccctaattagcacttaaaaaaaaattttttttttttttgagacagagtctcagtctgtcatcaaggctagagtgcagcggcacaatctcggctcactgcaccctctgcctcccaggtccaaatgattcttgtgccttagcctcccaagtagctgggattacaagcatgtgccaccacacctggctaatttttgtattttttttttgtagagacggggtttcgccatgttggtcaggctggtctcaaactcctggcctcaaggattagcacagtttttaatgccacttcctttcctccagtctgctcactggcctcagaagtgagcatgagtgacctgtgtgtagcacaggggctgccaaacagccccgactgacacgggctcagaacttcaccagcttaatgaatgaggcattcaatcatcgcaactactctatgaggaagacactaccatgacgaccattttacagatggggagaccgaggccagggtagttaaatgacttgttcagggtcatgcacctcctagtggcagagctggagtcaaacctaggcagcctggctcttcaacctgtgcactgcctttcattagatgagtacaagggcagagttgagagacctgtaaggaagccatggtcaactgttaacctcaaatcaaagtggccgtctaagggaaaatcccaaactgcatgtgaaatcatggcagtgatgctctctctctggctggtatagtcaatagctgcctcgctccactggggacttcttggaggttcaccttcctcccttccctgccctctaatgggtagacatgtgactgcacggaacagcagcagcagggagggcagaaagcataggcagagctcacacaagctggaaactgtgtgttcttaaaaatgtactcagttattttctctggtgtggagagcagtaaattatgtggtttggaagctactactacactactatttcctgaaagagctttctagcacggcctgtcacagacacaaatttacaagtatg

SEQ ID NO: 4350 - DNA, 3806 bp, Homo sapiens
ataggccgcagcagccctggaaatgatcaggaagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcg

SEQ ID NO: 4351 - DNA, 1681 bp, Homo sapiens
ctagagagaaggcaccttcaggtttggctgatgaatcctgtatctctgccttgtctccaggcccccaggttctgcctctgtcctgacatccagtgttggattcctcttcacatcaactcctctctgtaggttgggccatcagaccctacctccttatttatgttgagcaaaggagagagaatgcctctacaaacaatgaaaaaagtgaaaaaaaaaatctttctcctccttataactttagttagcttaactttagtcagttgcttagctactaaacagtagctattgggaggtgggaaggaatactattgtgtaatcaactaaggctcatacagaggattagggttatctgaattgatttgaattaattagaatttactctcagagctgtggcaattccttgaaccacactgattgctataaagtggaagaggaatagattgaattttggggagtcaactacaatgtgtactacaggaacaaaacccatcagaagatgtcagaagataaggatttttgtcctgatgctacacttaccagctgtccctcagtgttctacttcttaaaaaaagagagatggataaacagaggcaacccgaggataaaggccttgctcagtgtcacacatttcagtcactaaataagacacaatggatgccagtattctcatcccctcacaaataaagagccttcaagctcttgcagtcaacaagaacttttggaatgatttcactgcctgaaaaggcagatacataggtgacacccacaaataggaagaaaatcaacctgaacctgagtgtgtgggctcactgactctaagcagtagagacagaagaaaaagttttagcaaagaagggttctgaaagaaaataaatatagctcgttatcaagtgctgtttttacacagtaaaacatgggcaaaattactcttctttaagtagtaattcttatctcttgattaagtcacctactcattcatttaataaatacatactgattgttttctatgtgttgagcactcatctctgtattggaaatataataatgaccaaagttgacaatagtaataacaataatagctaatatagcaggcactaataattatttgttgagtaatatgtcaaaattcagtgtgaacagcattctatttggggctgcatccactgactataacacagctaatctatctgaaatgttccagctttgggcctctctaacagaagaagctgttgttgggcctgcctctagttggcgatgcatccaccaatgagaatgaatttatgatcgaccactcttcctgtaaaggccgctggaactgacagcattgtgattttcttttactgttagttttaaattactagaaccaactcaattactagaacgaactttacttctttgtttcctacttatcaaaacagtaaaaacaacaagtaaaagaaatgccatcttaatattgttttgatgacaaaacagtattccttttagttgtgcttcaaatggaataagatgcaaacaggcttggtatggtggctcacccctgtaatcccagccctttgggaggccaaggtggaaggattgcttgaggccatgagtttgagaccagcctgcgcaacatagcaagaccgtgtctctacaaaaaataaaaaattagctgagtgtagtggtgtgtgcttgtggtccc

SEQ ID NO: 4352 - DNA, 787 bp, Homo sapiens
aaatttgtgaaaatttaaaaagcatgaataagagcttttggtgagactgtggggaaacagatactttcatgcattgggatggcaaattggtaaagcccatatgaaggagaagatggcaagatggaacaaaactacacatgcacttacctttgacccagaaatctcacttctaggaatctatgctgaagatacatttctaagagaagaaaaacacacttgcacaagtttattcatctcagcattattttaaattgtaaaatattgaaaacaacctagatgcccatacatagcagattagtggaatacactaagaaaaattcacacaagggagtaccatgcagctgtataagtaaatacaggagatctcaatgatctgatatggagagagtgccagaatacattgcttagtggaaaagactggttttactagtgtgctaccgtttatgtaagaaagcagaagaaataagaacatatatatgtatttgcccaggtatgcacaaatcaatacaggaagaatacgtttgaaactaagattagtcacctacatagggtagatgggaacaaagtggataaaaacaagaaatggcaacacagtgtaagggataaaggggttccacatctgagtatgattttctgtcaagttctgactttcagaatcataatcatgtttcacatactaaaaataaacaaatcaataaacaataaaaatcaaaatgaaaatacagtaaaaaatattgtaggggggtggggcaagctctttatctagaggaaatgagttgtatcacca

SEQ ID NO: 4353 - DNA, 769 bp, Homo sapiens
tcgagagaggaggaaaagggtgcagtgtttgaaatacggcaggcaacatggacccaaaacaaattaccagcaccataaaggagctcctggatctccatcaggctcatcctggatgaacaaatttatgtgaaaatgagaaatgaccaagaacttaaaagcagattacaggcatgtgatcaacatttaaatgacattggaagaaacggtgactactatagaaactaatgaagaaacagataaagagatatataaatcaatgaaatggaatattccaacattctttgtccatggagatggtgtcatactagttgccttccactgacagctggctgaaacaaggaatttatcctgtatagaaaaatacaagacttggttcaatggcctctttaaatctgtaagacattcaaaagagaaacctgcatacattttgaaataaatgactccacgattcttccactcctaaactgaggagatttgcagataactcacaacttcctaagctaagaggtatttttatttttctccaaccattccaataaatgtgatcaagatacagaattttttcaggagatcatttgctccatttttttctttaaatttgatatttgctttttgatttcttaaaaagactatcaagagagtaaaaataaaacccagagaatgggagaaaatatttgcaaatcatgtatctagtaacagactgggattgaaaatatattaactactacaattcaacaactaaaaaacaacccaactcaaaaacaaagaa

SEQ ID NO: 4354 - DNA, 547 bp, Homo sapiens
aagcgctgctggcacaccgggcactggtagggcttctcgtccgagtgcgacagcttgtgtcggttcaggtggtagacgtcgcggaaggccttgccacacatctcgcaggcatggttcttccggatgcgcttccccgaggcggtcgtggtcaccacgccaccggcggccactgcggcagcgccgccgccggcacccgcctctccccctcccccgccggctccgctcagctggggcacgctcaggaggctcaggggcaccatggtcggcatcttcatagcacccgaggggacccggccggccttggctcccgtgtggatggcttcgtgcctccggagattgtagccgttcttgaactccttggcgcacagagcgcagatgtagggccccttgctctttgtcttcttctccaaggcagacgcgaccggggccacggcgaccgtcgaggttggggctacgacggcggtggccgccgccgcggcgatagtggcggcggaggcgggggggaggaaaagagggcgccttgcgggccgcggagcgccgcggcgac

SEQ ID NO: 4355 - DNA, 4962 bp, Homo sapiens
cagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaa

SEQ ID NO: 4356 - DNA, 5398 bp, Homo sapiens
gtacactggtgtttttccattcacctctgcccagcaggacaagatgatgaaagtacagagaacttgtgggtccaggtttgtgtcagaaaggaggttagtggcttgcttagggccaggcagagggcacattggaaggaattctctgttcccggtgacagcccttggaattgctgtgcacccagagttgcggagtaatttattggcttctgataactatagtattggataacttcccaacattttattaaaaattttaaacatataggcatgttgaaagaatttatactcaccacctagattttgccactatcacatatctgtgcatcctattaatacatttttaattattatttttttgagacagagtttcttttactcaggctggattgcaatggtgcaatctcagctcactgcaacctctgcctccaagattgaggcgattctcccacctcaggctcctgaatagctgggactacagaggggagccaccatgcccggttaatttttgtatttttggtaaagaaggggtttcatcatgttgccccaggctggccttgaactcctgggctcaagtgatcctctggcctcagcctcccaaagtgctaggattacaggcatgagtcaccgtgcccagccagccattaatgcatttttaatatatttttagtcaattgcagacatcgtacaattttccctaaacgttgcaacatgcctattcattacagttcagtatttttcaggattttttttttttgtaaaatttacaaagaaatgtggagatttaaacctgtcatccttgacatttggggcagaaactgctgaaatgaaggaggacttgccatcaaagaactggctgaaaggagttagcacaccactcctctgccctgaacagttctaagcaagaggaggagcctgtggcagggcgtgatatgaagtcctcagagatagagtgccaagagtagagggagtatcctggaacttcagtgtttgcagattgctactgagaaagtgccaaaccattcacgagggatccactacctagacccaaacacctccccctaggccccgtctccaacagcggggatcatatttcaacatgagacttcgaggagacaaatatccaaaccatatcgcccacgtttaggaatgtctctccatggtagatgatttgcaaatagacggtggtatacccattccatggaagcagggaaatatgtttgcacgtctttggttagtcctcttcttttctactgacagtgggcttgtccatgtgtcctgcatgatcaaaatgacaatagcaaacttgatggccacagaagattgaaaagtgcttgggcattgagcttgctctctcttgaagtgcttggagccctgagactgccatgagaccacataaatgatcactagctagcctgctggaggatgagaggtcacttgagaaaccttggctcacagcctgcttacaccagacacatggatgagtctgtcttagactatccagctccagctgagttgccagctgacttcagtcacatgagtgagaacaacagaaggacagcactgagctctgccaaaattgctgacctacagaatcttgagctaatgaatgattgtagctttatgccattaagttctgaggcagtgtgctatacatagcaaaagctaactgatacaaaactaaagatacaatggcacaaacatgaaaagacatgttcaccgaagcattgcctataatagttaaagactggaaacgactcagatgtccaccaactcaggagtggttgaacctactacagtgcattcaccccgtggaatactaagcagctccaacaggggtaggaaatttgtatactttcataaaatgatctttaggatatattgttaagtgaaaaaaacaaggtgtagaatagttaatagagtatgctacctcttatttaataaagggagaatataaatatgtattttgcttttatttagaaaatgaaagaataagaaaccactaaaatgattttttagaagaaagcaaggggacacagatggaagttagatttctctaaatttactttgttttgtagctagaactttagaaccatgtcaatgttttacacacgtcacgctgctaaataaaattataaattgtgtttattcctttacagaagcacattttctagccctgttatttgaaaatcagtaatgagcacccttagaatgcagattatagtctgctaataaattaagaaggaatgacagcattataatatcaccattttgctacttctaatgaaataatgaatctatgaaatgatcaccaatgtcctctaaatcattttggaaaattgatgaatgctttctaataaatggatctagttgacaattcagaaccaccttgatcaatcacaaaacactagacaaccatacattatgcacctcctgatatgaagcaataagaagaactaacactagtattctttaaaaaaaaattgatcctgactgtattcgggtctctatatctaccagtttatggaaattagagtgcagagaacaagttaaataatcccataggaaacaatgtctgaaaccctgtaagatcaacagccatgtttcttcaacaaataaattgcaaggaaattaaacgggtgatgattgtggaaagtcctctcaagggaaacataaactaaatgcaatgtgtgaaccttatttgaattttgttgtgaaagaatccactggataaaagtattcaatggacatttgggaaaatctgaaaacaaactgaaaattgagtgggagaggaaggtggtgggaaagggtgagaatatcctaggaaaaaacgatctggacatgtggaacttgaccagaacaaagccttccttgacagggcaagaggaggcgttgagtacaatgcagtgactgttcccagagtccatccttatccctgcttgctggctgggtcctggggaaggagagagctttggggataaagggaaagggctgactcagtaacctatgtaacatagtagagcgcaaggttgctctgagatgcctgtcgcacaggttcaaacacctgcaaccaaaggagacattattcatccacttgccctgctagattcagctaagggttcgggaggttgccaacttatatgtttactgctggacctgtgagagcatcagggctgctcctgagcttggagcaggcaggggtgcgcatgcagagaagtgggggccccctggattgtgaaggggtcctggaactcttgggttgggtgagtattttcaatcacacacagagccttgacttcaagcttccaggaattaataaaggcagagacaaacattacacttccgagattctaattaattttgatatggatttatgtgtaaagttggatgagtcactgattttaataaacaggaaagaaaatcttaaagattaatgtaatagctgagaacacaggcaccagaactttgatgcttgcttaatttttttctcccagcccatgtcatttggagaaaaaatatcaaagacagttacgaagggagaaaggaaaggggattatgcaaattagaagtgaacaggactaaatcattactcttgtgcaaatgagcttctccttcatgcgcttttcaggagtgttttagggctatatttgctgaggatacattcctgaaggtaatgagaaatggaagcatgatggaaagagcctgattataaactaattgatctttctaagtattactaaaggttaaaagggaaaaaaaaaagaaaaaaatctgaagtccagtaagaacttcaccttgtttacattaatatccatctttttgaaaaagtggcaataatgaattagtgacatacacactttgagcttccctttccccacacccagcctaggcagtgtcagaagtatagagcagtatggctatttttccagctgaccttcctagtggtctaagctccccactgtagattagaagtagcaatttagagaaagagaagaaaaagaaaagtcataaaaagtagatataattttttaaagtgaagagtgctctggggtcacacacagctcagtaatcctgaggtcagtcactgcattgtgactgatgtaataatacatttatatcttgatgacctcaaattgtcattaaatggttaaattaattttggtatatatcttttaaaattagccttgtttcctcattcagtggtaagtagtaaaaattcagcttgcactgtcttaaacaaagaaaataaaatattgactccagggtatatgatcaggcaaagctggatccttctacgcagagattgctatcaagaacctaacttactccattaacttgacttgttttttgcttggtgttggctttgtttttagggtctttctgaacagctgaacacttataatccaccctcttagcaacaccagctgaagtatctttcttttctactacacatccagaaacagttcttaagttgatgctcattggtccagattgggacgtgtatccattcccgaacccagcaccatcactctgattaacagaacctgggtcatataccttctctttcccctcaatcagattagtctcaaacccacccacaccactggtctgacagtgagagagggatggctctatgaactccgtgggaaaaaaacaaaagcacaaacaaaataaacccacatgtgaaggtttaactggggctggatgatccacttgcagagtggctcgcttacatagctggcatgtggctccttgccatatgggcctttccataaaacagcttgagtaatggtctcatgcaggagcatgattccctatggcaagcgtaacagaatttccacgtggaattgttcaaatatcacctcctgttttgagactctgatagactacttcattgtactgataggtatgacatgggaaaaaattagaactaataatgtatgtaatgaaaggaattacttgtatgtcatgattttctgaaatcaaagtcactggcattatgttggccaatttttggattttatctcaaagccatatttatgacaatccagtgaagtgagttttattttctccaatttgcagatcagaaaactgagaaaatgtctgctcaggtaattgttccatgaagcttaaatttgaatttaggctgttgactctgaagctttcactcctaaaattatatcagactatactgtctcatctatagcttttatttacaaaacagaaagctccattttattaggagaattttgaatatacaataacaagtagacagagtaattttatgaatcaatatgtactcaacacccagctgcactatcaatacttagccattaatatctcttctatgtttttctctccttatttattttgaaggaaatctcagacatcatttaatttt

SEQ ID NO: 4357 - DNA, 2185 bp, Homo sapiens
atggtgaggccagggcctgtcaccaccactgctgccaccgaacaacagagaaagctccaggagtacctagaagtcgaaaggaacttcaagtgccaaacactgagctttatctaaaagccaaaaataattgcccaaatctatccaagagaatgttatcaatcatgctgttttgcctgttaaagcataaggcccatcagcattaaactccaggccagacaagccaatattacaaggtcccagaagccaaagttgaagccactaaaactgggcaaaaggctgaatatgttccttctaaccaaactgtaagcctccagcagtagcttacagcagcacaaagctggatcattcaccatggaaaagctgtcaagaaaacccatggggtcacttaatgcacaggatttgaagactacaaagcagcagttaacatatcaaggaatgttaagtgtacagactccataggaaatgcccgcattgaaaattaatctttggttagctttctaaaagagattaatgaagagaatttgcctcaaaccttgtcagaccctgagaggaagccagactctcaattatgtactataaagaagttaaagaataactctcataattgaaccaagagcaatttggttcctcaacaagccttgggcagatattcagtgactagtgctgccctgaaagacagagttcataaacaatttgttggagaaacacaagtcaagcttctatcagtaaagtcatagcaactctctcaagaagatcttccaagactgggagaaaagcccccaagacagttccctctctctttgttcagacccttagtaggactcaagcatcaaaaataaaaaattaatggtggagggtacaaaggttaatagggttaattattaaagagcatgtataagttagtgaataggaagtaaaacataccaaaaccaggacatactccagtttgtttcagggaggatatagtaacagacatttaaacattaagcaagatcagcagtccattcaaccttgttttgggccttggtcgtgtgcactgcaaaaatcaaaagctataagccagaggctagtttgacagttggcagcttaaattcagtcattcccagcacccacggcgtaagagcaaatggaactaatggggacaaatgccacaacagcttacaacatagagcacaggcattggtctccaagctgaaaaaggctcttctgttttctaaacaagagagctcccaaaactcaagctggtaacacaatcatgaaggaaaaggagtgtcaaaagggacccaaatgaatccaaataccgaaaagaagacaatagcagaggatcaaaggaaacaactggaagaatgacagaaatctaaggggaaaatctataagtggcctcctatgacacgtaaaacagaaagaaaaataatagagaaaataaatattctggaagaccgttgaaaaaaaagaggaagaaaagaaagcacagcttcaactgctccataaaactaacaacactctgacagaatgtctgcagctcattgaaaggggtgtggtttttaaggaaatatttgccatattgtctagtattcctgaggctgaagaactgctaaattctggttctacaaagcaaagttgttagccaagaaaggcacctatgatgctactgggctatatgaaaaggccattaaaaatgaggcaataccaacacaagtgttacaggaagttgttcttaacattttgcaagacccaaacaaaaccatggaaggaatcacctctgactttttagttgctaaaactgacatgacatcagcagaagagctggccaagaggatggaatctggaaagtcttgttcttctcaaaaaaaaaaaaccaaacaaacaaacaaaaaggaacaggtacagcaacaccccaaataatgaaggcataacaggataatcatcctgatatcaaattgcagatcgctccagccctggaataaatggagtggcagaattgcaagacgtgaaacttatcactcctgtacggggttcagtggagatcaaacaagcagtatcccactacctggaaaggctgcaggaatgcaatttagtagtgacttctcttgacaagctattaggtgtgaaagaaacacagcattttatattttataaaaatgagattttgcctgtaacgttaggatttcaaatccttgaatca

SEQ ID NO: 4358 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcccacagtgattcagcttgaaacaaaaacctctgca

SEQ ID NO: 4359 - DNA, 768 bp, Homo sapiens
cagtggccccatctcagctcactgcaagctccgcctcctgggttcacgccattctcctgccttggcctcctgagtagctggggctacaggcacccgccaccacacccagctaatttttttgtattttttagtagagacggggtttcaccatgttagccaggatggtctcgacctcctgagttcgtgatctgcccgcctcggcctcccaaagtgctgggattacaggtgtgagccaccgcacccggcccacacagctctaattttatgtgaggcctcaagcaagcaaaggctccacagcaggaccaggctgtggtgcaagctgccctgccccttgggcctaatggcccagcaggcccaatggtacagggaatttctactgtgtgtgaaacctcttgcttttaggagaatcctagtaaaccccctatgaccttttctgacaagtacattccatttgaacacaaattgtaaaacctgaactgttgatgaatttgatgtcatctgattccaaaaaccataaaatttgactcatgcagcagcatttcattgttaaatgaaaatgtatatgtaagactagcccaagcagttcctgaggacacaattaaaacatacaagcggccgggcacggtggctcacgcctgtaatcccagcactttgggaggctgaggtgggcggatcacgaggtcaggagatggagaccaccctggctaacccagtgaaaccctgtctctactaaaactacaaaaaaattagccgggcatggtggcgggc

SEQ ID NO: 4360 - DNA, 776 bp, Homo sapiens
ggcagcagcaagctgattacacagggaaaagcttctatctaaatacacatagcataacaatcacccctggaaaaactacatggcttaccaaaagaggtctctctgttcactgtccattatctgttgactgaactagttcaaatgaataacaagtaatgatcaaattgccagtttatattttacaacagagtcttatctttaaaaaaatgcaaggaggaaatacaaaaatgtaatacatttatcttgctttcttttctatttcctcccctgaaattattactatgctattggaagccatacaaacacatatatacacaaatatacatatgcttcaatgaaaagcaggcatgcagctgacagctcggcaaccctgagcacagaattttgaagagagaatacactaaaagggaagaacataactacatgacatcataagaagtcctgaattagaagcgtatatttgaaaggtcatgcatcctgagctgccaacagcttaacaaccagaggcagaggccagctttgccagctcactgcttctactcatctttcatgatagtagccaggctgaatatagttccaggatgataatgaattggctgggcatactgtttatattagtatgtatgttcctgtactaaaccaagcatcatgaggccagcactattttgccatttttcagaaaaaaaatatgaacccttcaaaacatagtaagccttttttaaagtatatatttgattttgaaataatcaaaatatatgtagggatatgactgcatc

SEQ ID NO: 4361 - DNA, 1216 bp, Homo sapiens
gtatttttagtagagacagggtttcaccatattggtcagactggtcttgaactcctgacctctggtgatccactcgcctcggcctcccaaagtgctgggattacaggcgtcagctaccgtgtccagccgaaacatgaagtttcaaaatgccaagatgtatcacagaagacactcagcagtcagccacatttatcttggagaagagttccaggacttaaatgtttgaatagtataaactagttttttaaaaagtctgcctgaagccgaagattaaatactttaaaaagttcactgggtgatcttggcatgttgacattatcttaacagtctaagcttgttaccttacaccaacctgacaggttcattagaagcacatgaatacatataaaaggcataaaagactgggtcaatgaatatgagctctgaattctaaaattcctttgcatttctaggcagtacttaccatagtatgtttacgtacctggtgagtgacaatgctcaaaaatttctgaagtattcatccacattatgctagcgaaatgtcaaattgtcctttaatattcaaatgcatgaaccatcactccttggccttttggccaagatcaagtgtagtatcaaatgcatgaaccatgaaagctatcttaaaaggaaagtaacatttaaaggaattgaatataaaccttcggttaatcttgctagcacgtagtcaatacatcagtatttttctgccccttttatagtcttactggaaatgactgtaaaacagaaacaaagctaagccatggtaaatagaacattaaatgcccaacctaatttattttgctaagagaaactgatgaactaaaagagaaacaactattgtctacattttagatatgggggaaaaaaccctgagattactaattatgtatcaccatcctcttaatgtagatcctgaaaatgatggtatcaatataatacatacagtggattcaccttttaaactggatctattacctttgatatttgtcttacactgaaaaattctgacatcttcaggaaaccaatatgatggataagctaaatgttgacttaaaatagttaaaccccttaataacatcctttagtttctattatttcactgcttaagttcagcatctgaataacaaaggtaacataagtagtacttaagatcccaaaggcccattacattctatcaataaagacaaaacaaaac

SEQ ID NO: 4362 - DNA, 3735 bp, Homo sapiens
ggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaa

SEQ ID NO: 4363 - DNA, 1250 bp, Homo sapiens
gggctcgcctgtaaccccagctactcaggagactgaggcaggagaatcgcttgaacctgggaggtggaggttgcagtgagtcgagatcacaccactgcactccagcctgggcgacagagcgagactccatctcaaaaaaaaaaaaaaaaaaaaaaaatatatatatgtatatatatatatatatatatgtatatatgaactaatttatttaggcttaatctctaaaatttcagcctgatcttaaccaatgaaatttcaaaaacaaaaactgtacttcagtctacaattgaatggaattcagtgtagaccagtacaatggaatgtactggctgagatgggagggtcccttgagcccaggagtttgaggctgtagtgagctgtgattgtgtctgtgaatagtgactgcactccagcctaggtgacatagcaagatgccatctcaaagaaatatagatatataacataaaataaataactttatacatttcctggaggaaaagtactctgtaaattcaagagatctgaatcaaattactcaaccttttggaatttgatcctctactgtaatactcatatgctagattactgaattttcagagtgaaaaaaaattgacagggtaatatataggccatattatagtgaagatcataagtataaatgtcctcgtttaatctttccatattgaggacagcctctgcatataaaaatgttcattgggagaaaaattatttttaaaactaaatttttatagtagtcctccattactggcaattaaggagcaacccacaaaatgtcattatgtggttctttgattaggcataaaaagtattgcaaacagcttttctattcctttggaatatgaatctttttaatgtctaaagttaacctgcaacattttctagtaggacaagtcaatgtaaattaggtaatttttgcctgttttataccttctgttgcattttgttcaaatgaaaacattttttaaaacatgattgaatttttacttctcagataattggtttgagtgtggaatttcttttttaacactttgatatgtaagttagtgtaaattaatacttttataacactactaggctttatatttttatggaatgttttaaaatttgaaatttttgaagtgttaatttagcagtactttatcattatgtgccaatactgacaagaaaaacaattttttatgtatttaatatactatggtattcaataaattctattttaaaataaaatt

SEQ ID NO: 4364 - DNA, 15820 bp, Homo sapiens
ttcgttcttccgctcaaatcctgatctggtccattaaagagtgttcgcagacaaagtttctgaaagattagagaagaatcccccccaagattgccccaacactgaactacagacaaacactattttatttaaataaggagacagctttctaaaagtatacattctctaataaaaatagtttattattttgaatgatttaatggttttctacacaatttacatcacaacatgtaaattttagcagtaacatctgattctaacagcacatcatgctattcctttcatagagccttcagagattcaatgctaaacaaatttccttagttggcatcaaggcactgatcactttagaggcttttaagaaattatttaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaaagtgccatggttgatatttaagaactccacagctcttaaaaataagcacttatccctaacatgcaatactgcagatgcaagttaaacttatctgttaacagctgcctgctgttttctgctcccagatgaaatgaagcaactcttctgataacgaagagatacctctatagaaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacaggccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacaccagccatttctccaatggacatctcttccacagacctcaacgtgagaactgctctagtttctataaactgtaaacctgtggtggtctgattatcctgatattggattttcttgttttctgttacaccttgagtcatttgctttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaagatcgccttcaaattattttaatcacctacaacttttaaactaaactttaagctgtttaagtcaccttcattttaatctaaaagcattgcccttctattggtattaattcggggctctgtagtcctttctctcaattttcttttaaatacattttttactccatgaagaagcttcatctcaacctccgtcatgttttagaaaccttttatcttttccttcctcatgctactcttctaagtcttcatattttctcttaaaatcttaagctattaaaattacgttaaaaacttaacgctaagcaatatcttagtaacctattgactatattttttaagtagttgtattaatctctatctttcaatttgaaaagggttaatttccttaatatgtaaagagctcttattattaatcagtaagtatacaacccaatagaaatacaaatccaaactacaattaaatactattttccacttctcacattgacaaataaccaagtttaagggcacagcctgggtgaaggtgtggggaaatgtcaatgggaccaacctccttgaggtggaagctgggggtgtccatcatatttagaaatttacacatgctgtgcccagaattcctcctgaggaaacttttctctcacagatatacttgcccatgtacataaaaacccatgtacacagatatgcggtatagccttatctacagtaaaaattgctgaaacaacttaatggttccccaaaaagggaatgggtaattcaaacacggctaccacacagatgttgaaaagaccaaggcagacatgaatacagatatgcggtgcttacctagatgtactagtaactcaacagtccacagtgcaagacaggctgtgtggtgtacccacgcctgtacagctttacacatacacaggttctctggaaagaaactgcagcaactggccatgacggtggcctctgtgggaagggaggctgggggttagagaaagatgccactgaatcacccacagggtttgaagttcaaacatgtgcaggtatggctttgaacagttttcacacatctattcataggtgaaattaactggaaggaaactagcaaagcatttgcctttggggtcagcacaggagcagaggcccaggcagggccttgctttgacacacagatgatgggtcacacagttgtcaccttgacagaagagtaacagggacagcacaccagtcactctaggagctgaggccagaggaactcaggtatttccttctagaggtagtaagtccaccgaggcagatgccaagccgggtggtgcctcgctgtgtacaatgttctgctccctgtgcccctatgagtgaccctatgaggtaagagccagagccgggctcacacctgagctcctggcatgtggcggccctttagaagacagaaagtgtgtgcttagcccctgaagcagccacgctgtgcccagcggagggcaggcgcagacagcactccttcccagaccaggatgccacttaagatttcaacaaactaaacagacaagtgaataaaagatcattaaataccactttttacaaatgtcacagacgctttcctagaatagtttgtttttggtttatttaatctgtgtaggggaaagaataccaggaattagactctggggcctgcaggacccactactgttttgtgctaagccaggcaccgtgttatactcgattccggtatggacaggcagctgcagccactacgcagttttaccccagttccacggcacatgaggagaggaccaacattattctattttggcagcacgtgctttcaacccatctcacaaaacagtgtcaccaaccagatgtgccaagagccagagcaggtgaagacacctacagatgctgcctcctctggacactgcctctgggtgcctcagctctgcacccagagggatgcaaaagagatccccgcagcacactttgagatggctaggaaactgcaaataacctcaaagccatcactagaaaaatggttaaaatgaccataccaacacgtacaatatgacatgttatagagccataaaaataacagtacaccttgtatgattccattttagggcagagaataataggatacattttagtacatccacagccagaaaatgtctgaaggaatataaatgaagttgtcattagtagttatcttaggggtccgggattatagaggaacttttatcttctacatggcctttttctatagtgtttgaattttaattacaagaccagtgatttataaattcatacactccacagccccatccattacaatagcacataatataataacattagccatggacttacctaaatctgcataattttggtctcttcaggacagttgctgcaatgcaggcataagcagaggacaaagccacagtgtgacctgggtgcagagcactgggttgggcatcaccagcagacacatgacaaaagcaatttaaaaaattataccttgacaaaattatacatgattatatgtcttggaccctgggggccttgtcagcattaagcccatgaatgctaaattcacacacagatgacaagaatctactgtaccaattacagtcttagtaggtcactgcatacatgatagatcaaagatggcaactagcagaaacttaagtttcatatatggagcgtcgtagaggatatgaacaacagatactctcatacttaggtatgcaaagctggacacccactctggagggcaacagggcagaatggagaaaaatgtcggactcacgccctatgacccaggaatttcacttcttggtacctaccctgagaaacactcatgcattgtgcacaaggggttgtgtatgacgatgatcgcacagaactgtttgtaatatcaaaagattagaatactgtaaatttccattaacagcagaatggctaaactcacagacatacagtgcagaagttgaaaacaatgagggcagttctctgtgtactcccaggcatctccctactgttaaatgaaaaaaagtaatcaataatgtacaggacacaatagcattttaccacttctatagaaaagaaaccatgcaacacgtttttcagatacaaatggaagtgaataaggcgaggtgtagcaggaaacacagcaaactggtaacactggttacccctctggagggtgggggattggtagtgccaacgttgttgtcgtcacctttcaactctgtgtaaggagaaaacacccacatatcacttctacaaggacactgagaaacagtgttgttgagaggctgagaggcaacctagtcaccatggatgggagaactgataaactaactgaggtatagtcacatgatgagctctatccagtaaacaaactaaatgaactatcccctgggcaagggctgaatcttaccatggtattaaatgagaatgttccataagattacatgcaaaataataaattttctctaagaacagctaaaatataaatatatactctgaaaaacacatttagatcagattcttttgcaaaattatatgaaaagaaagcaagtgagagataaacccaggattcaggatgattattaccttggcctagggggtggcaggaggcggcaggggaggcgggtggtgtgggaccacataagtggaaggtgtagtaaaatctcagacttcactactgtagaactcatatatatgaccaaaagccatttgtaccccaaaagccattgaaattaaatatatatatatacacacacacacacacacataaagaaaaaaaaagaaaattataagaagttaatattgacagacctggaacaaaaaatcaaagacagtatttagtcattaaaattttgctatttcaatttcatcagtgtaaataattaatttaagtggagaggagtgttcattgtaaccataggagttactgtctgtattgtcctagtttttgtattggataggagattcagaaatgcttaccacattattaaaaaacaattaaagaaagcaagtaaaagagagccatgttgtgtcctgaatcaaagattaagattgagatttacccagttctgtgtatttgagttccaacagagagaatattcttgccttacaggagtgttctagcctccatttaccagattttaaagcataatgaaaagtgatgatcattacattccattgcattttattaacaacaacaacaaaaactggagcctaaaatttccagaaatagatccagagagaaaatgttaagaaccatttgatctagcaatcccactcctgggtatctacccaaaggaaaagaagtcattataccagaaagacacttgatggcagtacaagtcacaattgcaaagatgtggaaccaacccatcaaccagtgagtggataaataaaatgtggtatctctacaccatggaatatgacttagcaataaaaaagaacaaaataatgtttgtggttttttttttttttgcagcaattttggatggagctggaggatattattctaagtgaagcaactcaggaatggaaaaccaaatactgtgtgttctcacttataagtgagagctaacttatgggtacaaaaaggtatacagagtgacataatggacactagagactcaaagtggggagggtaagaggggggcaaggtataaaaaaccacatattgggtacaatgtacactactcaggtgaccggtgcagtaaaatctcagacttcactactgtagaattcatctatatgaccaaaagccatttgtaccccaaaagccattgaaattaaaaaaaaaaaaatacacacacacacacacataaagaaaaaaaagaaaattataagaagttaatattgactgacctggaacgaaaaaaccaagacagtatttagtcattaacattttgctatttcatcaatgtaaataattaatttaaatggagaggagtgttcattgtaatcataggagtacatacatgtttagctactaaagaaaaagtaatcagaagcaaattcaatggacttatcagttattattattagacttatcaaagacttatcagactgatttttaaagtcctggtataataggtgctttttgcaccaacaataacaggaaaaatggaggataaggtttacaatcataagtggcaaatgtggccttcccaatgatactaagagttcatgatcattataaaggtcaatatgagaatttcacatggttagtggtcaaagaggaaaaatgcagagagaaactgtggtaaaatagaaaattataaaaaccattcgatccagcaatcccactactgggtatctacccaaaggagagtaaatcattatactaaaaagacacctgatcatagcacaattcagaattgcaaagatatggaaccaacctacatgcccatcaactgatgagtggataaagaaaggtgagtacagaaatatagactaagacaactaaaataccttaaaagtaccttataacgttggatttggcaaggatttcttggatatgacaccaaaagcacagaccacaaaagtaaaaacagataaattagactatttcaaaactaaaaacttctatacatcaaagaacacaatcaacaaagtgaaaaagtaaccttatggaataagagaagatatttgcaaatcatatatctgataggggattaatatccagaatatagaaagaaactcctacaagtcaacaacaacgataactctaataacccaatttttaaaatagtcaaaggacttgaatagacatttttccaaagacaacatacaaatgaccagtaagcatatgaaaagatgctcagcatcactcctcattagggaaatgcaaatcaaaaccacaatgaaatgtcacctcacacccactatgatggctgcaatctaaaaaaagcagaaaataacaagtgttggggaggatgtgggaacctcggaacccttgtgcactcttggtgagaacgtaaaatggtgcagttgctatgaaaaactacagtggttcctcaataaattaaaaatagaaatatcgtaagatttagtaataccacttctggctatatactcaaaagaactgaaggtaggatctcaaaaagatgtgtgtacattacagcattatacttgtaaatacaataatatagatatttgtacatagcaccattatttacaatagccaaaagcaacccaagtgtccactaatggatgaatggataaaaaaaagatataaaataagaatattatttggatcttttaaaaaggaaggaaattctgacatatgctacaacatagacgcatctcgaggacactgtgctcagagaaataagccagtcacagacagacaaatacttcatgatttaactgatatgaagtgcttggaatagtcaaactcacagaaacagaaagtagaatggggttgctgaggctggagggaatggaatgtttaatgttatttaatgggtacagagtttgttttgcaagatgaaaaagttctggagattggttgtacaacaatggcgacatacttaacactactgaatgtatacttaaaaatgattcagatagtcaacttctattatatgtatttcaccacaaaaatttcttaaagtagcaagaaataaataaaattgtaaaaacctgatgttagtggctatgtagggaaatggatatcatatactcacaacaggaagtgtagctttctggagtcatttgagtctgtgaagagagttataaaaccataagtgctcactgccgaggcaatgccactccaggggatacatgtgtacactaaatttacagagatgctcacagctgcacgatttaaagtagtcaaaacagtttaacagctcaagagatgggctacatatcctttagtataagcacaatggcataaaatcatgcaatcattcattcatgatcttttttgagcacgaacaagcagatgaaagttatgctttccacagaaaaatacaatttcagagcatttatagacttctagaaacccatccatgggacttcctttgggaaggttaagaatcctgagaaaaagcctcttcaaatgtgtttgtgaactctgccggtacagggaaatactactggaaacaaaattaagtgtagaaacagaccagaccagaatatacatgctgattcccgttacatgaaaggtccagcgccaggcgggcaggcagccagccacagaaaagggagaggggcccaggaggaagtggctagacctgacgctaggcaccaggggaggcggggaaggagggcagaggcaggagagttcactgtgagagctcaacaaggagtagctgctgccaaacatctacattcatttacccgcatttcacagacacaggcttggggaggttaagtaacttgctcccagacataaagttgccaagtagtccagtcaggattcgaaccagctccagtgccctattaggtccaaatccactcagatggggaaatggagagtcagggacaagcaacaaccaggggcccattcaggaaacatcagcctgccctcaaggtcttctgaattgaaccctgccactgtgacaaccaccctcacaggacagggctctctggccacaggaggtgggttctgagagcaccatgcccctcctcacacaaacacagattccacaacacacaccacggggaagaaggtttaaatgtaaaaaacgaaaccatacaagttccataagaaagtatggattaatatttatgtactcttggggtggaaaagatctacacataacaagttcagaaaccacagtgataaactaacctaagaaaatcgtttaacttttatctacctgaaacacaaaattaaaaggcaacctataaactggaaaaaaatatttgcatcaaatataacaaaagattatcaatatccttaagatgtaaatggcttttgcaaaacaatcaatagaaaaatgactaggaattagaaaatcatacacacacacacacacacacacgcacacacacacacaccacaaatggccaattgacacaaggtagagatgttcagtcaccagcagacaaagcaatgctcacatccagagggaaagcagactcgatccgtcggaggagcaaaggttttcaatgtgataaagccggttctgaggaagaggggaaggcatcaggtttgcctcaccagtgagaacactaattgaaaaaatccctccctgctgggcagtttagcaatatgaacctgaagtcttaagagtttaacagtcatttccttctcgaaatgtatgtattcagcattcccaaagagataacaacagacgtgaaaaagtctgagctacaaggaaagtcatcgcaagtattattttctaagaggaaaaaaaaactagaaaataccctgtatgcccattgaaacaagattgtttaaattgatacagccatgcaagggaacatcctgtcatcattaaaaaaggtgttcactatatattaaagtcacaaaatagaatttatggcataatcccatttttgtttaaaaatgtacttatcccatgcatacaaaagaaatcttccaaaagcaaatgtgcccataacaattgttactggtaagattactgaggacttttaaaaaaaatttccttatttgcaaactttacagtaaactttttttttttacatattagaactcaatgaagaattatttaaaagagaggaaaggcagtgcagggctggaggtcctggagggtggcggcgggtcgtcctaactagcaggctgaaaggtgctggaggggatgccttcactcagaggaagttcacagccacctgccttggaacatgtacctgttcatcttttcgtaatgttagtattcattttgctatcttcctgttgccatttccaaacagtgtcagtatgtttttgttaaatacgaacatttaaaacatatcgtatctgtaagcctatttgggtgtcttcatttcatgcccgcactgcaccataatgagtaccacacaaagccagaggatgacacttcctccagaggtctcactgcacatggagaggttagccctggcattaagggtccttggaatctctcagcagtcatagtcagtcagatgcaccaagggcagctgagtcaatctcctttttgtaacaacaggccgttcctgcggttctcagtgctgccaacctgggcatactgaagagcctcaaccaatactggctctcagggtactttcctttttaaaagaagttcaacttttgctattcttatgccccataacttttaatttgcacaagatcagccatgcccactcactgaattctattatattacccacacctctggaaattcacaaagtctgaattcagatctatgcataaggatgcaaacggattagcaataattgctggcactgccatcaacacctcctgtcgatctcacctgatctgaggataaatgaaggcaaagaatgtggccccagcccctggattggagtggaggcaaggagggtggcgagctgtcttcagcagtcggcctcacctctctgctcctgtatcaacaagtgccatttcatccccacttccaatccccaacatttataccccgtgaatcaattcttcttcagcatgccagttgctggagacagcaccatttacatacaggcatctatagcagttatcttccagggtggaagcaagagttttgtaatcataaaaaacaggacgagaaacaaggagttctgaaaagaagagaaggcggttatagaggtgctggggtaaaaagcaaagcaaaggggtaagataggaaaggaggcctggattgtttctggggcatccagggaaaggagttgcaagcagaaagaggaccctggattctgcacacagcagtgccccatcttggagatgccatgagcacagacagaaggtttactaggtgggcggcacagtgacttctccccagcactccacccgtttgtcagtagtgtacacgtggaggggtcaccaagatataacggcacaggcaaataagacacagttgcaaggacggcaaccagccctgcagctcatgggaaggaaagaatccttcaggtcatgatcccccaccatttgtgttggtccccctggctagtcccagttcagcccttatctccccttctcaggcaaacaggcccaggtgagtagaacaagcctcccttgctgctccctttgaaacaagcaccttccttctcagcacagaggctggcagtggcttccattctacgcccaaagtttgtctcctgtaagcaaaaccttacaccccaagaggtaacacagaacagcagtgcaaggacagaacagtcccacccaggagacagaggcagtttgcaagccaagatgtatcctccagattccacgtgatcctgctcacacctttgcacagcctctgcttgcttactgtagcacgcacacagggaagcccagacgttttagtcactcaccaaaaggaaaaaaacaaggcaaattctttagtgaggtaagaattacgcatacacttagacccaaatcccaggcacattccagcctcccaaagactatggaatatgcatattatgtgtccatttctgtttttattcaggctttcccctaaccaaacaaaaataagtaccacttagaactctaaccaggtaatgttttaaaatattatggcaaagtactccccacctacacacccaccttcattggcttgagtggtttcatcacatttcaaaccaatgattaccaactctcaacagagagcagatcccatccccactcagcagtctgcagaccacttgggataataccagttctatctgtggttaccatgctctcctacatggccttaattacttggagctagcaaatctagacctaaatctacaatatgaagatacatccaaagtcgttatgaaggcaatgtgataggggtcgagaaatgtaacatagcaatacaacaattctaatgagtttagaactcaaactttatttgtgctgtaaaggggaagaaaagtgattagtaattatgtacatgacgtaacagaattagttcttaccatacagagcaacataccagtactttcaaccatctacttttacagtttcaatttcacaacagcatacccgagactacttccccatacatgcgtgactaatacactctaaatcccaacgacagtaattgtttgcatcatccccaagtcattggttaagaactgaactaccatgtcaacatatttttaaacatttaaaaaatggaacccagaagacagaaagatcccaacgataaaaataaccatgatttttaaaatttcaagtgaaacttaaagggaagaaggaaatgataaaaagccattggtattactttaccaattcaatagacgcagctcagaaccaagcagggttttcagatcacacatgtagtaaaggcacctcgcccactctctccccacaatccccatccccttccctttttaggtcttgttttccaaactgattttaggtgatagtttcccctctagtcttggctcatttaaaaagcacaaacattcaaattaaaaatacaataaattattcattctaaccttagcaaaggtacatggattctgtctaccaaatattaattttacagtgaccacaaaaggttatttggttgttacaaagactacaatttgaagatactagataggcaaaaattttgccattattaatatcgaccaaacacagaaaagacaacagatgtgtttctaaggcacgatttacatactaaattcccttgaaattcaatgcaatttcacttcgctcatgattttcaatcacaagacacctgtgacaaatgaggaacaaatccagaagagcccatctaatctcgtcttaagagacctgccatttctcacacacagatttaggaatgaccaacttgtaccctcccagcgtttagcacaacacaatgacacccttaatttgacaatctgcttcctctaatatatccccagtctaaggcatttaaaattaaacagctcttcaacgccccaagttatttcatcaggctaagaacttctccgagaaacgcacaagaaggcaggcaaacaggtgggtaggtgagaggtcacggggctccatctgcaagctccatctacaaggcatcaatctgcgttgtggcatcaacgttaaaatgttctacagcttagggatcttcttgaagcaaggttccaagcacaaaactagtatgaccggaggctcaatttagaagatgcagcatctgaaaacctttaccccaggaaaggaggggtgcctgctggcattcatgggctctggaacaagcatttattcaaagctgatggcccctcgagccggatgcatctgctgtggactttttaagattgccccccataagctcatctgcaaactttaaatggtagcctcctgaatacagggcttcctgagcaaggcctggaaacagaacattggagaacttcctcctcctaagcctctggaaattcaatctgcaggcatcaattgaggcgggctctctcctccagggtctcccctcctgcaatgctaggactcacggctgctgcggcctattcctcctgactcctccaccccttctacctctccctgccttcctccttccacacagaccagcgcacccgggctcgctcagctatgcaagagcggcgccctcccagaggtcaagttccccctccaccaggcagtagggacagcctggcctggagcgtggctgttctgcctgggggaccctgcggatattttccatgcagcctgccccactgtggtccccctagacctagtctccttgccaagcttccttctcgcacccccagcccgccccctcgtctcatctaactcagtcatctctccctgtctgtcccctgaagccctgagctagccacttcctcccccacaactacacccaggcgcgcatccctccctgtcgctaactccggctggacttgccacaacttttgcttttatagccctcagccgcgtcaccggggtcattgctcaacgggacgattcctccacggccaccggcaaaaaagtccctccccgaccctgcccggagagactcccgggcggtgcatggtctcccaggcggcccccacgcaaggaccccagtgtatccccgcttctctttaacagtgctttttgggatcgcggacagcgctcaaggtgacatttgggaggcgaatgccatgaggaagaagaccccttttcttcccggatgttgttgaggtcgggcgggggacgcgcttccccgagaggggctgggggcgtggcgggcgggggcgccctcttgagtgggcgacgggagccgccggggtcgcttgaggtcaccacgcccagccgaggcccgaaagaagggccggcaggacatctggaaaattccaggcggcggcggagggatctctgcagagggc

SEQ ID NO: 4365 - DNA, 2158 bp, Homo sapiens
aaaggcagatgaataaggaccaattgtagagctgcattaaagaaaaatgccaaaatcttcagaaaataaggaatctgccaaagaagagaaaatcagtgacattccagtttctgaaggaactccaagacatgtatgatttcaaggctttgcaaagattttcactggctgtcttgcagcagttactggtggtatgatgtatgatctctacttatctgtataccacgaacagaaattctggttttccaacaggcaggagcttgaccgggaaatcacatttcagggtgacagtggcatttattactcataaagatgtgttaaaggcgccttcatttgaaagaggtgtttatgaactgacacacaataacaaaactgtatctctgaatagcataaatgcagtgtagcaaatgtttctatatccagaacctattgccagcgttttatatcaagccactggtagcaatgagattattgaggtggagtatttctatattggcattgtttttggagtgtaaggaatatatgttattgctttgtttgttacaagttggcttatgaatggaacgtggctagcaggaatgcttactgttgcgtgggtcattattaacagggtagatataatacaagaattgaatactccattcctttaagagaaaactgggcactaccatattttgcatgccaagttactggacttacaggctatgagaaagcaacttaaatacttatggagagaggttttgctacttgctgatgagtgcttcaatttacacatttatgatgatggggagtacagccactctcccgtttcttcaagccataactctgttcctgctagatatcttttcactggagcaaagtgatgaggtttatgaagtttataaaatctatgtattttctctcttcctgggatatttactgcagctagagaatcaacctttattggtatcttgtttattaagtttggtagcagtctcaatgcttgctaagtgcctttgctgaatctaaagaaaggaaactttgtagctaaaataatgaaagtgattaatttttacttggtgtgtactctaacagtgacattgtatgttataatgaagatgtttgtcctaaacagagaaaacgggctcatgctgaaattccttgaagttaagtttggaccaaatatggctaagaattttacaatgaattggctcctctgtcaagaatctctacaggggccatctcaggattttgtgtgtgtgtgtgattgacacagtcttctttattacccttttatattttagtgttaattatttattttgttcctatgttgcaagttatttttaggaggattaatggtaaatccctgaaagaagctgttactcttgaagatgaacgaattggtgacattattggagaaattatttcataattcacactattttattgggttctcttgtgatggttatagaaggcttgaagtacatctggattccttatgtgtgcacgttagcaggatttggtgtacgttcttctgaactttgaacgacacttttcaagtggtgctgattaagaactgtatacccaatgtggttgtctctccctgagcatggctgtgcctactatagtaggtctcagtttatagaaagagcttttttccaagattaatggcacaattaacggagtgacaggaattctacgacccaggtacagtggaacttatgacatggataaaaaggccagttccagctgcaactgtgtttgcagggagtccacagttaatgggtgcgatgaagttatgcactggaaggctggtgacaagtttgcctctttacaatgatgatcttctcaagagaaatgaaaacatctaccaaatacatccaaagcgatctgctgagagtatttataacataccgacagccaacaaagctaattacctaatggtagaggatactatctgcaatgagttgggaaccagagaggctgtagggttaaagatttattagacattgaaaatgaccacatggtttgcaaagaaggtgacaagctaacctactcaaaatatgggcaattttttcatgaggtcagaattaactgttctctatgtgtgaattatctcactagagtatactggaacagatcctactttgtacacaaaatcaacactgcgggccacgtgcag

SEQ ID NO: 4366 - DNA, 976 bp, Homo sapiens
ttttttgtagtatggaagttgtaaagctgtgttttaataggattaccttaggaataagaggactgctttttaaagatacgagatcccgctgccttggcaattctgttatcagaaagatagtgattttgatacaaaacagtaagaaactgtagaattgcaggacccataatcctcacaaggaagatttagagagtgctgtgtgtcaatcactcatcagcacctcacagatattatctcaattcgtcctggcaaccatcactgcccctacttagcagtctcagagaggagactcaactcacacaggggccaagagctggaccacggccaaccaggggcagcagaacgccacagtggttgagcatgggctctggtgaaggatggcgggggttcaaatcccagttctccacctctctgcttcgctccgattcctgggcctctgagctggtctcctccgctgtggagtaacagtgtgactgctcatctgcacagattccttctgtgctggacacggttccaactttccaactactcccgcaggagctcatttagtggagacaagatcttgctcagtgtcatagtgaggaagaaatggaaatatctgtgcagggcccaagcccggcctggtgcgggagaggcattaataaacgcagcttgagttcagaagcaggtggtctgtggctcactcagcctggcttcctgctgggtcttcacagtgctgggctaccttcctggagagaaccaaagtccaggctgtgtagatgcctgtggtccaccagcgcaaagcagcggcccatcaggacgcttcggaggtagatgcgtctgagttccatgacatcggggacatggccccactcctgttctggaggtcacgggcctgctgaacctcttgtaccaggtcagccaccaggttcatctggcaggacctgagagcccccaccaggtgggccactgttgcgttctccttctctgtgttctt

SEQ ID NO: 4367 - DNA, 2316 bp, Homo sapiens
ccaaataggggcaggtggcccctgggaaggtctgagctgagggatacaggggacctcccaccattgccggataccctgttcttgacaagaagatccttttccccagtgccaagccccttggatccatcagagaaatagcctcgggccttgtcctttttcacaaccccacttcaaaatcatgtcatctccctggcctgatcccgctctaagctactttgaacaactaggaattatttttctcagaggctttttgggcattatgaaatacatcctgatacatccagggcagtatacccagagctccaggcagagagtgatggaatcacctcttgtcactcactagccttaggcccttctgcaggttagcctctcagtctcttccttagcttccttagctaccacccagggattgtagtaacgtccctggcacctcttgtgggggttagctggtgcccagagcctggtaggcagcaggcctggtgtcatgggggctgctgataccacataacatcatctgggttacatgggctcctctgccatcatgattgataggaacagaacctcagccaaaaagcttcctgagctgtaggggctttccctgaggcccaggttcacctggcccctttcttccttggtcatctctgcctttgcccacagtgaactctgacttggttgttcagtgctgaatatttctttcttaatgttttgaataggtaatccattcatgtggttcacaaatcataaagtagttaaaagcctttcttgagttcctgatgcctagcaagctccgctcctcactccatgaatacctactattggtttgttccttgggtatccttccagagatcatttatgcatgtacacacatgtgtatgtgtgtctatataatttttctccttttctactcatgtgataccagacaagtgtattcaaggaacgctcctactaatgtgggaagagccatcccagaaatcagaatacaaaatgtgaacccagaattgggggatgtttttgcaatcacactcctgttgagtaagacatattttcattttattgcaacatactgaaattttagttttctgtacaaatcagaatctgcagtccctcccttaccccaaagtgctgggattacaggcgtgagccactgcgcccggccaataatttttttagtttaagttcatttttgtccccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttg

SEQ ID NO: 4368 - DNA, 2321 bp, Homo sapiens
ccaaataggggcaggtggcccctgggaaggtctgagctgagggatacaggggacctcccaccattgccggataccctgttcttgacaagaagatccttttccccagtgccaagccccttggatccatcagagaaatagcctcgggccttgtcctttttcacaaccccacttcaaaatcatgtcatctccctggcctgatcccgctctaagctactttgaacaactaggaattatttttctcagaggctttttgggcattatgaaatacatcctgatacatccagggcagtatacccagagctccaggcagagagtgatggaatcacctcttgtcactcactagccttaggcccttctgcaggttagcctctcagtctcttccttagcttccttagctaccacccagggattgtagtaacgtccctggcacctcttgtgggggttagctggtgcccagagcctggtaggcagcaggcctggtgtcatgggggctgctgataccacataacatcatctgggttacatgggctcctctgccatcatgattgataggaacagaacctcagccaaaaagcttcctgagctgtaggggctttccctgaggcccaggttcacctggcccctttcttccttggtcatctctgcctttgcccacagtgaactctgacttggttgttcagtgctgaatatttctttcttaatgttttgaataggtaatccattcatgtggttcacaaatcataaagtagttaaaagcctttcttgagttcctgatgcctagcaagctccgctcctcactccatgaatacctactattggtttgttccttgggtatccttccagagatcatttatgcatgtacacacatgtgtatgtgtgtctatataatttttctccttttctactcatgtgataccagacaagtgtattcaaggaacgctcctactaatgtgggaagagccatcccagaaatcagaatacaaaatgtgaacccagaattgggggatgtttttgcaatcacactcctgttgagtaagacatattttcattttattgcaacatactgaaattttagttttctgtacaaatcagaatctgcagtccctcccttaccccaaagtgctgggattacaggcgtgagccactgcgcccggccaataatttttttagtttaagttcatttttgtccccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttgaaaaa

SEQ ID NO: 4369 - DNA, 535 bp, Homo sapiens
cagcttgcgcaggagctcctcctccgtggtgcctgacgacaaggagtacgaatggtcggagccagtatcagggaagccctcttcccctaccaccaccaactgggggcccatagggcactcggcagcctccagccctgcggtagcagcctgtaactccgacgcggcggccgcagcggctgcgccctctgcggctgcaaactccacttgcactgtgagatcgatgggcttcacgtcttctccagtgggagtgatgggcgccggctgtacggatcccggagcctgactgctgtctacagtggcctgaagggtgagaagcacggccgcggaagcagataccagtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcct

SEQ ID NO: 4370 - DNA, 2096 bp, Homo sapiens
cgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtg

SEQ ID NO: 4371 - DNA, 457 bp, Homo sapiens
attcaaatgggccctgctgccaagccttttttttttttttttaacaatgccatctcttcatattgttccatttaacaaaactgcagcccttcatctatccttaagtcccttggccagtggtacagagccagagtatgctactccctagcaggaaatcaacaggatgacctactaaacaccattcagaagatgctaagacccatgaattgcaacaggaaagaaaagacagagaattagtcagacaggaatcaaggttccctagagaaatggctgactccatgtatggtgcagtatattgatcctggaacatctgttttgccagaaagcaaggaagccatcaaagtccaacaggatcacttcaaaaagacatgaaagtcaacttgaagagataattattaacctagatgagacaatctaagcatccaaaacaataaagactgcaatggcctgaaataca

SEQ ID NO: 4372 - DNA, 1253 bp, Homo sapiens
attttaggttaaaaacaacgtctttccataaacttctgctagggtctatgaaccagcctttgctagtttgcacttttctttcgcagcttcctcatggtgactctcagccttaatagaattgaagagagtcttaccctggattaggctttgacttgaggtaatgttgtggctggtttggtcttctatccagaccactaacactttcttcatattagcagtaaggctgtttcactttcttatcatttgtgtgtttactgtagttagcactctgaatttccttcaagagctttttctttgcattcatagcttggctgtttggcacaagaggcctagttttaggcctgtctttgctttcaggatgccttccttactaagttaatcactttttagcttttgattttaagtgagagacgtgacatttcctttcattgaacacttagaggccattggagggttattaattaattaattggagggttactaattattaattggcctaatttcaatattgtgcctcaggggatagggaggcctgaagagaggaagagagatgggggaacagctggtcagtggaacagtcaggacacacatatttatccaatttgccatcttatgtgcgtgtgcttcgtgacatcccaaaataatcacaggagtaacatcaaagatcactaatcacagatcactgtaacagatacttaagtttgagaattttcaaaaattaccaaattgtaatacagagaaatgaaatgagcacatgctgttggaaaagtggcaccaatagatttgctcaagctgccacagaccttcaatttgtaaataatgcagtatatttgtaaagcacaatgaagtgaaacacaataaaatgaggtatacctgtacagctgagtagtctgcctccatacaagatatcatattatacttattttttctctatatacccttccagagatattttaaacatgcaaatactgcatatatgtttattacaaaacctaccttaaacactttgtttcttgttttttccctcataagtgtaaacatgtcctttgttcatcaaataaatttcaaacagttttttttctctatttttcttttgatttctgcgtgggaaaaacactgtgaacacatagaaatgataaatatttgtagtggtgaataccctaaataccctcactttatcattacacattctatgcctgtaaaaaaatatcacatgtgccccataaatatgtacaaatattatctaccaaaaa

SEQ ID NO: 4373 - DNA, 751 bp, Homo sapiens
ccctcatcctctatccctgaaccaggtcagacatagatggaatcagagcaggagttggtgttgatgtggtttcaggtccacctatcagagtttgagagatttaggccatgaaccattatgaatatagatgagaacctttgtaattgctgaaggaggtagtagtgcaggcaagtcctgtgtgcaagacctgctgctcccagttagtacggacccctgtgacattcacagaagttcagaatgtctgagatgctctgcaggctaccttatctccgtctgcagctacacctccagtgatcacaatcagtgctacgctggcacagccagcctggccctgctctggattggaggcatcctcaagggctgcttgctgtggaagcagtttcgctggaccgagaggagccactggaattttgggtactgggccttagggtcacccgggaatgggaatggctgctgtgtggccctgtttgccagagggggccattggtgatgagccccatgcaagtggcatctgcccttcacctgctccttctaagccagcgggatggagaccctccagagagaatatgtgagttcctctccttatgagagccgtggtatgggcattgagatgactgacttgtcaaattagttcggaaagatttttgacaactactacaagatcataatgtacttgaacaaaaacctgtgatatgtgttatttgtttgtttttagatattggagaagggaataaattttagcaagtaaaaa

SEQ ID NO: 4374 - DNA, 5264 bp, Homo sapiens
aaacaaaaacaacaccatatatttatgaacctcagtgaaccagcctagaaaaattgacttctgcaggtgctaaagcacctactaatacgcagcatgcacagcatttcaggttgtgaataccattttacaacgagtttgctgttaactctctttatccaatgcaaacttgaaattctgatgcggttttccagggtggtattttttcagagtattgaatttactatttagtaatttatagtatagctttttatattaaaatgtgatatttttaaaagagatatctggttcaattggtataatgacgtgattatgcaatatgctgatctacaccttgcgctcacattgtgccaaacttaaatgtgcaagtgtacgtgagaaaagcacatgtgaatgtgaattctttaattctttgcttattatgttaaaattagtcttcatagtccactgatgtgtatgcttgaataatgtctatttactttggaatttcaagatttccagcttcaatggtaatttataatttctcagatcaccttaagaaatattgagatactctcccacctgaaaataatctgttctttaacccacctgactatgggagtagccaggcaggtgcctcactggcttcttcagacgaggcttcctcaggtggatatatgactattaggggaaaagaggcttttgagacagcttattacctccttcccctttttgaactaagtacattgtctcagtcccagtatgaatttgtcccatttggggtatttttaaaataaaagatggctaacatggaatctggggcatagccttggcctttaattatggttgtaagcccaaataatggcagagaaacacagggctgtttttacaacagaaaactcaatataagttttatataagaatcctataaaatttgaaccagagctcctatttagttgttataatgtctcctaaagatcttaaatgcttctaaaagctaattattattccagagcaactttttccttttcccccttataaagtttttttttaaatccaaaatcttagatttctgtgccacagcaaaataaaatgatcaacaattaaagatctgtacttaaaatagtacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggctgaaagtcgtggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttactttcctgagttactttttctccattcattgagactatggattcatcccaactccttctaaatccctcaaccatccagctatattttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaatgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaattttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacacc

SEQ ID NO: 4375 - DNA, 2439 bp, Homo sapiens
cattacgcctaagccctatctaaaagttgtatataactcatctgggtttagcaatgctatgaataaggaaaaacaaagaggaccaatctacgccgtggaagggaaatgcacttctctgatagagacagtgatcattacaggtcctcaagggaaaggtggaatatcaagggaaaagactgggaagctgtgaggtctttccacagtgatatttggcatttgcattttctaaaaatagctagcaagtattcttccatctttttctgttgcctaagagggtattataattcagataaaagatggctatggatgtacgaacaagatggataagaaaaatattcgagaattagaactgaccagatttgattgactgtagaagtgctgaaaatttctctttcttctgtttagctcatatatcttctccccagatactaagcataaagtgatagactaaattcctatctctgcatgtcaatatgttgacttttagtttgaagtagagccacacatatttggtcagaaattgattgtagagaataaaaaccctgtccaaccaggaaatgagcaaaagagggctggggtgaagattgcaagaatatacatctcagactccaggaaaaggaaaatacaggaactgtgaagactgttttcatttggagaccagcagccattccctctgtctctctattgctgctacccaattagcaacttcccctttgtgacttaaatgccaaaaagatgacattaatggctcaattcagtgtatgaaggattcctgagaagaatatatgataaagcatagcttcctaggtcacccttttaacagggaccaggagtttgggttgtggtagggctgtgtcctgaggtcaggccaagaagtgggctgatatgttaaaggacaactgaatacttcttcaactatataaagaccttctatatgtaatgccatgctatgtcattaatggcatttcattttagctttttaaaaaacccaacgaagggaaattcaaggtaatggaaacattttaagttttaaaatctgagtcctggtcatgggtctactacaaatgtgatttcttcccattgcttctgtttctctaggctaaaccaggaagatagttgtcaaaacttcgggtactattttaacatacatcagcacttgttaatttgctgtaattccctcaatagaacaccaagctttagttttcagtatgtttcttgggcaagtgaggtggtaggtggccatgtactagatcaaacttgattttctagggattgttttcccacttttagagaataccattcttaggctaaactcaattacagaatctactgcatgctatacagccctctatagaaatattcaccctgagtagttaattatgtttcttaatgggtaaatgttttatctagtccctctttttttttaatttgataaaatccagatctctcagagcttaaatacacttcctcttattttccctacaacaaatatggaaaagatctataatatatatttgaatatgtattaagttgttcctcacccttttctattttttattagctattgagtgtttattaatgcttcaaacacttccaagtgctttatgtatattaactgatttaattcttaagttactctatgagatggtattattatcccaacttaataggaaactgaagcacagtgagctaaagtaactctcgaagtggtggagcagagagatgaacccaggcagtctgactttagaacatctatgcttaccactatgatgttctcaaggaccccattctgaatataggaataaacaaattcagtttctcccactttaatctcacaacacccttctgactccagatgtgtgtggaggggggttccccacgcattaagcaaataagcaattttgcagcagacaccagctgggtgtcctctaattcaattcacttcttacactacctggagatagcatcagataccataggttgaaggctcagtgccacaagatggctcccacttcagatgacaatcagaagccccagatggtgaccaagggtcctaaccaactagctataagttagggttcccataaccccttcttgagctccattagtttgctagagaggctcacagaactcggaaacactatacagtcatgctgtacataatgacatttcaatgtcagcctgcatagacaatggtgatcccataagattataatactgtatttttactgtaccttttctatgtttaggtatgtttagatagacaaatagtcaatccttgaacaacttgggtttgaactgtgtgggtccatttatacatggattttttttcaataaatgtattggaaaattttttggagatttgcaacaatttgaaaaaccagatgaacctcatagactagaaatatcaaaaaaaataaaggtatgtgaagagtacat

SEQ ID NO: 4376 - DNA, 735 bp, Homo sapiens
aaaacattttggttagcctgtaaatttaaattttttattggctaagtattatagttcccaatccctgaacataatacagtatatcatataaatgactttcataaatattttcaggccatagtaatttttctagacctatttttggaagtgaagtatttaggaatatacagtatatagaattaggggaatatttcattcagaattctattgttggtgaatttaattctggtatgatatgctgtattaatgttacctccagtaaatacaattccctccagatttagctattacacttcggtgttagctcttggtcagtgttttagaacagtagacatagtctacggtaaggaatagtcttaattggtaaaactaagatagctgaatttggaaggaactcttaatagtaatggatttggggattttttaggttccttggttaatgtttgtttcttttgtctgtttctttttctttcatttctacacattcatgcagtatttcatggttctatcaaagcagcagtaaaaaaaatactcttgacgcatgaaaattaactgttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgta

SEQ ID NO: 4377 - DNA, 5188 bp, Homo sapiens
atgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttc

SEQ ID NO: 4378 - DNA, 2735 bp, Homo sapiens
gaatggaaggtggaaggcggttgctgcttgcagaagaggcacgctggcagcattggcagggaggaggagactggaaactgagtagcagatccgagaaaccaaaatgctcagcaaatgagggcaggtggcatggagctacttccctgggtccaagagcctaattacgttattgttccataagttcatggcctgcggtcatcagggaaaataaaacactgactaggggtcggtcttttctgtttagaggaggctccctgaaacctccccctcccgggttcaagcgattctcctgccttagcctcccgagtagctggaactataggcgcccgccaccactcccggctaatttttttttgtttttttgttttttgtagagacggggtttcaccgtgttagccaggatggtctcgatctcctgacctcgcgatccgcccgcctcggcctcccaaagtgctgggattacaggcgtgagccaccgcgcccggcctcagctggtttttcaaaagtcatggcgtgtaattgtcagaacagtgaacttcggagatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaagaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtgaggaaaaagctttctgtcccggctcagtgcggaggaggccgcgctgcctcgcgctccactttctcaagttgtatttattttattttacaaagtggcccatcattaagtggctttgttattcattattacagcatacctgagttgtttcattttttaatttttgaccaatttgggtttgtttggggtggatccgggacagagaagggagaaaccctgagggcaacatggagagccccagggagacgcgcaccccacgacttgcttttatttgcgttccagtggctcgtttttcttagagtgttaaagtacttgaaaaatattgaagagcagatgtagatgtgagttttcacaaccgtgttttaagtgtaaatactggactttgtctgttaaaaggattttaggtaaaataaatttaagcggagtttatttcggcaaaggaatggttcatgaatcacgcaggaagcaccagaacggatggggcttcgagctcttagggtggcccctaagtgaggctcctcagtggctccagctaggccaccgcctgttgtggggatggttccctcagcgtccctagtcatacagccaactggctgctgggctttttggcattgactgtggttggtttgttaatttttttaagtcagttcaaatgcctccaagttcggtttctgtttgcttagggaaggcctcaggctaacccccgccgtatttgctttaacatgtcaaaaccataatttatttttcattttactttcctggcattaatagaagtaaattcacatttgtgtgttattcagaaagtcggtttaattggcaacctatttgtgatggtgcataaagtaatgtcttttaatcattggcatcttagattagatgaaatatgttaactctcttaagcttcgttattaacccataacaagagttaagtttctttttttctcctaggctttgaccatttaaaatacactcaggcatctcgtaacgatgttatactttctgagaaatctgtccttaggtgatttcatctttgtgtgaacactgtagagtgtccttataaaacttagatggtgtagcccactccacacctaagttacatagtatagcctattgctcccaggctacgaacctgtacagcatgtctctgtactgaatgctgtagtcaaccataacaccatggtgattgtagattgtgatcccagaatatctgagacaggtctcagtcaatttagaaagcttattttgccaagattaaggacacgcccatgacacagcctcaggaggtcctgacgacgtgtgtccaaggtggccagggtagagcttgcttttgtacattttagggatacatgagacgtgtaagatgtacagtcatttggcccagtaaggcgggacaactggaagcaggaagtgggggtgcttccaggtcagaagtaggttagagacaaaaggttgcattcttttgaatccttcatcagccttccactgaatacacaatttagtctggctcaatgaatctgcatttttacataaataatagggcagaggaagcaatcagatatgcatctgtctcaggtgagggatgactttgagtgctgtctgtcctttgtccaaaaggaaattctttgtgggcaaattgtgagtgaggtatgtagctttttatctttgtagctatcttaggaatagaatgagggcaggtttgcctgacatagctcccagcttgacttttcccttggcttagtgatttgggggtcctgagatttattttcctttcatggtatcagaacagagaaaaggtaatgcgttgagccatgagc

SEQ ID NO: 4379 - DNA, 543 bp, Homo sapiens
cacgttcttttctttgttgccgttggggtgctggactttgcacaccacgtgttcgtctgtgccctgcatgacgtccttggaaggcagcagcacctgtgaggtggctgcgtacttgccccctctcaggactgatgggaagccccgggtgctgctgatgtcagagttgttcttgtatttccaggagaaagtgatggagtcgggaaggaagtcctgtgcgaggcagccaacggccacgctgctcgtatccgacggggaattctcacaggagacgagggggaaaagggttggggcggatgcactcctgaagagacggtgaccattgtcccttggccccagatatcaaatcactgtgcctctcgcacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagct

SEQ ID NO: 4380 - DNA, 715 bp, Homo sapiens
ttaattttttttcctagctccaaattaaatagcaaatttttaaaacatcaaaaagctcagagacccctggagactacatccatttaaaccactttgatagcactgattaaacaaatattgagggcttaatgttcactagcaaccatcagagatacaaagataagacactgtctctgccttcaaggaacttacaataatatagttaaaaaaaaaaaaagtgatccttcttcttaagaaactaacaggcaaacaaacaagtgtaacaataattacagtagtgccatcagaggtatgcacaggagccttcataatagtagtcacatttaagcaagttttaaagaatggcaatttaacaagtccatgaaatagagaaggcaaagagatggagaaagtattccagacagaaagcacacatgcagtcagagataacaacaacatgacacatttaagcacgtttctctaagcatgatctacagacaaccagcagcacaattacctgtagtgcaagatgttacttttcacagctctacttaaatgtaatgaaccagaatgtttaaagattgagcttagaaatctacattttaataaacaccttcaattttatgttcactgaagtttacgaagaacagactgaaaaagaattactaaaattcagaacagttaaaggagtggaggatgtgccagagatgagaatagacaaggactagttcaagaa

SEQ ID NO: 4381 - DNA, 3465 bp, Homo sapiens
gtccgttgctgagatgcgtggagctgatgacaatgtagtaacactccatggggcagccgccgcctcctccgccgcagccgccgcttccacgcaccccgcgcccacagccgcagcgcgccggggccggcgacggtgggctgggaacccgccacgagggcacgcagccacccccggcacgtcctctggagactggctcactgcacccctctgtgattcgcgtcgggacgacgagccccgcgggaggattccagcctaggagggggccgggccggcgaaacggaaccgagcgggagtcagtgcccgcgcggtggccgggcggagcggggctgcgggagccgcccgcgcggcagcagaagcggcggcggcggcagcatcccccgcgctcggcgcctgcactcggagttgctgctgctggcaggcatgagtgttattatagtgagcggcgttgccggtccattgcactgagccaatggcagggagccactgggctgatactgagagctgtcagaggagtacatctgtcacccgctgcctcccccgcccaccccgccgccgggacccgcggccgcgccagcccgagcgcgagtgggagcgccccgcgcggcgccgctgccgcagagggccggggacgcgacggccaccgccaagtgggagactcctggaaggataaagctcaatatccagttcaggaaatgggaaacactgatatatgactcatcccatggaacagaatatagtctacgtggaatgtcacactgtgcttctagtggcaaagtttgcatatatgtatgtatcagtgtatctttaaatttgcctttgtgttgcaagcacttgttatatccttcctattattcctattatttaaatcaatttttattttgcaagactactggtaaagattttggaatgaaatgtttctggggaaccgagtcaccctaatttaaaaaataaaaatatctcagtaatttggacaataggtttaatgtatgaggttaaatatatacctgcttattataaatatgcagaatcatttcttgtttagaaaatatttcaaatattttatggaataattacagattatttgtgttcagttggcaatgttctagccgaacaacttataattaaaaatgtaaataaagaagtgtcattagtctaaaaacttgcagttcatttttgctacaacttcacttcaattttgccctttttgcaactgcaattgccccttcaattcgccatttacaactgcaattcaaatcaagattctttaagttttgctcttatactgatttatcccacttatcttgctttgcttaactcaaatttggataataggtttctgctcagcgttgttcctcatctgcttctggctcacacaaaatttcaggacagtgttgtcaccttgacatgtgaaaccaaggtcttgctcctttcctacaccagcggctagacctctgagttctaaatccctttccagattcattcagtccagctcttccaggagtaggtaaatctttcctgagtttacctactgatgtttaacactatatgttactacctccacatgcctttccactggactcgctacttcatgtcataaaaatctttggatgcttttactatgtctgaataacttcccatcactcaactgaaaaaatccacaaattagattgacttctgggttccagcaattcaggcttacctgggcttttgtgaaccaagtttttaatcttatgtcatcctgaaataacatacaaagcaaatatgtattccaccacttttcatatgtgtctgggacgtattcatagtcatcactgagtatattttgggattcaaaattttccttttcattactgtaataatcttaagcatatttttatcatctgtataaccatacagctggataatttggaacttagtgttgccactatttatcactttggtttacattcatgtttattatcacattggtgcccaacactactgcttttattatttgtgaataataaaaatttaacactcgattgttcactctaagttaatgccaagcgatatgatggcatgctgcataaatgaaggtgctacatagttaaattggaaaaagtggtagaggaacagcatcaccatagtgcactcatagtcattgtaaacttcaggcatgtggagattagcgttgacacacaaacactcataaacaaattcatgtttgagataggatttgatttcagcaaagcaacatcatctgttgtattaaattaagttgggaaatttggatattttgcctgttgtattttcatttgatttctttttttttggtttgtgtttacataagagctataagcatatggggttgtataattagtttgatgttaacatatttaagtaaaattatgcctcaagtgaacttagtgtattcaagagaatatttaagaaaatgtctatatgatatttagtatgagaaacgctgatctatactagtcatgggatatatattgaataccaaaactgatattacctgaagatgataatgcaattgtattattttatgggtgatggttaaaattttaaggtaattattagataataatttcctaaaagtagctccatgatcataaccctgtttctgtattcaaattcggctgagttgaaatatggtcctgttaaaagcaaggatcaataaattgtcactgattataagacatatataaagatgttacaaacagaaaggcatcttctaatcaaggaagtgtgaaacctatatttgtgtggattctatcacaattaacaccttattacaaaccactgtaaggcaccttcaactaaaacaacttttgaatattgggcaaataattattcagactcccttaacttcacttatttaacctttgaaagaaagggaataagcaagatattatcttatgttttttcaagcttaattatctgattctctggcaacttgcctagagctgatgttgattatgcctggcagaacagaataccaacttagctccccacttgaagatgtgtctcttgaatagctggtataactgtagaaattgtggaaatgtggaaattgatacaaatgtaaaaaggattagagagaaatttcataatttttctggattcaaccttaataagtagataaactaatttaattatgcaactttttacatcttaaaagaatgatagagcacttgttaggctgtaaaaaatatttaggtgatatttatatttttcaagcatttttgccccttactttttaattctaataagtagccttgggataaatgccaaaacaatgcaaactggaaagccaaagctacatttctaatatgttgccaaaaaaattaatgcaattggatgacatgtaattaatttaccaaaaggaataaatttaagatatattattatgagtaaagaagaaaagatgaacaataactacattcctgtgttttattcccttttttg

SEQ ID NO: 4382 - DNA, 2913 bp, Homo sapiens
cttaatgtagacaacttgacaagtttggaggtaagcatacacctatgaaagaatcaatacaatctatgccatgaatatatccattacctccaaatgtttcctcctccccctctctgttattattattatgagttccttgtatattctggatattagccctttgtcagatggtcagatgagtagattgcaaagattttctcccattctgtaggttgcctgtttagtctgatggtagtttcttttgctgtgcaggttgttaatttatttcaccaacttctgtctcttaaatatgtttggtaattgggtggaatctctgacaatttttttttggtatataggtttggtttttaaataattatctggggttgccaaattcaataatattaatacacagttgtttagcttcaatatgtttatcataattttgtaaaacttttcacttaggggtttgtccaagctctgcatggcaacaattttgtgcttctccttcattgtgctggctattctgggtcttttgcctttccacataaatcttagaataactttgttgatatccacaaaataacttgctggaattttaattgggattgtgttgatcctataaatcaagttaggaagaactgatgtcctgacaatattgagtctgcctctccgtaaacacagaatatctcttcatttactgggctcctctttgatttctttcatcagctttcctcatgtagatcttgcacatattttgttagatttacacaaaagtgtatcattttggggggcacaaatgtaaatgttattgcgtttttaatttaaaattccacctttcattactggtatatagaaaacagattgacttttgtataatacccatgcatcctgcagccttgctgtgcttattagttttaggaggttttattatctggtttgttctttctgactttctacatagatgactgtcatttgtgaacaaagatggtttttatttctccttgcccgtcagtatgctttaaaaaaaaacttcgtttatttggttagctaggacttccagtatgatactgaaaagaagtggtaagaagaccatccttgccgtgttcacaatcttagtgggaaagtttctcatttcttatcgttacgtgtaatgttagctgtcagttttttgataaatattgtaggggaggcaaaattttacctctacccttgtaaagtcccagttaagcctgagaattaaattgacttaagagagtaatgggagagaagcatacaaattgaatttaaattttacatgatatggagtcctcataaggaaatgatgatccaaagaagtggcgagtttgtatgcttttatattaggttgaacaaagagaggtagtcatggaaaagtaactaaattatatggggaggctaatggaaggtagaaaaggtagaattattttaacaggatttgtttgcccagaattctctggatatgattctctattgaaggatgtttcttttctcctgctatagagggggcatcttccctatgagtttttctcttctgttttcaggaagaaaaggggaagattagaatgccttcttgcaaatgatgttttttaagtgcctttagtctgaagtaatactatgtcaaagtggcatattttgaggtggcgtgttatgtcacccttcaatattccttatctagtgtcctctattcctagtttactgacagctttattgtgaaagcatcttgaaatttataatgatttttatgtatccattgatatcatcatgtgatttttcttctttagattgctgatgtgatgaattacattaattaatttttgaatgtcgaaccagttgcccaccagggataaatctcactatgggtgtgatatataattcttgttattcattgctggatttgatttgttaatattctgctgaggacttttgcgtctatgatcataagagatattggtctgtagttctgttttcttgcagtgcctttgtctggtttgactattatggtgatgttgacctcatacaatgagttaggaagtattccctctgtttctatattctggaagagattgtagaggattggtataatttcttccttaaatgtatggtaaaatttaacagtgaacccatctgggcctggtgctctctgttttgaaatattattaattattgattcaatttctttaatagatatagtcctatttagattgcctctttcttcttgctttgtcagattgtgtctttcaaggacttggtccctttcgtctaccttatcaaatttgtgttcatgcagttgattataatatttcttgattatccttttattgtctatgggatctccagtgatgtctcctctttcacttctgatatgaagaatttttttttttgattgacctagctagaatcttacctattttctaggtcttttcagagaacgagcattgggtttcattgattttttcctgttaatttcctatcttcaactgtgttgatttatgttgtaattttcattatttctttttttctgattaccttgaatttaatttgctcttccttttctagtttcctaagatagaagcttagatgattgatattagatctcccttcttttctaatatatgcattcaatgctataaatttccctttaagaactgcttctcctgcacccctcaaacatttataagttgtgttttcatttcaatttagttcaaaaatttttaaatttcttttgaaatttctcttttgactcatgtgttatttaattttgtttgatttccatgtagtttaggattttccaattatctttctgttattgatttctagtttaatttcactgtgatatacaccagatattacatgacatttctattatctttgatctcttaaaatgtgctttatggccaagaatgtggtctattt

SEQ ID NO: 4383 - DNA, 1466 bp, Homo sapiens
cgtccgcttccactacaaggctttgggatgcctagtctgtagactggaggagcattaatactgactcacgcagaaaagatatagctacatattggactgggggaaggggtggcaaaaccctctgcaaataggaagtgccacaagagcaccgagataaggatgaggccctgcgtgagcgcagccttcgggttttccttgggccgatcagcaccgactcccccgctctcggcgaggcgcctccagctcccgggaatgagaaatgtgcccgccgcagcaggggcccacaggaatgaagggccccggcgctgcgtaggcccaacagttccccgcgctctcgcccccggcccagccccgcctttcttcccccgcctcggcagaatggactcaccagggggcgaagaactcgacgagcatgaggcccgcagagcccgtgtcggagatgcgactctcgaagttgtcgtccgtgagttctagcacgtcggaggcagcggcgaggcgggccgcggcaagaagcagcgccacacccgggaacagcgctaggcggcggaggcgcatggcggcgagacatggccgcttaccaacaagaagggcagatgcagcttccccgagctgatgccattcgttcacgtctcatcgatactttctctctcatcgagcatttgcaaggcttgagccaagctgtgctgcgacacactatcaggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtgtatcctttcatgtcactcatttttatcctggctgttgatcatctgcctaatgacttattttttgcttcccaaactccattgtctcattctcactgcttatgttattgctcttattatttcagctgcataaatcagaaagaactccactctgtatgtttccttaagagacaacaggtcctctcttcaaaaacttcatcatcttcctgatctttttgaatacgatcgtactgatggttgaaatacgtgagaactgacattgtatgaaagaggaagtgaggccaggcgcggcggctcacacgtgtaatcctagcactgtgggaggccgaggcaggcggattgccaaagctcaggagttcaagaccagcctgggcaacatggtgaaaccctgtttctactaaaaaatacaaaaaattagctgggcgtggtggcatggcctgtagtcccagctactcgggaggctgaggcaggagaatcgcttgaacccaggaggcgtaggtttcagtgagctgagattgtgccactgcatttcagcctgggcgacagagtacaactctgtctcaaaaaaaaaaaaaaaagaaaaa

SEQ ID NO: 4384 - DNA, 2152 bp, Homo sapiens
gttaccttccacttcctccgtgccctccatcagcatatcctttgtaaagtttgatatctggccagtgagggaagccaggctgcccccgacttgacccagagactggcccaatccggagccgaggcccccaagccaggacgacatcgcggcgagtttagagaacgacccggtccgctcggaaaaaagaaaacgtttagcgccgccgggcgatccgaccaaatatccttgaacgcctgccttcgcgagacaggatacgataacacaaagctgggttctcaggcaaggccgactccaggttctgcctagaaacgcagaggcctggcctggaattttaccaggggcccgcctctagtgacacagtcacctacggagggccttctgctcattcccacgaattcccaccgtccagattgggccacttctttctcagctctaatgactttcctcagttccgtgggttactcctgccaactcgacgccggccgccatgacactcgctcggaaagcggcagcggatcatagaaaagcgccgcggtggcgtagacaggccccgcgaagccgccggacgtgtccttggcgcaagggaggctgggatcgcggaggaccgagcgcgggctggattaaccgcagccagtgcctagcgcaaggttaggtgcatgcaggcggccagcttcggccggggaaggaatggcctggataactggggcatcgcggcgctcctcggcctcctgcagctgcgtttcaaagcagagccgacccttggtgggtagtccggggaccctgcggaccctccttgtgttgttgaaacctagtgttttaattgggactacacccagcagtgccgggagacttggcggggacgttccactgcgcaggaagtggcttcaaataacttacacgcgtcactgtgtcgattagctgctccgtgacaggcactatggtaggagctgaggctacaaagatagaacggatgggttgcaaaaaaaaaaaaggaaaaaggaaaaaagaaaggatgggttgcaaattcaggtgtccaagcaggaaacacaccttccttctataggagaaatctcctctggtggctttatagctcacaattgaaaccctaccttctttaacatacgatgagcttttttcatgaagctgccctcacccaagtagttgaaaaacggacaaccgtttttcaaaatgactcgttagaagacagcagggcaacttaatagagaagtgccgtttagtgtcaacgctcctatggtattggcggcactagctatgcaagtgcccacacctccctcagtccttagttacccacactggctgtaacacacagagtcctaccttgcttgcttccttccctaaaggaagaaaggttgtcatgtgactttcaagcaattggtgcaggatacgtggacacacagcatctagccagggagacttccacattttttggtttcaaaaggatatgatagatctgcagttcttttaagcatagcaataagtatactggcatctttcactttgattatattcacaagaggggctatcacagattgcacagtttgtgaacagaacattgggaatgcctccagtatttgggatctgatggcaccaggcagtagtaattctccgtgaaagctgaattttttttttttaaattttattttttgagatggagcctcgctctgtggcccaggctggagtgcaatggcgggacctaggctcactgcaacctcgtctcccgggttaaagcgattctcctgcctcaggctcccaagtagctgggactacaggcgcccattcttcattttactaatgagaaaccagtgcccagaaatgttaagtaacccatccaaggtcatacagctagtaagtgacagacccaggcagtcaggcgttggagtctgcacatctaaccgctgggctgtgatgttcacatgaatgcagggacagcatttaataaacacttccagaatgagatgtgaattttattttaagcacattcagatatccagtgtgactccgggatgtaaaaaaaaaaaaaaaaaaaaaaaacagggccgggtgcaggggcttacgcctgtaatctcagcactttggaaggccgaggcaggtggatcacctgaggtcaggcgttcaagaccagcctggccaa

SEQ ID NO: 4385 - DNA, 926 bp, Homo sapiens
attttttaaaagggaaccatttcattattgaaatcttatgaatgcatcagttaatttatattaaattataagcaggctatctgaaaaacaaggatatagaaatcatatatacacatttttgaaatattagtttagtatttaacatattaacatttcaaaacaaatgcaatgatctagctacctatgacgccagctggtgtcagtggttgtagcgaagatgctgtttctgtttaccatgagcaaacagcatttcttgggtcttaagctaaacaatcacaagttatcaaagtaaagaaaatctaaagacagttcttacttttcatgtgtagaagtgtagtttgggtatccagtcatgccacagtgtgactgtggtcaacacagcccttgtcacaggtgcgtatggtcctaaatagctggcctctgtctttccaacatcttcacttcattgggaattcagtgcaagtgtttgttttgtgagttagtgcattcagctttttttgcatgttattttgaaaaagaagctgtcaggaagcagaagatacataagaacacaaggccctggatcctcagagcacctctggtctagagaattcagtgttttggaagtagtgttttcctgcattgggctggtcattgttgtaccattccctggataatctttttccatcagaataatgctgtgtgctccctctttgcctgctactgaacaatgacgtctcttgttgtgaaccccactggcagagcacggaccatggaagcatcttttggcagcaccagagaactgagcatctcaaagcatgagttcttctgtttcttctgcgtgggttgaccatgggcatcaggcatcagagatacaactctggatcttgtccatccattgctgggcactctgtccatcctgggcgcagaagttatacacacgtttg

SEQ ID NO: 4386 - DNA, 1959 bp, Homo sapiens
ggctaaagcctgaacaggtggagtggctaaccaaggagttctccatctatatgacaaaggacggccgcatttctgtggcaggggtcacctccggcaacgtgggctaccttgcccatgccattcaccaggtcaccaagtaatgtacctggtgcaaggaaacagagacgacctttctgtcttcagcctctgctattgggagcttcacacagaggatgagagagagcggatggtgataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggcccttctgaccattggattggccttagaagagaatcatcccatcgcatttggaaatggacagacaacatggaatataataacatgcttgctatcagaggaagtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcagcagcagcttccaccatgcccctggaaaaactgcaagtaacagacctgcacatgtatcccctacatctaaaataaaagttggaaaaaatggaactttgatgttaagatgcactgatacaaaacttaaattttggtctcctacattaaaacaatatgagtctcttaaaatattgatttgttcttagtaagattacaagaggctttgatttttaattctgcaatgtttccttaacagccattctgaattacaaactaattcctatttctgccacattccttcctgagaactgtctagtcctggtttgggatttatcttaaaggtctagaaaggcaacattttacttcagcaaaacttgattctatattgttgttttttcttaatgtgtcaaaattgttttgttactaggatttcctatgttgttattaaatgtattcccctgatcaaggtcactggcctagaaaacaaagattctgtgttttaccaagataattcccagtgcttcatggtgtctttattaggctttgactgcttagggaaactgagccttaaaagggtaaaagtttttccatccatgtaactttctgaggtctttaggttgtcactctgattaaatgagtagtattcttagcagtgacttattatctgttgaaggaagtattttaagctttttgacatctttggcaggtttctctagaatccaaatcctaaattaagccttttggcctaaaaatgactgggatttttccaggtggaccccctagatatgctcctccaaaggcttgtctttcttgtagagttattaaatgattaggcttatttggcaaatactgctagaagcattgtcaaataagaaatggtgttttacctttctttaagctgtgtttgtgtaagttcatcatttatagaaatgtgaaattttatgagattcctaagatactgacatgctgagatacctgtaataattgcaatttttatgttggatgattgtatgccacagaagcacttaaatttcctggttaattggtaacgttaatcagatctttacctatggctgttctgggtttttgtcattcacagttattattttaatttcttctttggaagcgttcgcaatcagctatagtccaaaattgctaattaagatcaagcaaaacaaaattaattacgtaaaattaatttataaggatgtttttatgacgtaaatgttttattttccagagccaaggaaattttctgtcacaagctatctaccgtttgcaataatttgataaataatcctttgtgaacaa

SEQ ID NO: 4387 - DNA, 2147 bp, Homo sapiens
tttccctacctctcacatacacagtgggctggatgctggatgcaaagctccctcgtcacagccccaaagacaggacttgaccatctcagtgcaatgaccctgtggtgccttctcccgaggacctaagagccccctgagcgcttgcaaacactgcagacaaagcgagccctggcaccagctccctgcctgcctgttctgtgaagggagcctacaaaactggcagcccctgcagttctgagctgcagaactgatgagctggggcaccctgaaacctgactccaaaatagcagcaaacccaaggccaaaaggaagacaagcgagaatcccccaaaagccaaggtcatcatcaagccaggatgaggactggaggaggagctgacagctctgcctcaaatggatttgggagcgaaggctttttccataagctttgggggtaagtcacagagctaccccaaatgtaacttagtctcggggtctccttccttttcaccagctgtcccctttgctggaggaagctttccagcccaaacgaagggcttaagaggagtctggccattcctggcatccagttagacctggaggaggtgaacggaggagaagcctgagggaggggtgtgtatccggcctgggaattcctccctctcccttgctagcgccccaacccgccctcatcctgttcagagagggcacttacaggcctcggaggcaggggagggtctcctcctggggaaccatccccgtccagatggtgcccccaaccagctgcggcggcatgatctgggcggctggtccagggcatgggttgcggatcgtgtagggaagaggggaacagcagtcgagaccctactccaagtacgcatcaaagacgtcgagctccgagtcagcatcgtaaaggcccgagccggggtcggagagcacgccgaggtccacgagcgcctggtccatgtcctcgggcaggaagacgaggcccacgttgaggacgatgtactccatgaggaaggcgtagtacaggatcagcacattgacgaagaacaggcccacgtagaacatagagggcagcagcggcggcggcacgtaggggaccagggggcccagtgcgtccaggtgggccgcgacccgggcgccgagcatgcagcgggtggcaagggcggcggcccggcgatcccggcgaactcagccgctgcggcgcccgggcggccggcgagggcacagcgcagccatccaggggtaccctggagcccgacagaagcagggccgggctccagatgtcccctggcaattgcgccccgacccccgaaatgcgccgggcgggtcaccgcaccccgagatgtgcccccaaggatctctcgaccgcccgggcggcgaggcgggcccccctgaagtggcccgcggctgcccggctccctcgtggcgcctccctggcgctcgcagggcctcgcagagccggtggggatcccaccgcggctcagtgtctagggccggtcccggcagccttctctcccgccccgccccgcaggtcctcgcgcaccccccgcgcccccgcaggcccagcacccatggctgcggccgccgcgtagccctcccggtggcgctcggagctccgcctcccgaggggccccgagctcattggcaggccgccccctgcacgcgctaattggccggctcaacgcccgcgctgattggctccggccgccagggggcgggtaccgcttcgctccgcccctcggggccctagcgtctgagttgctttcctggttcgggtctgccctcagatctcaaatcgaattcgctctgcgtatcgaatagggggaggtaaaagagactgaacacagttcaaacctagacataatgctaaggccgcaaaagccgaaggaaacccgggctaccgctgcaccttgctgcatgcctctttgggactccgtttctcctttaaaaggaggcggggtcggggaggggcgacggacggttgccctggaaattttggacattcccaaagcgccaattttcatggtggagatccaccagtgtccccttcgcttctccaaactctggttgctggaaggtccgcccactacggaacctgcatcctagagttaaggaacacctgaataaagagattccgaggtagttcagatcttcaaccataa

SEQ ID NO: 4388 - DNA, 710 bp, Homo sapiens
acggcgcacggaaacgcaggggagcctgcaccggctgacggcggcggaaaagggcgaacgaagcgcctgagggccctggcagcactcaccagggtcgttccagcccagggcagggcccgcggtcagcagaaacaaatgcaagccgaggagcaagcagtacccggccgctcccggcccgcaggctgcggccatggcgctcgatgaagatggcgccgggctgccagacgcctacgggccgaacctgggtgcggtagcgcgcgcgacgctgcgcagctacaccgctacccctggcggcggcgaaggaacggcccgactgcagagctgcagccgcaacggatccgtgcgccaaccctacgtcactgccgctgcggcccgtggggctcagtgagtggccgccgtgggcccccgcccctggagcacagcgcggcttggggcggggcgaggcggtgtgggcggggccaagggcctggggaggcacggctggaggcgggttggaggcgtggcgccgcggtgtgggcggggccgagggcctgtcgccgccgcgcccgcgggcggggcgagggcagcgcgcagctttgttgtgtctcgtctgagattcgggaagcttctgtgcgtaggcgatgcagtttgagaggctgaaaacgtcacgacgcgaaatctaagaaatgtagtcaaattatgtattattaaaacctcaataattgtaccaa

SEQ ID NO: 4389 - DNA, 2847 bp, Homo sapiens
agatccactacaggctgcgcctctgcccctgcgaggggcacccctgggtctctgggaaacggaatggagggtcttatggaagagaaggtttggaaccaccgctggagggaaggggagaagaaagcaagcaggagtggcgcgaacaggaagggactagggatagaagccgggcttggacacagtgaggcacgaaccccgacagacacagagacagacaaggggtgctgatctcctcactgggcggggtgggcaggaaaaggaacaggagctggagctagagcgagggctgcgagcggcgagtggatacccggcctcagggaggagcttccaggagggcaggggtctcctttggagcagcaccggggacgtttgctcggcaagggctttttgtgcgaagtaaccgaagccagtcaggctaatggcggcagagagaaggatttattcttgcacccagggtgtgcggaggagcccaagggcatttggacctgtgttgacgtccggaagggcccggaacccaggaagctctgcccgcagagggtattcctctccctctgaagaccacctcaaagctcaactttatcacctccacgcatgagaccgccggcggctgaactaaaatctcaccatcccaattccagtttctgggaattgtcacctccattcgctctcattagaaatccagcttttttcacgaggtgaataacagggcagttgacagttcccaagttttctgtgtccaatcttcagccctggagggactcttctgctccaagtccagcgatcccgggagggggcccactggtccagtacggctcagtacccagccctggatccaccagctgacgctggaaggagtgggtcatgaagaactcagcacgaacgcagctgggtacgaattcccagagatgtcctgtccctccacggtaccaaggacccctcctttaagaaactgcttcactgaaggcgcagatggagggagggatcggcaacagagttcagaggggttccgggggcacatggctcagccggaggaagcaggctgaggcaggagagtcgcttgaacccaggaggcagaggttgtggtgagccgagatcacgccattgcactccagcctgggcaacaagagcaaaactccatctcaaaaaaaaaaaaaaaaaaggctttgggactaaagcccgtatgcagccgcccctgggcacatatacgtggttttatgactttggtactgactcagcctaactggaccccagatacaggagaaactgagaaggacggagaacataagcactgtccccggtgcactgtgtcccatgtcatcctcacatcaatcctgtgtcatagggtccctgcacagtttgcctgcacagggctgggcccgcaaagcctcgctccccaacgcacttgtttcatcacttcaattgagcctgcatcctgctcctgtggctgactggggaggggccagctgcatccccatctaggggccctgctcccccatcctctcatgcctgcagaaaccttcaccctggctcttgggtttgggcaggtccagcctgcagaggggagcggatctcctcctgggccctggcctgccctccctggctggcatgtggactaggggcctgggggctcactggatggtgcccgcccagactcacggcagctcctcctgcgtgcactctggcctgtgcagctgtgtaagggtcctgcggttacatgatgggaaaagcaagagggagcatctggggccctgaagtcccaagtcacacccaaaccaaaccacccagccaggaagatagcaggaagcaaattggaggcgttctgggttgaactgtatccccagcaacaacaacaaaaagatatattgacatccccagtacctcctaatgagacagaatcattacagaggtaatcagactaaaatgaagtcaataggctgggctttcatccaaggtgactatacaaaggggaaatgtggacacgggcacacacagagggagacaccacgcggacatcctggaggaatgtcaaagcctgctggcaaagcaccagaagctggggacaaggcctagaacagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagaggaccctatccagctgctgccccatctccaagagcctcgccctgctggaagtgcactgctagtctggttcatcagccactctgcacaggacccctgcccaggacccagggtctgcattttaggccatccttgctggataggcccagagcccagggtccccacctgcctgtagaagggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaa

SEQ ID NO: 4390 - DNA, 2038 bp, Homo sapiens
gctgtgctgcctgtccaatcagaggatccattttatggttgatgcgaatacaacggtaacccgatcccttgcatggcttttctgggaaccagtgatgtttataatgttctatagaagaaaagaagaacagagaaacaacgcttaggatcgttagctcccactgcggattcctcctaccccaggctcctttgaggagcgaaaatgaaaactatcaactttttaaaatgtccaggattgcatccgttgttgtgcatgtgcggggatggaaaaagcgggcagggttttagaaataacacagtagtaccggacaaaacaatctccaggaaccaaccggttgagccgccaaaacaggaatcaggcgcgcagcctcggccagtcgggaagccactggcacctatggccaggcgagaaactgtttactttctccaccccaccccagatgcacacaatggagttgatggctttggagatgagaagcgccaccggactgttaaccccgaagggaagaaaaacaagcaaccctaaaccacgctctgggcagggctgttaattgtgccggtgacaaatccgatgattaatgggcaggggcaggaggcgcggggagacggcacgtccgttctgagctggctccggggcagcggcgcagcttcccaccccggggctgggccgccgaccacgcaacggttggagggggctgaggaaaggggacgtcgaacccaccccagccccacggctcctttgtccccaaatccgccgacggtcctcggaccgcagctcccgcctcggtgggcttaagtttctttgttgtgcgtgttgtcttctcctctccgttttgccagctggggggaagggggcgccctccgtccagcccctaaagcctcgcggggaaccgctgttagcggccacccagcgcaaccacaccggtcccgcggcggggcccaagcgcgaccggccccggggcgctgccgaggttcccgcagccccgacggccggactctgacccagggatgtggggcccgcgtccctccgacgccctcgccctgctcacctgccagcagctcctgcaggctctggctgaaggtctgcagctgtcgctcgctcgtgagccccttggtgcggagaaacttggagatgaaggacacggcggcggcgatctcgcctatcatggtggcggcccgggtgtagaagggatgcatgggggcggcgtgcgggggcggcccggggcggctggggctcggcggcgcggccccgacggcggagcagccaccccgggcttcctcaccgggcggaaggctgagaggaagagagggcgtgaggggcggacgactacttttgtctttctttctttagactaaaaaagttattttcgagacaggaggcggcaggagagaggaagagacgagcgatggcggcctggtcacatcgctcggacctccccagctgcctccgcctccagctccgcagcattcgaagatctcaatagctgcatttccagctccgagaggcgaagagatgcaagcgccgtgcagcaccctttatagtgccacgaaaaggaagtggcgtagctggagcgtgatggccgactccagccaatccgaatatcgcaccattgtgacgcaagccgtaacttcagcagtcaacggagagaagagtggaaaccttactggatgcggacaggagagccagttactgaaagcagatataacgcggatcctgtaaagagtggtgtgtatccaaaaaaaaaaaatctgtacaatgtattttaaaacttgtgtgcacaaaactgaagattttcttttttacctagtccaaatgccgtcctagcctgagtcctgctctttataaaaataaaataaaaagaatttgaagcttgtgaaagtattaagtgtagacattcaagtttatttgaaaccctaccaaaaaaaaaaaaaaacaaccttaaaaaccagtgtaacaggaaggcgggagcctgctaaaacgattaggcctaagacagggttaaccccaactccattaaggagaagggggaaaagaaaaa

SEQ ID NO: 4391 - DNA, 606 bp, Homo sapiens
tgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccacccttatctccttttgctgactctcttttctgactcagcccgcctgcac

SEQ ID NO: 4392 - DNA, 6527 bp, Homo sapiens
gaaagtcactttgctaaggccaaataaggcaatcattgtcttaagtgctacaaagaagtcagtgtgggaatctgacaaagtatctcttgatttgaaatgagcaagtcattgagacaacaacttcaatggagtcactgaaattgaagttaggctacagaaaattaaagtttgatgtgagaaagtacagatagaaagtcaagtgattgtttttctcaaagtttagtcgtgaaaggaagaaaagataaggtagcagtgagactgagggagaagcagggtgaggtgaactcaggaagatttaaaccacctttatagggcgagaaggaggcaacagaacacgaaagagtgacgttttgaaaaataatgcgtaattgaccaagtaaggctctagagaagtcaggagggattaggattgaaagcacaggatgggggcaggaaagcataggtggagagatacgaggaaggagataggaaaatacaagatgtaactgagtttgaaagtagaggagaggcagctgagaaaattcttgccttctagatcttgtttttggagggaaatagacgataggactttgttggcaatagagttattatgaatagggtaggggacttgagaagagtataaaggtgtggaacagatgctatggggaatagggtaaatgaaaaaacggcagcatccaaggcctggctgagatttgctctcatgaatttgtaatatggttctttattaaacagacacttttggacaggtgtggtggctcacgcctgtaatcctagaactttgagaggctgaggtgagctgatcacttgagcccaagagttcaagatcagcctggacaacatggtgaaaccccatctctacaaaaaatacaaaaaaagtagccaagagtgatggtgagtgcctgtagtcccagctacttgggaggctcaggtaggaggatcacctgagcctgggggcatctaggctgccatgagccataatcatgccactgcactccaccctgggtgacagagtgagatgagaccctgttccaaaaaaataaaatccaccacttttcccccagcaatttctatcagcctaagagtagaggcaaaataaatgggcaagtggattggcaagaggcatgcttagagaattgaagatattagtaaatgtcagggtacaaagtagaccaagaactggaactgtcaattttgaaagatttaaagaataaaactatgagatagcttaataatagcttaatagatagtttaggaagacaagcctgaagaagaagatcttaaatctacatggataacaagttgacagacaggtggagagatgacaacagttaaggagaaggtggcaggaggttttgtgcccagaggtcaggcaagagttcaacgaatttgtattagcaaagtctaagaagtactattttttttttcacagcatatcttttatttatttattttatttgacatgtgctggtctattttttatttaaatttttatatattttgggggcacaggtacagatttcttatatgtgtatgttacagagaggtaaagcccagttggtaagaagtactattaactcatggtttcagcaatttaaagacagcccttttaatttaaaacagcccttttaatttaagacagtccttttaatctaagctgattggatctggggcccaatgagaaaacaaccttgattcagaaaacaaaaagaaacagttcaggccaagcacggcggctcacacctgtaatcccagcactttgggaggccgaagcaggtggatcacctgaggtcaggagttcaagactggattggctaacatggtgaaaccccgtctcaactaaatatacaaaaattagctgggcatggtggtgggcgcctataatcccagctactcaggagggtgaggcaggagaatcgcttgaacctcgggaggcagaggttgcagtgagccaagattgtgccgttgcattgcagcctgggtgacaagagcaaaactcggtctcaaaaaaagagaaaaaagaaacagttcatcctcggattagagacaaaaaaactagagtgtacttgaaaataatgggagtggcaaacaagattacatgattaggcaacagaaagatctggtcttcctaggggtggatcagagagggcctggacaagatgaagtaaagtcattaaaaaatatcaaagaagcaagattatctattaataatataggttgggcattctctacctgaaatgcctggggattagaggtgttttggattttaatttttttttgttttcttttaggcagagtcttgctctgtgcaggctggagtgcagtggtatgatctcggctcactgcaacctctggctcctgggttcaagcgattctcctgcctcagcctcctggatacctgggactacaggcgtgcaccattacgcccagctaatttttgtattttcagtagagatggagtctcaccatgttggccaggctggcctcgaactcctgacctcaagtgatcgcccgcctcagcctcccaaagtgctgggattacaggcgtgagccacagcgccaggtcagatattgttcttaaccacattttacagatgagaatattatggcttagagaagttgagtaatttgactgtggtttaagtgcgacactataaatattcaaagtctgtgccctatgaatcttctatgccagcagtcctcaacttttttggcagcaaggacaggtttcatggaagacaatttttacatggatgagggtaggggagcggcggggagatggttttgggatgaaactgttccaccactgctgatctgacaggaggcagagctcaggtggtaatgatcattcactgaccactcacctgctgtgcagcctggttcccaacaggccacagactgttaccagtccacagtctgggggttggggacccgtgtcctatgcggatataaaattatttggaagataaattcttctttataccctagaactgtgcagcaaaaagtaacaaataacaaaagcaccccttagaaggttgcctatatcatcacaatgtacctggcatgtttctgacctactccccccgacacaaaaacaactcgagaaatcagcatttctgttatacaagagaaataaaatattcagtctcaaaactcgtatcattcagaattggtcatctaaacccaactgcagttaaattattatcaggcatttctgcttttaagaaaaaaattgtataaaaatggtgtatatatatatatatatagtgcatatatacatctcttgccagagcctcagataacaaagcttatattatatcttcttaccctttctgttttatctgcacagaagagtcgtgtgtgatgtcttttttgcaccacaatataagttattcctggccggtaatcttcttccaagctaatacatgcctttcgaattgctattagttctggccaagctacctagaagacagaaatggaattatgtttaattgagaatttgcctagtatctctcagatctacccagaatggtagatgagaggaatctccctcagactcctaggggccccgaagggcaacagggataatgagagtacctgtttcatttgtccctcagatacccctccacggtaatagatgatccgagtgggtttgaagcgtgtggatttgtagaactgaatcagcagctctcgaaccatgttagtcaggtcctggatgacctcttgactgtagaggagctcttgggagatctcctgccgggaagtctgcacccgaacggtggcacagtaccggctggggtggccatccatactgccaaccacagcagcaatggaaggtttcttcccatcccctgctggggggtgtgtgacatccgctcccaggaagatgacaggctgctggaacaccgagggcctgctcagatttaaggagatgttgccactcagacatataagtgaaaatgtttgagtttagcaagattatatcaccagatataatcagatataaccttataagagagaacaaagacttaagcccattgggaaagaacactacggaccactgaatattgatgtcacccagtacagtgactctggactgactgaagaagtgaacatggctcttctataacagtaggaagagaagatttaaaaaacaggacctaggctgggcaccttggctcatacctataatctcagcactttagaaggccaaggaggaaggactgcttgagcccagaagttcaaggccagcctgggcaatatatcaagacccaggtctctacaaaaaataagaaagcccagcgtggcagcgcctgcctgtagtcccagttacttgggaggctgaggcagaaaaaaacatttaagcccaggagtttgaggctgcagtgagttatgtactatactacactgtactgtgtcacatcactgtactccagcctgggtgacagagtaagaccttgtctttaaaaaaagaaaagaggccgggcgtggtggctcacgcctgtaatcccagcactttgggaggccaaggcaggaggatcacctgaggtcaggagttggagaccagcctggccaacacggtgaaaccctgtttctactaaaaatacaaaaattaaggccgggcatggtgactcacgcctgtaatcccagcactttggaaggctgaggcaggcagatcacttgaggtcaggagtttgagaccagactggccaacatggtgaaaccctgtctctactaaaaaatacaaaaattagccaggtgtggtggtgtgtgcctgtaatcccagctactcagaaggtggaagaggcaggagaatcacttgaaccaggaaggtggaggttgcagtgagccaagatcacaccactgcactccagcctgggtgacagagcaagaccgtctcaaacaaacaaaaaaaaaaattagacgggcatggaggcgctcacctgtaatcccagctactggggaggctaaggcgggagaatcacttgaacccaggaggtagaggttgcagtgagccaggatcacgccactgcactccagcctgggtgacagaggaagactccatctcaaaacaaaacaaaacaaaacaatacccttttttttttttttttgagacagggtctcactctgttgcccaggctagagtgcaatggcatgatctcagctcactgcagcctcaacctcctggactcaggtgattctcccacttcagccttccagatagctgggataaattcttaaaggtaggatttgggactgcgagtgttaattcttcaagtgtaatttaagaggcatcccatacttgacaacctcatataataggtactaaaggtaaggtcccatgggagaagaggctgtgtcccatttatctctctgtatcatcacagaacataagcctggcacagagaagttaataacagcggacatatataggcaacacacatatatataacataacagcttacatatacaacgtaccagccactatgctaagcacttcacacgtgttaactcatttagtccttaaaattttatgagggtggtacaattattatctcaatttttccagataaaaaataagacataagaggataaagaatgttcccaagatcacacagctaggagaggaaaagctgcaatccaaaccaaagaagtttaacgccaaagtatgcactctaagccactacactatattgtctcaaatgtttgggttaaaattaaatgaagacagactttaggttaacttcccctatggcccatatatctcatcactaatgtttaaggagggatttatttacctagaagtttcatccaaggacaaaaatgagaactgtgttgggaggctgagcgggtggattgcttgagctcaggagtttgagaccagtgtgggcaacatggagaaacctcgtctgtatgaaaaatacaaaaaataagccaggcgtggtggtgcacacctgtggtcccagctagttgggaggctgaggtgggaagattgcttgagcctgggaggcggagtttgcagtgagccgagattgtgccaccgcactccagcctgggtgacaaagtgagacactgtctcaaaaaaataaataaataagaaataaaacattttctgttcatcaaaagccactgttgaccaggcatggtggctcacgtctataattccaacactttcagaggccaaggtggaaggatcacttaagcccaggagttcaagaccagcctggacaacacagcaagacctcatctttaaaaaaaaatttaaggctgggcatagtggctcatgcctataatcccagcactttgggaggccaaggtgggccgattgcttgaggtcaggagctcaagaccaccagcctggccaacatggtaaagccctgtctctactaaaaatacaaaaattagccgagtatggtggcatgagcctgtaattccagctactcgggaggctgaggcaggagaatcgcttgaactcaggaggcggaggttgcagtgagccgagattgcatcactgtactgcagcctgggtg

SEQ ID NO: 4393 - DNA, 664 bp, Homo sapiens
atgccttaaacttatgagtaaggaaaataacgattcggggtgacgcccgaatcctcactgctaatgtgagacgaatttttgagcgggtaaaggtcgccctcaaggtgacccgcctactttgcgggatgcctgggagttgcgatctgcccgaccttattcacgcctaaaaagtagactgactgtggggtggtcgtgttttttgtttcttgttggtaggtggtgaatgcgtttttttcgttgttttctccgttactcaggctgccagttgcttggcagtcttgtcgctggctgtggacgctctgcacttcatcaccgtccccagctgcgctttgagccggtctaaggttgcccacagtattgacgttgggacccacgaaactggcaatttccatgtgtgcggccttacccagttctcccaaacttctgcgtataaccgcttctctgtgcttcagaaagataagtccggccccggcctcacacagcagctcagttcgtgacagcgtttaatatgtaaaatggagcaaataatttatagggcgttgggagagttaaagagactaattcatttacgtgttaaatacagggaatggcttttgcattgatataaccccagcctccagcatgcgccagacctgacgtaggtgttcggcacatattttgtcca

SEQ ID NO: 4394 - DNA, 664 bp, Homo sapiens; identical to SEQ ID NO: 4393

SEQ ID NO: 4395 - DNA, 47120 bp, Homo sapiens
atcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggattatgaagtattaattcttccactgatatctcaaaaggtgatctggacaaaggaacaggtatctcaggaggcggaggcaggagtattgctgagcccaggagttgaagactgcaatgagctatgatcgcgtcactgcaccccaacttgggtgatagagcaagaccctgtctcaaaaaaaaaaaaaaggtaaagagatactaataaataattcagataacacataaagaaataaatatagtcaagataagctataatcttgtcactcaactaaaactatgaaacttttggtgtatagacttttattacttttatttttttgagacagagtctcagtctgtcacccaggctggagtgcagtggcaagatctcggctcattacaaaccctgcctctcaggttcaagctattctcatgcctcagcctcctgagtagctgggattacaggtttgtgccaccacacccagctaatttttgtattttttagtagagatggggtttcttcatgttggccaggctggtctcaaatgcctggcctcaaatgatctgcctgccccggcctcccaaagtgctaggattacaggcgtgagccaccgcacctggcctttgtatagatttttaaatgctagacttctttgatattattgagcatatattttatctaattatgacacctgttttgattctgtgcttaattaagcaattttatgattataatttggctataggaaaagaatgtatgctttatatggaaacaagtattctggttacattgatgggtatattgtagtaaattaataaactggcacattgaagattattcatcttcttatgtcagctgtgctgattgtccttataatttatctttgcacagttgactaattgtttccttaccaaatgtaattttagtcatagaaggtgcagtgaatactctcaggactctgaaatatggttcatacccatggaaaaaagcctaacaaaaatactgatagcatggttccaaagcgggcatgaggaggaatatgcatttggaggtgttagagaagataatatgataataatcagttactatagttttgttaggagaacctccctcattttttaactgtacctagataacgaactttgtcagtttatttattttttttaatttcttaattttttgagatagggtctctctctatcactcaggctggagtgcagtggcatgatcatggctcactatcctcaacttttcagtctcaagtaattctcccacctcagtcttctgagtagccaggactacagacatgtaccaccatgcctggctaattttttggatttttttttgtagagacggggtttctgccatgtatcacaggccgatctcaaactaggctggtctcaaactcctgggctaaaacagatcacccgcctgagcctcccaaagtgctggggttagaggtctgagccaccgcacccagccaactttgtcattttagagatagcagcatatgctttatcttggtcctgaggcatggttgctggaggtcaagtctatgcagttagctacgatgggccacggaaagattctaaacttcttgtagtcatccaagtaggtggattgcatgcactatttgtaattgaaaagtatgagttcctgtttttttgttgttgttgtttttggttttaaggagctgagagtttaataggcaagaaggaagggagaagacagaaggaagaagctccccctatacagaggcagagggaggggggatacaaagccgaaagaggaggtccctacctgctaaccataccagccaggtatatatgcagaggctggaggaggcggtgtttgatttgcatagggctcaggggattggtttgattaggcatttcattcacatggcccatggaaaaagctggccctcccactctagccttttaatatgcaaatgtagggtgccatgatggtctacacacgtggggatatgtgggggtggccatgttgccaggaacctgtggggaaagggcaagaaggcccggggcatctccatgtttgggtgggcccagtttctaatggcctgcatttgcatatcaatggttgctggcctggctctgagagccagggctttgcaagaaacttttccagaggtgctttaacaaacaaaaacttcccaaggaccccttttcctacaacattcccccctgtggagatgccacactaactgctgttagggggtttggggcgatgactctttctggctacttcctgctgaaaaggggcatcgaatggggaacagcagctaaggctccttctggggtcgatctaaggatcctcggaagaatggcgtgtggttcagtttacagcaccatttgaagtttgattgcttctaggcgagaagaaacaatttgagttataatattgagtatacagggtccaaatatcaatacaagacagataagcaagagagtgcttaataaaggggttaaccaattccataaagaagactggaatttattaaagagggattgtagccactcgggctgaagctggcattttccctgagcctgtcaataattttgatttgatttctaagtacgcgtagattttcctctactttactagagttgttaatccaaaagcagcatgtttcatttaaaactacattactaaacctaataaaaagtcctagcagactcagtgatagtaaaactttcatgcttcctttttgtcaactattatccttgctataaggataataattaagcaaaatactacagcaatggaaactctctgtccaatatttcagttagaaggtggtaccatgtgtaacgctattgcaaatagtagggtgaggacagcagttcccacaaatgtggtgtggcaggtaatttccatctaaaattttacttgccaagatattagaattcccctttgggggtctatgaagttccctggttttattttcccaaacagaaacctccaggttatgggcacttactttaattatctggcagaatttgcaagataattgcccagaactagcatattgattcacatttttaccttacccatccctattcttttattccaagctgcagaagatcaccacgtgattcacaggaataagcaaggttagtctaaaacataggcaaaaagcttaaaaacaattaatgagagtaggctttaatgacaaatttatgataagctttggggcaaaatttttctctccagtcctcatttttggtaaaaactatgaataaactttagtcttatacttggcctgattatttgcataaagtgcagcaagaatggttatttttacataggccttttggattggctttgatgaaactctgttccacaaggaatttcagataagacttaaagccgagcccagccatgggttgtatcctttaatacctgtgagttgggtgatcctctcctcttgagttcccaagataaactctgagcttctatacctgttagaaagtgacattctttactgaccacaggttaggaaccctgtgtggggactgtgcagacaaggtatgaggccagttctccacaaggggcttttattggctttgcatgtcaagcttgattccttaaagggaaacacaccctttcagtcaaagccttggtaaaataaccagtttttccaattgtgtcctgttgacaaagaaaaatggattcgtattgcactgatgcaaacaactatattgccataaattaagagtactcacagatagtttccaaattctaggggaaccaggcagagaaaagtaaacatgctccaaattttgttcacaggggtataccttactcaatcattaaaggccataaatagtttaaaataacttcccttgactctgaaaatcaaaacaaggattagcaatattccaagcaacagtcaaaaaggttgctttaactttctgagtgtagtccacttagttaacttttgttttgcttggtatttgtcaacatgtcaattctttgagtcctgtacattctttatttcaatgttacaatctttaaggctattaaaaacctgcatttaacaacacctgttaaagtccctaatatagctttattataaactgtcttttgagaaggaacaaaggaagacaacaattgtctgcgaatgacaaatttccaggatagttacagttaaatatatgactaagaaagaagtttacttatcttcgtggtttacaataactttacccttaattatgattgatagcatatacttagacattagaattttagaaatctcatacaattttggaacatattagtatttattcaccaaaatataacttacaacaatataactttatagcaataaagaagattggacatcattttggcaatctcatgtgactaaacatgtcaagtgatcttgtttacctcttttctgaatatttcaggggccctctgaaccatccagaaagccaggcagcagtaatgacaatttccagattgccataaattattttgtaaaaataactcaaaaggcaaaagcctttcatcagcctttactatgatatgaaaattttgttcaaagcaaaatttttcccttgcattagtttattaatgttaattccagttcgtttccatgaacccttatagattatcccgtctaatcctaaccaatttgaccatgaggtgaaatctttacaaaccttttgtaacccttttactaaagggcagattagtgtcttaagacctccttgctgtgcttctattttaatgcttaattcatgaaaagaccgtatagatgctatgggagaagatggtgtagtgcttctaccatgcatttcattgcaaggcaacccaaagccaattggcttattttgtaatcagcccatccctgatgggcgtctcatctcccagtgggggatggggatgtttccttatcttccaggtggccaagagcatgcttctctgttttgtaactgctattagccatcccttactgtgtattttctacctagttattacacaccaaagctctctcataatgcaaagtaatttctgataacccccaaaactcaaaaccgtcagataacacagtgcaaaacagaataaagcctttgattttgagagggatctatctccttttaattcctggggtttcatgaggaaaacaggctttttctgaaaacagggtttgcggtgcctcctctgtttttccccaggagtcccatactaccagaagttattttagggctttttatgcatgcattaagaggggtaagacaaaaaacggagaaaataattcagtcaactgagaagaaaagagcccttttccagaaaagcaagattcaagaagagaaaagcataaaggcctttaaatatacctataacttgaatatttacttttaattaagctgagcactctttaagaaaatccttttaaatcccttgttacttgactttagccacaccaagcagttaagattttcggcttttgaactttacagaaagtacccttataggtgaaaccaacgagccttaattaggttatgatttaattacgagtgtacaaggtatttttaaaggagtgatagacagcttttgaaactgtcattgcaaaactgtcactgagacagtcaaagagatcccacccaaacaactccattttgtttccaggtttccagccctcaagctgtccttgcccatctctgggtgtaggctaaaccaactttgggaggagcctggtttacagtctatagtctaaaacaaagacgataacagcggcttcccaagatatatttccctcttacctggggaccagtccaagaaactaaccacaggattagaaaccatggcccaggagctggaggccacaagattttgaccctccctaaactgctctcaagatcagtacttaagatattttgtaaaccctgcccttgatagatcagctggcaccacccagattgacaaactggcttatctgatttagcacaaaaagacagccaccattgtaaaatggcggagactaaaacaaagtattgccatgcagttacagatgacattcccaaagacatgaaacaagatggagacctgtagccgactttgccactgaccgctttgctggactggcttgaacagcaggcttatggggtcctgggcctgcatcctaacctaagattccctttctttgacagaaccatacagaaagacatgcaaagcacacaagattgtctacagcttaaggccagccttacaaatcctttttcattagttatacatttacagagaacatcaacagtgatccttattatcccttttaccggtttgcacaaggagagagaagccaaaagcccaactgctaagaaatgtttacccttttgccggcacatcaggcttctgggtccactttcccctagctcaactctatgccaagcattttaagatttggcaaattaacttttcctaggttggaacaacattataaaagagacagaagccattttaaaccacaaaagaaggaaaaacaccttagaaaggagtttcaattagggttgttaagaagtaatacctctcttcctattgggaatggtgtttcccctatttctttgccttccctatttttctcttttcccttctggcccactataggagacatattgcttatctccaaaattttcttctgcttgcagagctgcctgttttagcagcagtgagggtttgacttagcagcaacataacatccctccatatgaggtcaaatacgtgagttaaattttggaaagcttctatatacctatcagggtcgtcagaaaatcagcctcagtttgcctttacttgcctaaggtcattaaaggggcccaaaataagagggaccatcagatgatttccttgaaagttacttttttaattttggggaactagtttccctggacctgcccgatatggttgctaaaagagctggcttgatcttgcaatgttgcaaaggtctagtaaaaagaccatacccttgtgcaaaagaaaataagccactttttcttcaaagtttcaaggtcgaaggagtcccagtgcttcaacatatactccatgggagtgcacattgaagacgatctgttacccatctagaaaaagaagtgagaataaaagcgtccttttagtctccttcctttcagtatgtgatccagggtggagatgaaaacaatagagggcatccccccaactattttctctctgttgctccaggattcccggcacctgcttaaatgtgccacccatgactgcaggtgtgaccctccaagctgtggcaccagaggaactgagttccttggtcacgctgtccccaagcaatcagtactctgccttttatttccctttgaccttctagacttgcgtggcctgtgtgccttccaaaacacggatttcaagaaaaaccatgtaattgggcaaggcccctttaagggagggggagtgctagattgaactgtgtattctgctattatagcccatgctaaagcatttactcatggaagaatggttctggttaacttccggactcaaaaatccccttactaattcagtactgtcttaataggagacaaaatcaatgccttaaaggaacgtaggagcctaatggccgttttcctgccagtggggacaatatcgagactaaaattcggctagggaagacatcttactcctaactgttaaaagcaaaaacttcccgttcccaaaagaggcctagagcctgatttctactaggcggcttagaaataccatgtgcttgccagggaaaacagagagagaaacatttattgagttactgcctgccgtgattcacgatcttttctgacagacctgttttccctgaactgtaaagattcctgcacattgaacacccagagagagggtaagagaccaccaatagaaagtttggtgacagggtagctggaagaaagtcttgagattaaaggacagatttgaagttgagatccgctccatactcaccagtctgatgattgaattttccttttcccgcccatgcaccaaaatgatatggctctgatgagtggaggaacaccagggttcttgttcctcaggctggtttagataaaacaacatggacacatgtggagtggttttaaggagtggagagtttaataggcaagaaggaagagagaagacagatggaagaagctcccccttacagagacagagggaggggggcaccaaagctgaaagaggaggtcccccaagttcctgtttttattagcctggaacttgatagtaatgacattaactgaaagtaggacataaactatatattttagtttaatatgtaaaaggatcttctgcatcactaaagaagaaaagtgtcttgctgggaatgagattaggaaacaaatttgggaaataccattgttccttttttgtggagaaaggtaccctgtccaaaaagaaaaatgtcttgctttgctagataaatgcaccgttttgcctaaaaaccagtgtaacattttattctaagtcagaagtaattactgagctgtggttttgtgttctgtatgtataatctcatttattgacagttctaacctagtaatgaaagtgcaacaggagaattataaccagaaacatctaactgttatattatacatacatgtactgtttaactgtaattgtgaaaatgcattttgaaagttggaaaaaaagaaaggttgcctctatggtttggcagcttaataccgaaaagtagacagtgtcttgcgggtcatagatcatgggactcaacataaagtcatacagctaagacttgttacagcaacataataagcatatatagcctttctaaggttagcataagggaaaaagagaaggtagagtctggaggaaccagcgtgcaggtctccttatgctctctccctctcatgagtggtcatacagagcgcattcttgtagcaataaaaatttggcaacacgtgtgccatgtttctgctcgaggagcccattagagacttggcacccaaagtttctattgtaggttggtcctgtaggcactttctgctttgcatgtaccaaaattccacattcccagaaggaaagcaggtattcaacatgacccacttttatttgcacaaacaatctagtaaaaggccaaccttggcagcaggtcttcctaaggatactagtctcagtctgtgcacataagctgaatgtgtaaaatggttaaatactggacccttctgtaactgatcacatgcaaactgcttaagggcagaagtgggccagtttaataagaatgagtttaaatacatgattcctgttgtatttggggcatgctaaaaaatactgggagtcctttaggttaagttaaagacaataacctaagcttacaggattttaaacaaaatctttgatatattggctgtttttgtttgcttccttttgctctcatactatgcatagagttacctgaaagaattgtgttaatttaaaaatttggatgtcattccttccccacagtttacttggaaattggtgttcaaatatttggaaggagccattctttttttttttttttttgagacggagtctcactctgtcgcccaggctggagtgcagtggcgcgatctaggctcactgcaggctccgcctcctgggttcatgccattctcctgcctcagcctcccgagtacctggtattacaggcacgtgccacaatgctcagctaatttttttgtatttttagtagagatggggtttcaccgtgttagccaggatggtctcgatctcctgaccttgtgatccacctgcctcggcctcccaaagtgctgggattacaggggtgagccaccgtgcccggcctggcaccattctttaagaaagaagtacaagggaatattagatttttattgtgtggtttcacatcagtgtaattagaatataggaaatttgtttaaaataataggccttttcatttgacgagatttaaaaacacagattggctgtggtatctgggcataatttgatatagataatagtattttcctccatatcgaaaattgaggtaagttttataacctctttgatgcattttcctagtagagttaaaaatgttgaagtatagccaccaaaacattcatgttggttatccttttttttttccttaatgaaaatgtactactttggtggaaaaaagttaataatttcgttagttggtaggtgaataatgagtgatagagactgttctgacaccaattgtctgacaccaactgggtatcctgcaattcatttcaattctgacactaactacccagagttaacacaaactaccaggcacacaaagtgttcatccaccaggaagctccttgaactttgagtttgcagagttttattggccacatgattaacttccttctccagctcctctttaatctctgaacatctgggggtgtggctaaaagttccaaccctctaaccatatgcttggtctgtctggcatggccagctcgtcctttcaaactatgtgagggcctaccttgagtcacccccaagtataaactcagatatagtccaaaggggcttcttatgaataacaaagacacttccattaatcaggaaattccaagcctctctaagctctgtaccaggaacaggagacaaagactagatttattcttcattatatgacagatacatttttatattttgcctctggttttagtaaagtttttgttgtgaagaacacaaatgccagatcaaatgagggggctgtaattagcaaggctgcaagggattgtgagcagtaagggagatagggattttactggaaatccaccaaaggaactggtatgtagctatgcctctcagtaaggggaactagaaagctattaggaaatcaaggcatctggagaaactatgtgtgtgtgcccaccaacatgttcatgtttgcgctgcatttttgctttgtcatcctcttgcctcaggttgttttgctctcttgtttgactttctatgcccttctctaccctagggcttctacttagagtttctgcttccacaggactccttacagcttaagttctagtttatatgtggctatgcatattgaaaacttgggttctttttttggagacagggttgtacaggctgttgcacaggctgtattgcggtggtgtgatcatagctcactgcaaccttgaactcctgggttcaagtgatcctcctgcctcagcctcctaccaccccctgctaatttttgttattgttgttgttgttagagaatggggtctggctatgttgcccaggttggtcttgacctaagggcctcaagtgatcctcccacctcagcctcctaaagcactgtgaatttcaggcatgagcttgagttcttattaactgtcagcctgactggctctttcctagctaggctagtcagctcggctgaggagtcaagggaggacaggcttattactatggaaagcacttccaaaacattaaaatgtttctctttaaagagtgtttatcaatgctcaaacctgaaccagaaaaagaaaaaagaaaaaaaatggaaaagagtgcttaaaatattaaggatattaagcatgtcaatccttttcttattcctaataccaaaagaagaattcctaagataaaagattgataagtgtcatgacatgaaatttaattgagtttaacatatttaagtaaatatttgacttttgattttgtaagatcagccgggagaaaggacaagagagcaagacccaagttcaggcaagcttttattaaacccgccggctgctttatcacagacaaaggaggcagcagcagccagcttacagaatgaggggtttatattggggagggagtttgagggagttctttggtatggccgcatcccggggttgtttgctggtttattctgccacattatcaccttgtgacgtttatggtaccggagattgtaggtaaagtttgtttatgcttcccacgacctccctctgtgcggtccggatggtttgtaattggggtttgctttatagcagcgaggcctgataggtaaagtctgctggcttcactgtggcgcctagataagggcttagaaatgtaaaaaggcttggggcagcatggagaggagttgcagagtggggaggggcaggcagcaccaagaagcttcttgaggcagtttgtccctaacagatttattttcggaaaggaattctgaactctgagaccaaatcagtatatttgtgtatattttttcatatacttccaaagtcttttaattcttaattaacctgatatttaagtgaaaagggtttactctttatcctagttaattacatattccatttgttaatgaaactatcctttgctcactgcgttgtaaacacatctttatctttctttcttcaaacatagaagccataaaataagattcataaatgcagctacataaaaaatatttttaaatatttaaatattaatattaatttttttaaaaataaaatattttgtgtcaaaatgctctaaatgaagtcaaaagagaaacaagaaactggaaaaaatatttgcaacacacattaagtgctaatctccattaatatataaaaagcttctaaaaaaataaggaaaattaaaagaccctagttaaaaatgagcaatggtcatgaacagatagttcccaggaaaaccaatggcactttaatatataaaagcatgcttaagtcatttataggagaaatgtgaaaaactacagaaagttaatatttgagaactttgttggcaggactgtgggaaaactggcacttatagaatgctggaatgcaaaataatataatacttatgaaggatactttggagatatttatcaaagtaatagttgccctggggaatctccctgggctctggtgggtggtggctgtggggctgcagttagtgcgtccaggccctgtggcttgttgggcatgaggcagcattcgtacaccttccagggtggcttttcttgctcagtttctggaaaggaggaggaaatgctgcagcttccacagtacttttgcttaagacaaagccagggatctggaatttcaaaagagctggggatagaaggtttgagctggccccacccagccctccatttgacctccaaagcaggctgtttcctgctgctggctgagtagaggcggccttcctggagggaagggagaaaaaaaaattaaagtcgcctttatttgatctagtgaatcctcttctaagaattatcctacatagctgaaaaagtgaaacaagttgtatatgtaacattgaagaatattttataatagcaaaaggttggaaacgatccaggggctcatcaataagggactggataaactggtagattctcacaatggaatactagaatgctttagaaatgaatgaggtggcagtctatgcagtaatagaaaatttgaaggctatattaagtgaacaaaggcatataaagataatacatataatgagttttcttctgtggaagaaaatgggtgaaacatatgtttacttatattttttaaacatatagcactgagatatgaaagcagttacctctaggtgctaggagaatggggcaggtgtatccagagtgagaacaaaaattttctatatacaatgtttggaagatccaggtgatttgtttttccttttgtgtgtggtaaaatatatatagcataaaatttaccattttaatcatttataagttgcagtccagtggcatttcttttttttcctttttcttttttttgagacagtctcactgtgttgcccaggctggagtgcagtggcaagatcatggctcactgtaatctcgacctcctgggctcaagcaattcttccactccttccacctcagcctcctgagtagcccgtgccaccacgcctggctaattttatttttttgagacagggtttccttttgtcacccaggttggagtgaagtggcaccatcttggctggctgcaacctccacctcctggcctcaagtgatcctcccaccacagcctcctgagtagctgggactataggcgcaggacaccattctccactaattttttaattttttgtagatatgagattataagttgttttaaaaaaagtaatatgtgcaaatggtaaatagtacaaaattcaatttgtactaaagttgttttagttaaaagtcttctttctgcttttagattcccagttctcaatcttccttcctccttacaagatacaagcaaccttcaaccttcccagagatggtctctgtatatgaaagacaatggtcttattatgaagtcggcatatttatagcttgataaaaactgaaaaatctgtagcctatttttaatagtgatatataaggaaataacataaataaaaatttggcaacaagaatccaggagcaaatttatgatcaatacacaattgggcaagtggtgttcataccaaccatgcaaaaatggttcaattttaggaaatctttgaatatagcttttagtaggtcagaggaaatcagtatctcaaagtactttcatgatttagttatttttaagttattgatcattttggattttattttgaggttgatagccatataatgatttcacattttattttaaatggctagctgttgtcccaatactatttactgaaaaatctacattttgctcactctttttttttttttttaagagacagggttttaccatgttgcccaggctagatttgaactcctgggctcaagtgatcctctcgacccagcctcctgagtatctgtgactgcaggcaagtacccctgtgcctgctcacttatttaaagttctacacatcaaatactaaattctcatctatttgacttctggactcactggttggtgtcattgactgtcttttcctgtgatagcatagaattattttgattgtggaagtactataaatgttgctatttattgtgcctcttgctgcctatctatatttagactcatttatgtgatgccattctgtatactctaaattttttggttctattttaataatgtttgagtcaatgacttttcatgactcttgacttccctacttcaacagtttactagtctccatcttgaatgtttttattaatctattttgtgttaattctacccaggttttttgtttttccttgctactattatatatatttctgccagatgtcacatggtataaatgcctatatggacttttgtaacagaaaatttacttactagaattaatgtagggggctttttaataagagtgcatgtaacatagtaacagtagcagagctatatcagaaacagttctgataatatttcatgatctatagtttgttgcatgcccattgcttcatactgcttgtgttcttggttgagtcataagtaatttttatggggtgtgtcatgactgtcatattcatagagagttgtctgccttgccccatggtctttgcatggcttaaacaggaccccttttcatacacaagtcattcaattttatgtttttaatagcatcaattttagtgtttaacatgtgtctctggactatgcatcagaatacttgactgttagtgtgaaatgaaaattcatggatatcataatttatgtaacataatttaacatttctttattaataagactttagattgtccctttcacaaaaaaatggtgcggttaaaacttaatccttgtgtctttttgtgagtagttctatgatttctatatgatggcatccttgaaaaagttggtaaaaataagaatagttcttatttattaaagttcttctcaaattgctcttccaaaacattttagtttatactgcaatgttaaccattttacacttgcttaagtaattttcttcaaatacacacgagtccaggctatttaaccttattttaccgctatagcacaaaacaggttttccaaaattgtccttgcacacctgggattttacaaggatattataatcttggttcagtttgacttactgaatttgtagtaagtatattttagcacatagaaaattcaaaatatgtgttaatctgtttatagggtaaatttttatgagggtggatgtcatcctgttttttttttttttaataaatgttttgtttcagaatgttttttatttacagaaaagttacaaacatagtacagagagttcccaaatgctccacaccgagttttccctattgtttttttttttttttttgagatggagtctcgctctgttgcccaggctggagtgcagtggtgcaatttcggctcactgcaagctccgcctcccgggtgcaccccattctcctgcctcagcctccggagtagctgggactacaggtgcccgccaccgtgcccggctaattttttgtatttttattagagacgaggtttcactgtgttagccaggatggtctcgatctcctgacctcgtgatccgcccgcctcggcctcccaaagtgctgggattacaggcctgagccaccgagcccgaccagttttccctattgttaatatcttgaattagtatagtacatttgtctccttctcctttttgcccttggtaacctctaatctactttcagtctctgaatttgcctattccaaatattttgtataagtggaatcatacaatatttgtccttttgcttctggcgtatttcacttagcacaatgccttcaaggttcatccatgttatagcatatgtcagaactttattcttttttatagctgaataatatttcattgtgtgtatatgccacattttgtttatcattcattttgtttatgtaccatgttttgtttatatacatctattagtatgtatttgtttagatatacaatttgcttgtataccacattttgtttttctgctatctaatggattatgctgctctggaacattcatgtgatgcttttgttaattgcttatacattttattaagctaatgagcttggtcatagtaacatataaaatcaagaatcgtttaacttttgcaataaaaatcttgatgttgactctgaagtagtaagatgcaacttcaatgtactgggattgaggcagccatagcaatattaccacaggttttccaaaaattaacacaaatattttctattctagatgtgatatctttggcatcactgttcattcttttcctccttgattaaagtgaaacaattacattaaaatagttttatgatttaaaaatcattctttttttaagctattatttttaatgtaggtcagtgtgttatgtaaattgatgtccactacctgaacatgtgatgctttctcttttattccttggtatttcctccatattctctgagggccttcagtcaatttttttaaaggaaataataagttcaaatatgtatctatgacttagggttacaaagaatattttctttgcctccagtatactttgtattaaaaaaattataaaaggccataggtattcattttcaaatatttgaaaaaaaaaggcatggcacaattaaagcatatgcagaaccaacttggattattgctatatttctttctttctagtgtgtacggatattgatgacatttttaggtggctcttaacaagaacattttcctctctttagatgtgaatgcatagaattctttcatttggaccaggatcgttttaaaacatttcctttattttttgattaaatttttttccttttaaatattaggacttagttttttattaaatttgaacataatatatttaacatacttacggatacatttttgtgggcatatttctctgacaatttctcttattacaaaccaaacttgttagtgacctgattttgtgtgtgtgtgtgtgtgtgtgtgtgtgtgtgtgtgcgcgcatgcgcgcgtgttttgcatttctattctttgttttctagtttcatccctatgctaggacatggctgtgttcgtttctctttcactagatttttttaatgactgtaaggttattctacgcttgtaatctgcttttgcagtacttttccatcaaaaacaactgtgttacttctcatttaaatatttatttatttatttttgagacagggtttcgctctgtcacccaggctggagtgcagtgtcgtgatcttggctcactgcggcctctgtctcctgggttcaagcaattctcctgccccagcttcccgagtagctgggactacaggtggacaccaccactcctggctaatttttgtatttttagtagggacggggtttcaccatgttgaccaggctggtctccaactcctgacctcaagtgatctgcctgcctcagcctcccaaagtgctgggggattataggaataagccactatgcccggcctcatttaaatatctcttaatcatcttttacctgtttttccattctaagcagtgcattcttttttttatagcagtcttttgataacaatagctaagaggccaggcacggtggctcatgcctgtaattccagcactttgggaggctgaggcaggcggatcacctgaggttgagagttcgagaccagcctgggccaacatggtgaaaccccgtctctacttaaaaaaaaaaaaaaagaattagctgggtgtagtggtgcatgcatgtcatcccagctactctggaagctgaggcatgagaattgcttgaacccaggaggtggaggttgcagtgagccaagatcgcgccactgcactccagactgggtgacagactaagagagtctgtctcaaaaaaaaaacaaaaaacaagcaaacaaaaacctcccaagagttaacattaactgagcatacattaaatggtaagtgtcacacactgttctatgtatgcatagctcagtttttaacttaggaagtaaattctaataatattccttatttttttctgatggggtaattgagggcagctactctcagtaacattgaacccgatagcacatagtgaagactcattatctttatcaatgatgtgtcagttggaggtaaaaattaggtccttttcaatatccagtggtgactgtgctcctaggaagatcagccaaggatacacagtccgaaaagtttatagcttaggtaggtaggattaagtgcagtgcctctctagtacacacctggatgtgactcttgtgtccacatgtttttcaaacctggcaggaacaataaccccattcagaaatgacttctaaaaaggctatttttgcgggcttgcaggcatgcacttgtagccctagctactcaggagggtgaggagggaggattgcttgatcccaggaattctgagctgtagtgagctatgccgattggattcctgcactaaatttggcatcaatatggtgacctcccgggcacgggggatcaccaggttgcctgaggaggggtgaaccagcccaggtcgggaatggagcgggtcaaaactcccatgatgatcagtagtgagatcatgcctgtgaatagccattacacttcagcctgggcaacatagcaagaatcaatctcgctctctctctttttttttttttttaaagagccaaccttaggaagaaatgcctttttttttttctttttaaaggacatttcttctaaggttggcttgttttagggatagccaaacctacaggttgttctaattgatatactcatctcaccaacactaatgttactattgtttttattacatttcaaagaggtcatcaaatcaataaaagttcagaacttggcaagaatggctagccagtaaattctagactttctctttgaacccccatgtcttacaatgcaagaatgtaacctcttaattgctctatttgtattacattgtcatctttggactttcctggatacccttgatctctctggtatttcctgttatggtgagtctgtcctaacagccttatttatagacatgtttttgcacattaaccacactccatggaagaagccctttaacatgagacttgttcctaagtactccactggcttaccaagtataggattaccctttgattactttatctggctaccaggacagagagattcttgggagccaaccagccatcaggtcaactattttgctacagatactgctttctgggtttagtcccctgtactttcaggtcttcagcctcagtttgacttcctggcttcttcagtgaggattttagagttatgtcaggtgaggaatcaatccatccagtctgaaatgttgctgggaggagggctgtctttctgtaacaggggaaagttttatttatttgaactacagaataagttatagactataatgcattgtacaattgtttgattttaaagaaaactcattatagctttactgttccaaaactgaacatcttatgtctgcattcctatttatttatgatctactctgggccttgcagatattctgtttcctgggtcctctagcaagttaattattggtattaatcatctaacaaattagttattaatgtacattgtacagataagtgtgaattggagagaataattttaacaagatcagaatgccttccagttcaatttgaattcgaaggcttaattcatggcattttatagttcaaagaaagctttgaattattttggatatactaacatatattacaggaagagaagtatggataaatttcccaatagttgcctagcagaagtatatacttagtatatgacttaccaagagagtgatcacgagtgatttagggagcactttgtaggtttcccctatttacctttagccttttaccacatcaccaatgacctcttattttcatactgtctatagaattaagttagtctgcccaagaagtcactttgtttgaccctggtcccagtgcattcccaaatatcagggattatattcccttacttttacctgggcattggatgcctcatgttcccttatatcaaaccttaaaggtagcttttaggcagaatctggtagtgctcttgtgtcctgagggtaggacaatagaagaaaaactcatttggcattagactttttcatggtgcttatttggaagaccttcttcatcttcagaatattgatccaagtcctttggggccactgctactgtcagagttgttttgagtttggcagtacctctccagagcctcaaggtaagggacatgtggtttgagaagtggaatacaagtccataatctatacaatactagagcttaatagatgattactttattaccttgattatacccatcaatttttaggtgtgaacattgagatctggggttgggtgtagggtggcttgtgtgggcttccccaggctagattgaaaactcaaacaaactgcatatacccttctattacttttgtttttggagtttaagaagttttagagtcttggcttctcatttattatataacaaaagggaaataaaaagtaggagtgggatagtgtatagctggtaaacatctcctgtaatacaagtgctgatgttattgggaattttatttgaaagtttttgggaaggggagatagttaagggtagggccctgagggtttgggacaggagggaagggaagggatggaggatctatctgtaatctgtttcaaagaaggaaaaactgcatagtgctttgaagaaattgggcatcagtccaagaagaaatgtgatgccagcagccatcttcacatcacccccaagcctgttcccctatcttgctggcaagtcatagccctacttttacccccttttgctggtttcatgtattttgagggtcagcaattgtccatgcgctgggtgagttcaaacactgtgtgagggaccacttgggtttaggacacgggaactatgtggaagggatggtttcttgtgatatggggctgtggtgtctgtgtgatggggagcatcagagaaggtgtttggggcagcatggagggaagggtgcatatcctgtaagaatcaggggacagggtttcataacctatcatgtgcccagaaagtcaggaatggctgcagttctattaccaagccctgacaagcagccattttggttattagcagtgacttttaaaagtttctcctttgcaactttactatttcactttcaacctgctcagtatgttgaaaatgaagtttatggactatctttatataaaagtcgcaacttgtaatgcctccattattatatgcaggctttctctttgccccttccttggcttctagtgccgtgttggggttgatgggccagcctgcgtcctgtgagtgttttctgaatacttattattgtgttcaattttttgattgatgggagaggggcagagggactaaaatggggattgggctgtgtatattcctaaagttttcttgtggttttcacatgttccagataatcttagtgtttggtaagtacaggacatttaagcaacaaacacaactacagacattagaagtcatctgcttcagcaagactttaagcacttcctatattccatgttttacacttgagggtacagttaagaaaagttaacttactgagaagtttctttgatcctgaaactatattcacctgatacaggaaaccagtcttcttcaaaggtgatgagaatgccttgacaagatgatagggaccagcactgtacatttgttcccaagggaatactgcaacatgcaggcacagcccttggtcacctaatacatgtatttgtgaaattccatgggttcccttaagttgggagctaaaagggttagctttgggttagctgtggttttcactagtttctgcttgacaggatcagaagactgccgagacagatactgctatgctgaatttttcatgttcatctcagggactcactgcatactattttttaactacatgtgctattcagagttaggagatcttggatgggactccaaaataaatgatttaagaaattccataccttacattaggaccagagcttgtagtaaaggatgttgtgatatggttttgacccagaaggatgcttttgggtatcatcctcaagaatgtctgcaaaaggttttcagtgaagacaacaaagaatacctgtgctttcactgggaggaggaatgagcctgatggtagtagtgccttttgcttgtggtacatgtagccaaaagagctctgtgatgccaacaaacattgagaaaggtaatctttggtcactgccagctggattggccagtgcaccttgtattcagtactctatattgaagtatctgtcctttgactgtatgcggtgcttattgtacttagtttttagggccctgaaagctttctttgcacttactggttcaaatcccaacatcaactacatgttaaaagcagtcaggaaaagaatgatttggcttattttaagctttaagcataacatactgacagagcttatgaatatatatacaataaaatttatataataatataaatatataactagcttacacatcttaaaatttagatccagcacacaaaataacattttaaagctaaatactttggattttatgcatgagggaactacaaactgcacactttccacaagggagggaataaatacttttttctgtgtccttggagtgtgggtgggattcgtggatacatttctctggttcactatttcaatgatatgaaggagcctcatgttgcagcacagaagatttttcatcgttggaagttaaggttagttcaccttcattgattcctccctacactggactaaagcatttaatctagaaacacttaggtctctatatagcttgtcataatctctatgcatagaaaggggctttctagaacctgtcagcatattgtgaaatatctcctatatcaactgataataagaaatcagaattgcttaattgtggcattaataaagtatcacctagattgaactaagcaggaaaattttagatgagagtttaccatcacaagcaataaacacacaacagtccctgaatcctaaaaaggtggagttcttgatggtattagtgcgtatcttcaaattatttgctctctggaaagatgctgataaaattttgtccactaccatagtatccctgctggatgggaaccatatctttacaatagactctccacccattggcaaggtgatagctgtaaggacagtcaccttgcaagtgggcatgaagctgttaatttttttttttttttttgtcaactgaggtttttctgctatggttctgaaccatttacctgatagactgggttatatattcccagttaaccactactgggttaagtgacctaatgatattagtagccacttaattattttcaagcattctgcctaggacatcgtttcataaaattaaggtttaacagactgaatcccaacattagtagtataactaaattctctcaggagctttttatgaatgccttagtagtactttggcttcttgaagaggagctaatgccataaccctttttaaatcatccatctgcagctgggcatggtggctcacacctgtaatcccaacactttgggatgctgaggtcggcggatcacagggtcagcagttcaagaccagcctggccagcatagtgaaaccctgtcttcactaaatacaaaaaaaaaattacccgggtgcggtggcgagtgcctgtactcccagttacttgggaggctgaggcaggagaatcacttgaacccgggaggcagaggttgcagtgagccgagatcatgccactgcactccagcctgggcgacacagcgagactctgtcttaaaaaataataaattgtccatctgctcctgttatacatgttgatatatgctgctttgcagttgcattgtcaacatccattcccagattattgctgtcctgaagtaggataaacattttaagtagtgctactctatcttctagcttcactggttactttttaaattttatgtggagacaaggttttcttgctatgttgcccggggtggtctcaaactcctgtgcgcaagctatcttaccacctgggctcctcaagtgctaagactacattacaggggtcagccacggcacctgccctggtttttcaaattggatttaacatccaattagcagctaaactcagcaaatgggatattttgatctgtgtataattgaaattccaattttggcttctctggacaaaatgggaaacaatggaaatctttcatatgtatttgcatggccttgtcttttggaaataacaggtacagtgctgtcttctaatgttgagacagtaaaattttagtaagatttttcagctgaggaaaatacaggatcttaaggacttcttggagatagtattcatgctttctcatatacacagtgataggtgaattgtgtttagggttttgttttgggttggttttggtgcaatgtctaattacatttgccaactcatgttacctagtagggatatttccattctgtgccaattgatatttggtacagtgaatgtactcaataaaattaaaggtttggtacttgtttttgagatggtgaacaactaacgtgcaaatctgtagtccctaatgtagccttttgctatctgacatctgtttgacatatgctttgtcaaattgattcaactcaaacttgaatacttatgttttgccaaatttgtgtgatcacattgtgttactaatgtgtaacatcagcctgtaacttcagccacctactttttatttgtggatgctgcttagaaacttgcaaataacactatgaatatgtggagttccttgactgtccactctgttgtccctttagagagtacattacatgcacatttcttgtgtattttctagttcaattagaattcctccgttctttccagccaattataaaggttttaaaggaactattcaatgcaatgtatttccataagtttagtacctatgtactttttcttgggagtggggagttggcgaggggagtcatgaatttttggcaatgttaagtagtatcttattgcccatatttttcgcatgtctaaatgccaaattttgtgatgtattttgcacaaataactcattactctgaatcttaagtagtgctttatttgccctcacaatgttgccctttataaattgataaatttatgaaaaaagaaaattcctcttaatataacacttcagcaacattggaaatcaattattcaataataaagacatttgatgaagcaaccaacatttttgctttaagtgtagaggtatatatgctttgatcctttagcctgaatgtttcataaccaaatttgatttcttaaccattgtcatttgcaagtaattttagaactccctcccctgtaatggtagcatgtatttatctagcacatttgtaatcttaaaatttttaatttggtgcttcttcagggacttggtaatgaatcaactggaagttttgtactaaatttgtctacacagcagcgctctttagctggtggcatagagtccaaagttaagaatctgtatctgctcctaattaatagaaatatcattcttgtcctacagacaaaaatagtttttataaggacttttgacaaagtatatacagtataggtgaatttagtcaaaaatatttgccagattctcttggttctcatatggccatttgttcaatcccagtagctccaggataatagtgttcagttttcataggttgtaatatattgggcctttccagatttgttgtggaattctggacagttgatgtctaatcacaagttctgtggtacataatttgtaccatgcagtgttgcattttgctgatatagatggttggaggttcatgtgagtttaggaaatcagttccattagcactacagtttaatggctcagtgctatttgcccagaaatatattgaaattggtagagaccttcaaagttttaaaatgtaattttttattgtacactggtactgtaattctttggttccctgttgtctcattacagttatgcccttttaaagtcctctaaaattaagggccctgtagaagtgatggtcaactctattttccatatgaattattagatttggtgctgtcttgtgaagtaacttgatacgatagatgtgtagtatgaattttgtccacatggttgtgcccttggcagaactgcacgtacctgaaatggttccctaatttttttctagtattactatccaacacttcctctcataatcactagtgtattgtataattgttaagtgtcctttattcatatatttaaattaaaagagtactctggtaggattttgagggccaatagtgtatttccactgtttgaggtattaggagggctatttactgatacctgtagtgccttcccattctgtttatcatgcacctctaaattttgtgacttcctgttgcactaagcaatgataatggaaattcactagtaattgattatttatagtttgtgatagtggcattggtaatattgcccttcagagattattactccagtagctatctagtttgctgttctattagtaaaccaacattaatgtagctttcttgagggcattgtgatttttagctattgtggtaggttctgatatgtagttttgcttgtatgatttccttgtttatagctcagtttttgttacatggtatgtgaagtagtaggcttgacattagctgtatacaacacataaactagatttttcatccttgaaccttgaaactccaaggagctgtccagatttgcgtactctattggaataaaaagactagaaagaagcattgttatggaaaccttgcagtactcagttcacccaaaagaccttttagaaatgttagttcaccattcccatcagaaatttgattataggaagatcataacaatataatctgatctccttactatagaggcaaaaaatatattcagttaaaagctgtttacatataatgtcattttatttccacacgaaggtgacatcttaaaatcggtcagtgtaattatattaaagtggctaatttcctgtacagtaatttcctccaccacttatctatgggcgataggttctaattctcctggtggatcccttagactggatagtaccgaaccctatatgtttttatctacacatacatacttgtggcaaagtttgaggtgtgacagcaaaactagcacgaatttctttttcctgcacaatttctcaaactcctgagttcaaatggtcctcccaccttggcctcccaaagtgcacttagaaaatttgttactgcaacctcagtatacaatttttttttccttattctgttgaaaatgttcgcctttttactaaaggaagcattttgtggcttctctttggcacgtctgtattgatggcatcacagctcttatattggggtcattgttaagcactgtgttactgcagcagtcaatctgaactgagaagggtgctaagtgactaatggatggtagcatataatgtggggtatacactggaaaaaggggtgattctttttgctggacagtttgagatttcattacattactctcaacggcagacaatttggaatttatgaattgtttattcttggaattttccatataatgtttttgaaccacgtttgaccccaggtaatagaaactttgtaaaggaaaaccatagataaggggagaatactgtaacgttaggcttctttccccccatttctgttttattttgtttcccttattgtcagaaagtatgttcagtatggcctccttgtgtacacaaagtaatttttggtggaaaagaaagtactaccattagtccacagcatgtccttctgaaattatgttggatgcttgttatcatggatttggttctcatagggatattaatacagtaccctagtcagtgtgttagtgagccaaaaatatgtttgaaaatgttcatggatgtttgcgtcttttttttttttttttttggcttgttacaagttctggtttataggttttgacatcctttgcattgttggaagtgtgcccagtgttgctacctaatttgtggaaattctgtagtaccaccttagtccacagtgcgtccttctgaatagttgcatagcttgcataactaatttggtgtgaaattctagagtgaaaactaatatggtaacctaatcactgtgctatgttgaggatttccaagggtgcatgatgtattttacgcatttttctaattacaattcctggcttatagactgcataggtatttaatattgtctagtaaagtgtgttgatgtacaatttcttgtttaattcagtactattattagctacatggttctgctttatcgttgccattaaactaaatatatactgattattttcatcaggcaccagcgttaatgtgtttctcctaagtgagttgacctcatgggaattcatcacatctgtggactatattttagtgttaaaggcttaatgtactactgtttcaaaacttacaagtattggtatttcacatgcttttaaaagtactgttgtactttttttttttttttaagacaaggtctctctgtcacccagactggaacatggtggagcaatcatagctgatggcagctttgaactcctgggctcaagccatcctcccgcctcagcctcctgagtagctgggactacaggtgtgcactaccagcccaactattttattttatcttattattttatctgagacagcatctcggtatgtgacccagggtggtatcaaagtcatgggctcaagtggtcctcccaccttggcctcccaaagtgctggaattaccacacctggcctacatgttgtagttttgttgcagtaagttcagttgacttttgttaaatgtaccccagtaagcacatgccctgtggtaagtcctgttgtgtaataaaaaacatggtatgtatcaatgtgcttttcctatagttgtcctctgtcttcccaggttttttttttttttttaaacagtcatctagggtccataaatatgatgcagtaatgagtgatggtttagttttgctggtgttctctagcagcccctattatatacttcacagtattttcattctcatctcacttctggtttcaaaaataattttttttcatggcaaaatttgtttaggtagtgtgctttagtgttgtcacctggtggttcagcacgttatagtgctttacacgtgtaacttcattgtttacctttaattcaacgttgctatttagaaagggtgcattccaatagtattaaccacttaacccattgccactccaattggctgtctggaattttttctgttggtaaaatgttagttattaagagttgctaaccataggttgaatggttcctgaggtactttaacttgccatattatgaaagcacagcccatgatttgtcatactgcaaagattgacttaactactttaacaagaaacgtattccagaattttatcgtggtgtgcagtcattgcttctatcttgctgtcctttattaaatagtattaatttacaccatagtcaccaagaagactatattttggtaggctttggggtttatctgcctgcaagaaaatttattttccactgctttatactggtaattagatattattgtactttcaaatctttcactgaaaaatatctagttaggtcagcatgccctatgtattgtagatgcggttctgctatggtttttcaccaccggtggttgaatgtagggtggtacctttatctagttttgagtttctttagtgactcatttttgcagtcttacatctgctactcctctattagattattatttagcccaaaagtattatgggatcatttgacttcatggcgtcactggaaaacttaaatgttctgttggatgaaagtgtttcacttatagtactaatcgccatgtggtattcctttactttccctaacatttgcttgtttgtttttattgtgtatctacatgtattgagtagttaggtgcttgtacaaatcttctaccttcactcatggtcaatcaactgtaaaccttacctggggccaacttgccaaaggttttacagttaacaaatggtatttgaaatttgtagtaagagtaaatgctttggagtaggaatgcctatctcagcaatcctgctaagcactatactctggataaggtaattaccttcttttgtagaaaagaactcgtgatataattcatataatataaagttcaccattttaaagtttagtgacttttagtatattcatagagttgtgcgaccattgccactattatagtttacaacactttcatcaccacctcattagcacttattccctatttcccttttgccaaccctgacaactactaatttagctttttgtccctatggatttgtctattctgggcagtcatataaatcatgcaatttcttacccttgttactggcttcttttaactaccatgtttttttgagattcatctagattatggtatatattactgttctttattgatgaataatatttcactgtatggatatatttcattttgtttatccatcatttgacggatgtttgcatttacagatgttgtcttttgtcagtaatggtgctaaaaacattcatgtacaacattttatgtgggcatgttttcatttttcttgagtatacattaaggagtataattgctttgtcatggcatgtctaggtttaatgttgtgggtaattaacaaattttaataaggtgcctgcaccattttacattttcatctgcaatatgaggaattacatttattcatattctcacttgttattttctgccttttaaaattatggccacctagtggatatgaaatatcttattgtgctgttgacttgtatttctgcattgagcaacttttcatgtgcttagtggtaatttgtgtatctttggagaaatgtctgttctaatcctttgctcattagaattgggttatatgtggttttgttgttatcagagttctttatataatctggataacagactcttattggatacatgatttacaattattttcttccattctttgtattgcctttccacctttttgatgacattgtttatagcacagaagtttttaatattgatgaaatctaatttatctatttttttttgttagttgtgattttagtgtcataacaaagaaaccattacctgacctaagttgtagctcttacatttaggtgtgtgattcatttggaatttacttttgtatatagtttaaggaagaagtccaacttagtccctttgcatatggatatccagttttctcagcaccatttgttgaaaagactacttcatcattgaattgtcttggtacccttgttgaacatcagttgattctaaatataagagtttattttggactctcaattttattttatttatctctatatctatccttatgcctgtactacacagtattgattattgtagctttggagtaaatttcaaaatctggaagtatgagttctccagctttgttctttgctttggccttgattattctgaaggctttgaatttccatatgaattttaggatcagcttgtaaatttctagaaaatgccagaattttgctaaggaaagcatttaatctgtagatcaatttgtggagtattgccatgttagaaatattaatattcccaatccattaacaatagatacctttctattcattttatttttcataatattgaaaatggaattattttcctaactttaattttggattgttcattgctagtgtattaaaatacaattagttttctgttgatcttgtatcctccaatgtttctgaacttattggaaaagcttttctaatagtttcactattagcatttttttgtggattcctctgggtttttatgtttatgtcacctataaatatagatagttgtactctctttccaattgcattgattttttttatttctttttcttgcctaatcaccatggcgaaaaccggcacagaagtagcaagagcagtcatccttgacttgtttctgactaggggtaatacaattagattttgactattaaatgatgttagctgtatggttttttttttctttttcttgcctaggttcacagagctagctatacagtatttgtagataccctttgtcaaatgtagatagatccctttgttcctagtttgttgaggattttaaaattataaatgaattttgtcaaatggcttttttatgtctgttgacacaatcatgaggttttatctttgttctataaataccatgcatatgtaaatatcatgtattgaattaattggggaagtgtttcctcctgtaatattttttgaaaagttatgtaaataactgatgtttattatttaaacgtttgcagaatcatcagtgaagtcatctgttcatgaatgtttctttatgggaattttgtagattaaccattcaatctgtttttttttttttgagacggagtttcactcttgttacccaagctggagtgcaatggcgcgatctcggctcactgcaacctccgcttcccgggtccaagctattctcctgcttctgcctcccgagtagctgggattacaggcatgcgccatcactcccggctaattttgtattttttagcagagacaggggtttccccatgttggtcaggctggtctcgacctcctgacctcaggtaatctgcccgcctcagcctcccaaagtgctgggattacaggctcgaggcaccgtgctcggccttcaattctgtttttgtaagtattcaggttttttttcttgtgtcagatttggttgtttgtgtcttcctaaaaacaaacattttgtataaggtatctaattggcatactgcttttgatggtattcctttctaattcttttattttcctataacattggtgataatgtcttttttattctgattttatatgtgttttctctgtttttcatctttggtctagctacagatttgttcatttttaaaattatttcgagaaccacatttgctttccttaattttctgtttctctgttttttaaatttatttttactctattttttaaattattttctttgtcctaatcaatttttttttttttttttttgagaccaagtctcacgctgtcacccaggctggagtgcagtggcgtgatcttggctcactgcgaccgctgcctcctgggttcaagcaattctcctgcctcagcctactgagtagctgggactacaggcacatgctgccatgcctgactaatgttttgtattttagtagagacggggtttcgctgtgttgcccaggctggtcttgaactcctgagctcagtcagttcacctgcctcagcttcccaaagtgctaggattacaggtgtcagccactgtgcctggcccctaatcaattttagtttgatcttttcctaatatctcaaattggaaagttagcttatttatttgagatcttcatttctaatgtagatggtcacagttttacttttccctataagcactgtttttgctgcattccataaattttatgttttgttacattttcactcatctcaaagtattttctaatcatttttgggatttcatttttaatccattggttgtttaggagtttgttgtttaatttacacatatttgtttgtttattttgagacagagtaccactctgttgcccaggctggagtgcagtggtacaatcatggctcattgcagccttgacctcctgggctcaagtgatcctcctgcctcagcctcctgagtagctgggactacaggcatgtgccaccacacttagaattttttttttttttttttttttggttgagatggggtctcgccatgtttcccacactgatcttgaactcctgggctccaggaattctcctactttggcctcccaaagtgttgggaatattggcatgaaccacagcacctgacttgcatatttgtgaattccccaaattgctttttttaaattgatttctaatttcatttcattgttatggggaacatactttgtatggtttcaatgttttaaaattaattgagacttgttttatgacttagcatatggtctgtgttgaagaaggctccatgtacacttgagaataatatgtatactgtggttgttgggtggattttctatgtatgtttaggtgatatggttttatagtgttgtttaagtcttctattttcttctttttctgcccagttttatttttgaaagcatactgaggtctccaactcagtgccttagcctcctgagcagttgggactacaggcatacgccactacacccagcaatttttttgtatttttctgtagagacagaatttcaccatgttgcctaagctggtctcaaattcctggactcaagtgatctcgattcccggcctctgcctcccaaggtgctgggattgcaggcatgagctactatgcctggcaaattttatttttccttttattttgtcacataattaaagctactccagaattcccttgatttctgcttgcctggtatatcttttttccattttttaactgtcagccttttttgtgcctgttaatctaaagtatgtgtttcgtagataatatgtagctggatcatattttaaaaatatttattctgccaagctctgtcttttgattggagtattctttcatttatgtttgtaattactgatgaggggggcactaatgtctgctgttttgctatttgtttccccatgtcttatgtcttcattactgacttttttattaaacaactattttcttgggtaccattttaagtccctctcccactcattttttaatgtttttttgtgtttacttttgtttttattgtttgccctgatattaaaattaacattttaccttgaaatagttggcttcagattaatatcaacttagtttcaatagcataggaaatttgcttcactatatttccattttctccccgtcctttgtgctattattactataccaattagatctctacacaatataggcatatcaacacattttgtaattatttccttatccagttgtcttttaatatagatctgtgaagaaaagtattacacaaatagatctattctgttttttataattatttaattacctttggtggtgctgtttatttttcatgcatttgagttactgtctagtattcattcatttctctctgaatcactccctttagtattgcttgtagggcaggtctgctagcattgaattcttttaatttttgtgactcttcaaatgccataatttctcttttgtttgtgaaggatagttttgctagatacagaatttgcagttggcattctttttactttagcagtttgaaaatatttcccattgttggccgggcacagtggctcacacctgtaatcctagcactttgggaggccgaggcaggcggatcatctgaggtcaggagttcaagaccagcctggccaatatggtgaaaccctgtttctactaaaatataaaaattagctgggcatgatggcaggtgcctctaatcccagctactcaggaggctgagatgggagaatcgcttgaacccgggagatgatggctgtggtgagccgagatagcgccgctgcactccagcctgggcggctgagtgagactccatccccgaaaaaaaaaaaagaaaagaaaagaaaaagaaaaaagaaaaaaaattatttcccattgttttctggtctctgatttatgataagaagtcagctgattatcttattgaagatcagttaaatgtgatgttttttattttgttttttctcttgctgatttcaaaatttctttctgacatctggctttgatgatgttactactatgtgtaaatttgaatgtctttgagtttatttttaagacagggtttggctctgttgcccaggctggagtgcagtggcacaatcgcagctcactgcgtcctccacctcccaggctcaagcaatcctcccacatcagccttccgagtagctgggactataggtgtatgccaccacgcccagctaatttttgttctttttttttttggtatagacagggttttgccatgttgcccaggctggtcttgaactcttgggctcaagtaatctgctcacctcagcctgccagtttatcctttctggcatttgttggtcttgcacatattgattaatatttttgatcagatttgggatttgggagccattattcattcacatattttttctgccccttttctctcctctcattatgtttgttatatttactaagagtaattctttttcattattttataataagagaacttatgatagcattggctgaatttcctaagtaatgttcttgttttgttgtttgctaaatatgcttgattataacttatatttattcttttactcaatagttatttagtgtgatgcttcatgttgaggatttctggctttctttttcctcaaaaaaatcatgtttttatttcattgtaatgagacaatgtgggtgctgtcatttcctacatgcttagtttttaataacaaccttatgttgcaggacacatccctcattcttcttttttccaaaattttatctcattatcatgtagttattttatgtgaactatagaaacagcttgtcgagtgttcacaaatatcactggaatttaaattggaatggccctgaatttgtagattaattttgggagagctgtcatttttacaatcttcccatacattaatgtaatatttttctccttttattcgggtcttcggtatctgcgtatgtatattctacttattacttttaatctcccccattttctggaaaaaaaagatgtctttggaagtgcaattctggtgggaaaagtgtagatgtcatctgcatagactagagccaatcagtagggaatgtcattcaaaatgtgttttgtgtttgatcttaccatttctttcaaatgttcctagcagcctgcattatttataatgttctgtattcctggtttaggtaagtccagaggtgagagctggtattaggaaaatgacatagtaaggcatttgttttcagtaatggcagcatccgtttgacctcctttcccatttggaagggctttctccatcctgaaagctcctgtagacttggtgctctttttttttttaggattcataccagttgaagactttcaaagccttcagtgtaactggttatgttcttactagaaaagtatttagggccaggcgcagtggctcatgcctgcaatcccagcaccttgggaggccgaggcaagtggatcacttgaggtcaggagttcgagatcagcctggctaacatggtgaaacactgtctctacgaaaagtacaaaaattagccagtcggggtggtgcgggcctgtagtcccagctactcaggaggctgaggcaggagaatcgcttgaacctgggaggtggaggttgcagtgagccgagattacaccactgcactccagcctgggagacagagagagactctgtcaaaaaaaaaaaaaaagaaaggaaggaaggtaggtaggtaggtgggtatttggggccagctggcctgtaatcccagcacttggaggctgaggtgggtgaatcacttgaggtcaggagtttgagaccagcctggccaacatggtgaaaccctgtcactactaaaaatacaaaaattagctgggcgtggtagtgccacttgtaatcccaactactggggaggctggaacctcggaggcggagattgcagtgggctaagatcgtgccactccagcctgagtgagactccatttcacaaaaaaaaaaaaaaaaaaagaaagggaaaaaaagaaaagaaaagaaaaaagtatttggaaccaaagaagataagaattctgttccatttggtagtttattttaattctaagagcaactctttgagaggaagctggaggagaacatccatgatacggagagggatctgaatgtagatgttatgagaagcatcataggaagtagagctgtttatattgtaggagaactccaaaaagaagaatttgtctttgctttgttgtcttctgtctgttttcagatctcttattgggtcagggacagttgtcttttgctgcttttgaaggcagttctaattaatagagaagcagttttaaggactctccaaagatgattcttggaagtgacacctagaggcttgtatgaacactgggaattgaacttcagaatctccttgggtggaatgagttggattacatgcactcgaaggtcacttttattcctgagattctgtgaaggtctcgattggcaaatgagtgtgctactttacatgttcccatttaatcatcacaccaaccctctgaggcatgttagagaggtagagtaggttttctaaggtaatgtctaattaatggcagagcacactcccccacacatatagcttaattctcctacatttgtatagcccttccttctttccttcgttccttcgttccttccttccttccttccttccttccttccttccttccttccttccttccttccttccttccttccttccttcctttctgcatctggctgtgttggccaggttggtcttgaactcctgggctcaagcagtcattccacctaagcctcctaaagtcctgggattgtaggggtgagccaccgagcccaacctttttatttttatttttagttaattgatttagttttgtactttattgtttctagaagctttttacaaacatggttttatttgacccttataacagtttggttaggaataagaacagattcaccaatgtgtctaatttataggtggaaaacaggctcagaagctctttagaatatcatgagaagaagggatgtggggaattattcaatacaacttctgtattttgcacttcaagaaactgagtaccagagttaaaaatctggacatttggtggatgttcttagatttgtgttaatgcaagagggttggattagatgatctcacagggtatgggaatggatggtgtgttccctgtatctactgtgtagtgtaaagttaattgatactagctcaacatattagattaagtggcattttagcaaacatgaatgaaaggcaccaaaggtttaagggggaatttaaaacattaggtagcagcttgtagaggatatatttagggtcatgatgtccttcttgttggccttaaaaacacttcctgcgccaggttcaagggtcaattgggaacaggatcaacagaggatgagggtttttttttgtttgtttttgtatcattttaagacaaggtctcactctgttgctcaggctggagtgcggtggtacaatcccagctcactgcagcctccgcctccctgagctcagatgatccttccacctctgcctcctgggtagctgggactgcaggcacatgtcaccatgcctggctaatttttgtatttttcgtagagatggggttttgccatgttgtccaggctggtcttaaactcctgggctcaagtgatctgcccacctcagccaccgaaagtgctgggattataggtgtcaaccgccacacccaaccaaatgagttataagtttgtgatctgtttttagcctttgtccacaactgtgggagtcaccattcactctgtgacataggctctcagaatgatggctctcttgactgtggcactgatcatagatttagaagctccagtatgggaggaccttaaaagtctcctatcccaaatagattattttaaactaaccccagttcaagtccctggataacatacccaacaaatggtcttttaacttctgagtaagtttacttggtaactggggactcctccttgagttagcttgtcccttcttttgagacctctttacaacattgagccccaaaatgtttttctatagcttcaattcattcagcatatttgtattgtaccactactcaagaacattgctttattctcactcctgcatattcagcatctctcctctctgctgtcatttgagctgccaggcactgtgctgggtagtggggatatggagatgaattagacaccatccccgtcctcaaggagttctcagtctagtgagagagatcaacatctatgtacacatataattacaacaatatggtatgctctacaatggaggtatgtataagatactctggagttcaaagagaaatcattttacagagtctggagatgacagagctcagagtacctggtatatgagttgagtctttaaagaagtaaagtcaccttttgactaggtgaaaaacagggaaaggctttccaagcaaaagcatggacattggaagtagtatgatgagtttggggaactacaaatagttctctaaattaggttggaaatgtaggccaggaatagaactttatatggtatgccatgggatttggatttcattataagtgttttcagaaagggatgcttttagatgatcactggcagtagtgtggggtgtgttcaggaatgttttcaaatctggacagggagatgagttagaaggatactgtggtggctaagatgagaaatgatgtagggctgaaaggagtgggagtggcgaagaggggataacctcttaggaagttataaaaatttagtcatgcattgcttagcaatggggatatgttctgagaagtgtattgttaggcgattttgtcatgtgaacttcatagagtatattaacacaaacctctctaaatggtatagcctattacacacctaggctacaaacctgtacagcatatgactgtactgaatactgtaggcaattataacagaatggtaagtatttgtgtacctaaacatatataaacatagaaaagctacagtaaaaatatgatatgattttgtggtgggacaactgtgggacaactgtcatatatgaggttcatcattgtcctaaacattgttaggcagcacatgactgtatagacataatagaacttataggaaaagttatagaaaaacttatagaaaaagaccttgatgaaaaatactgtcatattctttggatgaatgttgcaattaactccttttagatcataacttgactgtacagattgtgcaagattgttttctgggaacagctgtatatgaaatgttgattctcagggagacacctagacacctgaattgcagcagacattttatggtgttgctaagttgctggtccttctcatcagtagcaggcctactctcactgtcacatatctcccacggtttttttttttttttttttttttttttttgtaattaaccaaaagtgaaggcttttatatcaaagactcaattgaggaagcagtggccttagtcattattggcataattgctttagtttgcttatggatcttaaaacgtttatgactatatctgcaagtaaaaaaaaaattcaataattaaaaacctaaacatatcgagtgtttattttctctttttgcaaaggtatattctaaactcaatgttcttcgggaaattttccaattaaggctctgagtattgatatttgggatttagagaatggctttctatgaccagaatggttagtgatgagattttatgtaagtaggactgggtttttcagggggccttgtgtaacttgccatcaagagttgggaaaggaggccctgagcagtgcagcagagctatgtaaagtgagagtttgggtcttgggaccaggtagcctgggctcaaatctgctctcacacttagcaatgtggtcttgagcatgattcttcacttccccaggactctgttttctcttatgtaaaataggaataatatttattttcaatgatgggggtaaaaagtacttaaagggactaattatgtaaattgcttagaacaggcctggaatatacagctaaatgctgtgtcaactgttgttgctgataatggtgttgactatgacaagtattaaaagaagagatttgactagaggtacttatattttgaatgatcagtgacgatgttagggttgagaaagaaaaacagtaactgacttgaaggttttcaatggtatgtaagtgtgaggtcatttcaccttttatttctctgccaggtagagtgggaaaccaaattaatcactccatgatctagtgactaatctattgcctttgcttttagttccaaatagaaagctgttgaaaagttgttgtattacacctgcataaaggttatcctgaaaacagaaaaatgcattagactttgtcaaaactggatttgaaacctaattcaactgcttgctggctgtgtgacttaaacttgttgaacttcagtttcttcctctaatataactattaattttcagagtttccatgaagatatttgtaaagtgtttgtcataggcactctatacattaattacagctattattgttagatcttgggacacccagcacgtgacaaaaacaacagcagaccctggtgcctgggaggacttcatggatccagcagcaacctggagtggtgctcctctgaagaaatcctactcggatggatataatacaacctgctaagtgtcctagcacttagcaggttgtattatcattgtccgtgtctatggctctcgtctaccagactttaaattccttaagggcaaggacagtgccttactcatctttgtattcacagtgcctaatccggtgcacattgtaggcctcattaaatgtttgttgaatgaaaaaatgaatcatcaacagacattaattgggcgcctgctctgtgatctccatgggctcagcttgtccccgccagttgccaacaacgtccaagctctcttcagaatgcttactcctgaagcttattcctgtcttctaattcttttgttgaggacttttctgtgtagtgcaatgatagcaaatacacttcatctcaagtaccatctccaattgattgataatgcctgccctgattatgttttataacaagattctgaaaccaggtcttatctcagtgtgaaagacatttataactatttagtgatgtctgctgagggtcggagaagggggagtagcagcacaagtgcctcatatgtcatatttgctactctgttttctatgaaatacttcatttctatgcctgcattttggtcttagctacttgctgatgttgcatggctgttgctgctactgtaattgctgctaattgctccctgggttggaccagagtgctcattgtctgaacagaaacctcatcctcacagtctgaggtttgctcctgtggctgatatttaaagttttcccctttcaactttactccagctatccccttacctgcactgacaggtaatcctccaccgtcctgttcacctctcaccaggttcatattttctttatcttatttattgtacttaatcattattttgtgagaagcttttctgattgtagatgtgacaaccagaatacaagttaaaaccacttatccagcgccttacagtgaatcatttaacatgagaaaaaaattgagtgtgtttgcagaccatggggcagaaggaattgagaagggagtcattgtagatgtgagaaagagagagatgataatagatggaagatgatcttgaaagatgatgcaggtgaagctggaagggtgaaatttatggctctagaacacatgcaggtggagggttagccttaggtaagtggaactacctctttgctggagcacagagatagggataggagtaaggaagaggacttggcaagggtggtgaagatttgtaattgtagaggtggatgatggggaggaagctgaccaggaacaggaatatgaagacaaaagctgctggaacagaaatactagagggctaaatatgaaccagagtccctaaggaatattcaggccaaaacgctggagtgagaccattaacaggagagcttatggtatatcaaagtaagaaatgagtttgaaactgggttagaagctcaggaaaatatgaagtggttttggggcattgtcactagcagtatttggttgccttgattgattgaggggtggacagctagcaagagacgagttacacagaaatggatttaagaatccaaactaaggccgggcgcggtggcccacacctgtaatcacagcactttggaaggccaaggtgggcaggtcacctgaggtcaggagttcgagaccagcctgaccaacatggtgaaaccctgtctctactaaaaatgcaaaaattagccaggtgtggtggcacatgcctgtaatcccagctactcaggaggctgaggcaggagaatcacttgaacccaggaggcggaggttgcagtgagccgagatcccacccactgtactccagcctgggtaacagagtgagacttcatttaaaaaaaaaaatccaacctggacatggaaggaagtaaggtcaggagtggcctcagtctgggccaaaaagaggctttaatgtgaacaaggtgagtgctgagtaattggaaaactggagtgataggacctgtaatcagagtagactttggagtgttagatttcaaaactggagtggttaagatacctgtgaagctaggatgtcagatgatcatttacatgactattatagtaacccaggattatagtagaagctaggcttagaatgaacactgggccaggtacaaaaggcttcagtgactgtgaggaatgacttggaggttggcacatgttaactgcaaatactagagaagaaaggctgtagtgggatagtagatgagccttagaagagtggggggatccaggtgattccttcttttattgagtatttgctctatgcctgacaccttgctatatgccatctgttccctcttttgggtctgtcacacttcaggagtgggagaatgcgcaagaattcctggtgagaacagctaggggagctgttggcctttagcactgctggaatcctgtggccgtctcctaactctttcaaagagctgcaggctggtcagcttgaagtggcataaaaagatttatttaggatctaaatttttccttgatcttgacctaagttagttacatgttacaagcatttgttggccatgttccataatgtactttggcttctgagcctctgagttgaagagtgagctagtgctgctcttaaaaaacaacaacaaaaacaaaaaaccagtcatagtacacacatgttgattaaccggagcaagacacaatcctattaattcagctttttaggataaagggtagacaaaagaaagctcacatcaataggtgagtaacaactactttgtaaaagccactctagggtcagaatacatccagtttagtggtccatattgtagaatttccctgtgctgttagggaagagggctggcaattgaggcacagagatggccttaaggacaaggaaggtaaagcttaggagaagagagtctataaaacctctgacatggcatgcagacatttttcttttgagtacattttactggggagaggatccatgtcttttatattctccaaatgactcaatattccaaaagaagtttaagaactactgtgttaaagtgatcaggccctcagacaacccatcccctcttgtag

SEQ ID NO: 4396 - DNA, 2919 bp, Homo sapiens
aggactttgaagacccaagcagccaaaaaatagctaattcctccttatttcagttggtatgaagagaaggttactaataatgctgctcttccagcacaagtcttctgggctgtcagtgagcttggtcagtgggaaccacaggaaattatgagttatgtttgttatatatgagaggaaaattgaggctaccagtcttgtcacagggtttatagataattgccttgtgtgccaccatgcctggataatttttgtatttttagtagacaggggatttcaccatgttggccaggctggtctcaagctcctgacctcaggtgatctgcctgccttggcctcccaaagtgctgggattacaggcgtgagccaccgcgcccagcaccccattaaatcttatcacaaagcctcttcaaacttggctccaatggagggaattgatacttcagcaatattctgtcttctactccatgagcataaactgatgctatcctgagcaaactagaatgattaccctatgaaggttcagtaactataataggggtatttttggcattagtttgagacctacagcctgtgccaaaagtgaacaggaagcatcacatttaaaagatgtataaaatatgtctatatctatccatttgatatggcttgactgtgtcaccacccaaatcttatttggaattcccacatgttgtaggagggaaccggtaggaggtaattgaatcatgggggcaagtctcccgtgctattttcatgatagtgaataagtctcacgatatctgatggttttaaaaaaaggagttcccctgcacaagctctctgtgtttgcctactgccatccatgtaagacgtgacttgctcctccttgccttctaatacatcatctatctggttatttcatacatattttctagcattttattattggtttcttcaaaactcttcagaaactaatatatgtatattttccaccatgatcaactgtgcatattaatatatattatttggtatatgaatgtggattcataattgagattatgttccaatgagtcatagtaaaagtacagaaaattaatatttctaatgccttatcaaccgatgattattataaaattagcctttatgtcaagttctcattgctcttgaatttcattccaaacagaattttggaattcatattatttggaatagtatagctgtcatacctaaattagtttaataacccacatctaatgcaaatttacattaagattttacataaataattatggtgtagagtatgacaatcctatttcaaaaccacagagcccttagaaaaacaaattcttgatttttcagatatctcaaatactgtaaaatacagtataactaagaataattagccatgaggtcaaacttcaatttcaaacattataaaagtaaaattaagagttaaaatctaaaaccacatgaaaatttattcttcattataatctcaaatttgaaaacgttatataagatttatgcattcattagaaagtgatttattgtaattttataagatttgccaatttttaaaggtgtatttttgatcaatgcaattaaatgttaaaattattatgctatacattattagttcatgacacattttcaaatatgaatgtgatgtagaaacaggtgattatcagaaaataaactctgtttttagtttaagactaaattaaagctaccaaaaagaaatttagtttcaagataggaaagtttatttgtaaggatgctgggatgtttgaacccaagatgagtgatgtttaaaaggttttgcaatggcattcaatgaataaaaaatgtttagagttcagtaacttcagttaccattttggacagataacaagagatccaatctgactagcagagaatagtgtaagacatttagaatagttagcagtttaaatcagagggtagacagattattttccaatgtagagtacatatttctccatttgcataatcctcaccagtgggtagaatttatgaagaatagaatttggttcatggaaagaaaagcaggcaggaactaaatcagatataactttcttcatatttaataactgaagtttactcctattttgagactcaattctgatagaagttggaaaattaatctgtcagtttaaccctatctctaaccccctgccatgtagagaattgaactagccttcgctctcataagtggaattttaaaaaataatgagttacatgagctgataagcacacatgcatagtcaatgttaaggcttagcatttataaaatttgggatgataatttatggcaaatgtttaacacatttaataagataaatagtttttaaggcattgaataggtaggagttcatatgagtttactctgggttgctattacttttacatagtcaaactttattttgtagtatttttcttcttgattctctagtcactatgataattattagtatggatggtgacttttatttccaagcacagcataatccacaataacataacatttaaaagcaaaggctctgtatcgattattaacatgaacaatttcctttgctaccatactccatccagataaagaactgaatgttcctctgaaccttccaattaatttcctccattgtgatgaatcctccatagatttattggcaaaacattatttctaagtgttctccaccctactataaattgtctcaaaatagtttgtgtctaccaacaaggtagtatagactataaacttaataaatagtaattattgataattatgagataccaggatgctaatgaaactttattgcttgtattgagaaatgagagtataaattgagtataaaatgaaaagacttgaatgcttagtaaagcatataatgtagctaaagttattaaacagatatatgtatatgccaa

SEQ ID NO: 4397 - DNA, 4735 bp, Homo sapiens
ggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatgacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctaacttcacagagaatgcagttgtcttgacttcagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtgaataaaaaaatcttgattgg

SEQ ID NO: 4398 - DNA, 2038 bp, Homo sapiens
aaataaggtttaattttctaccgccccccaaaaaaatatatatatgtatatatgttaaatgactggatataaggataaggaaaaaagaggagtcaaagacaattcccaagttctaatttgtaagtagtgtcaatcactcagatagaggggaatacaaaaacaggcacaagtttgagaaaagatgaggttctcactttacaacaagttgagtttaggacacctggagctgaggaaagaggtctggactagctggtagctcacccactaactgaacaatagacaacaacaattttaaaacacagcaaaaaacaaattagaatcttactgggactctttacttcatattatatttgaatttcatgagcacataatctatgtgctaaaaattcctagtggtaaaactattattctgagagaatggactaccacactgttctgattggaaaaaggacagatgtaggatgaggcgattgatgagtttgttgtcatttgaagagagtttaaaggttcctttcaaaagagtcaaagatattagaaagccattcctttaagtagcccttttatttacatctgtcagtgcagtaagagattaacctgtactggggaagaaatctgctagaacatagaatgagagcaagctgcttcataaattactgatgctaagctgtctgactcttaagatttacagtgttttagaaaattaaatttatatcaggtatgagctagtaagaaatttcttcgttaaacttggctttttatgattttgtctttttaaaagaagtattctctttaaaaattaatgtgtaatatcttcagatgttttgacaagaattctacttttattttaaaaataactgtgttgaaagttagcagtttttatctgggtcttggtttaaagtacttatatactgtcattcagattacagaccatataaccaaagtactgtctcgctaattgtaagttattctaactgaaaataaagtaccttccctccaaaacattcatttaatggctgaaattgtaaatcgtgatgtataaaagatattatgttatagattcctagagctaattcctagttttcagccccaaactcccatataattctttcaaaaaacacaaaacagaaattggtcttgttactctacaaaattaaactgaacatttactattaaaaacctagaggcaatattttaacatcatctcctgttttaaaaattcatttaaaatacaagctcaaaaaagtcaaaagtggttaggatctagattagataacattttgaaagaatgttaaagatgaagaaaatattaatgcacatatatacacacacatttatatgcatataatacatatacacacacgtatatatatgtatcttcattttaatcataaaataatccctaaaaagatgtgtacatgtatcaaatttaaataagttaaatgtactaatgatactcgtttttaaatataattccatgtcaatctgcttaatgaagtacagaaacatcagctaactctgtaaattaagataggcagctttaagatttgctttagagtgtggtatgcctatatatgcaaatctcctttcaggtcatttcaacaattttatcattaggagtacgggattcatattatttcaaatgtggtaagttgaacaaaatcaatactgaacaacatacctttcagataaattaaggctttggcgaagaggttctaatttttgacatgtctctaggctgtcaacagatgtcgaaggcaatgagtctgattgcaccttgttggcatcacataaattagcatcgtttctaggtagggtctttctgaattttcgtcctaaatccgtccataggacattcgtcaacataactttgagttgcctgttatacacataaataattagtatatatggtactacacattgtagaatacatgaattcatcacaaactaatatctccagaaactgtaaacttcagttcctcaagcaactatagtaaataccctaagaaaaaagaaaaaatgcctaactattatcaaagat

SEQ ID NO: 4399 - DNA, 4603 bp, Homo sapiens
tattttattctcagtactgaactatttccattgaacattcagactttttaacaaaaacaaatatcatcaagaaggcaatagctagaaaatgagaggtgcctttaaaaaaaaaaatgcagccttacagtgaggatgaagattgagtttggggagggggtgggagggggggcacagagagagagagagagttagtgtgtgtgtgtgtgtgtgtgtgtgtgtgtgtgttgtgtgtgtgtgtgtgtgtgtttaccaatctgtgaaggtcctgatttgtgaccatcaatgtctttttaatgtatctgctcaacttctaggacttcaggggacatttcatgcgctttgtgctcttctgagcaccatatatactttccaagaattttgaatgtgaattcctagaaatttcagtagagaaaacaatagctattctttaattatagtaaagttcaggtagaaggagaaattatttgttcaccaaaattatgggatctcattaatgttggctaagtaaatgtaattttttaaaggctcactttttaatacttcatatatttccctcttacaaaacagcatgtcatgaagttcttatgtggtaaagattcaactagtaaatatttttaggttaaatacctgaactagttaaaattccacctaagaatagtcttaaaatatttaaaaagcatctctcatatctacctctttgtcattgctgccattttaactgaagcaaatctttatgacatctgaaatgatggttggatgcaattaaaaaaaaatctatgttggtgcttttctcaggctttgtcatttaagttatattgtattaagatgtcacaaatcagactgaaaggcttagaattaattttgtttttctttgaaagaattgcttaaaattaaccatcaatgtttttagcgagtggagataatgaatctttggttggtgtctgtctgtgtgatgttttcaaccaatagccaaataattattgaacttacatgaaaaagagtgctaagtataattttatttagattactttattctttgaaagtgactacaaggctattaagtacataatcattcattttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttcagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattcagggtatggataagctaattaagatatccatctttggtggctctaagtgtattatttgtttttaaataaagtgtacaaatatagataacatgcagcacatggaaagcaacgttttacattaatcgtgagttgtagaaataaacagcttgtggtttgtatatgtgccgaaatgttaaagtatgctggcatccaactacttccctttggaaatgggaccaagacaataatttttcatgcataaacaaaattaacttagagcaaaagtaattttatcagaaacagtttattttgggggctggataacttgggtgagagtgtggggaaagaagtaccttaccaaaaaggagaagcaactgaccctgtggcctgagccacattgtcttccatttcaacttcaatgggctggcagtataccacttctgacctcaaagaatgaatggttccaattctggcttgtcattggtccttgttatctaaattaaatatttttaggaaatatatcaaaagtatcctagagccccatggcaaagtgtcagaggaaatagttttcattatattttaggaagctgtaaaaatataagcccaagtattttgtgtcatctgcatatgtcaggatgaagaccaggcatgtaagaaatatcctaaagtagccaagtgataatctcatgaaaaaatatgagaatcgtttttacagagtgagttctcttttgaatggttttgactatgcttttaaaaacatttttaaaatgtacttacatctttttcgatagcccacgtatttcagaatatcctcttgatagaataatatcactcagtgtgatttttagaaaaagaaaaactcggtggtctcatatcttttgacagttgtttgtgaataataccctccccaacaaccttcccagtactcaactgctatgtaagaatgctttcttatgtggtaaatgtctcagtattttgctgcctggtatttgttcagtttccttgtatatctcagggtcagaaggaatcaggctttctcccaactctgaaacattcagacttactttctttttggtcagccttttaacaagcaagacaataaactccttttgtcagaatcgatttgattaaaaaaaaaaaaaaagaatgtgctccttatttctcattgctgtagaatacgtaggaatacacatctactaatcacaattaaaaaataagagaatctttagaaacatcattgctttctggaggtagaaattttgaacttgaaggttgtagttccaggcaattttgtgcccttgaggtgtccaattgatagtatagcttgcctctgctaataaatacacaaaagttttctttcctgtgattttcagaaattatttttggaatacaaagattaataaggaatatgtgatgtttatctcctgcatttcaaaatcttctggattttttttgaggcatgaggagcaggtaatgagattttttttctgaatatcttgattctctcccttaacccagattttgcatattatgcattgctcatttgtcacctacaaaaataaaggttaatgattatttgtttgcttttgtctatataagctccctaaggcacagaccatgttcgtttttcttatgttcctcttagcactgtgcctggtgccttgccatataaaaggtaccctataaatatttgttggctgagtaatcagagagcccatttcaaaatctaaattatacaaatcatcaaagaccaaaaaaaaaaaaaaaaaatctcttgacagttgatgctcaaatgcatttggttctgtggagcttatcctgagattgaggtctgcaccttgactggagaggaatttggactttacctcacaggtagcaacaaaatgcctgagtagcaacgtctttatactgcacagttgattttagacaagtcaactcttctaaattggcttctcatctatgaaatggggataatagatctgcctaattaggttgatttgagataacggatgtaaaacacctaataaaataagcatccagcaaatgacttgttcactctctgaatacagacttctggtcatgtagttcggtcacactcctgatagcttctagaacatcagggttttaggagaaataggttaaaatgaacatcaagagtagcagaagactactttccttaatatttgagtgccagctatatgccacacagttctagttgctggcagtcagcagtaaacaaaaacttcacctgatgcagcacattccaggtgggggaacaagtgaaaatatagggaatattagtgataagtgcagagggaaaaaaaatagagcagggaagggggatgatttgatgtttttcaggttaagaaagtgacagaaatgaatttaaatgcaaaaaacaatgcataaagattcataatggcaaaacgaagcatgtcccatcataccccttcattcctacctccctgatatgtatctttctaattattcatacaaatgtgtatacccagttattacatatggggttttattctacatattatgctgcacttgctttttct

SEQ ID NO: 4400 - DNA, 1703 bp, Homo sapiens
cagcaagagcaatgagttcatttttgttttctttttttgattgaggtaaataaaaaagctttatccagcaacacggagataagagtctgtccaacccgacaagttccagaccccaccctgccctcacatcaggctcttccggtactgactgtgcggggtggtctgtctgaggtgggagtccggggtctgcaggtccatctgtctgtacaggtctctcagctccctgacctcctgcagcaccctctttgcctggctccaattcgatgatgcctctcccagcagccgttccgtctccagcagcagctgctctgactcagaatccggcggagaccgaggggggtccttggcctttcgcttcccatctcccagtccctgaacctctgccagaagctcctgagtctcctccagtttccttgctaccaggtcctggatccgggacagctgccccgggttggggagggcaggggttgggggttcctcagcccgcagctggagggtgcgggcagaggcagcatcccgctgagataggatctcctccagggaggcgcagcggcctttctctgtgggcgtcaacttcttgggtgcctggggggtgtaggtggcccctttgtctgttttttcccaaggtcgggagagactgcttgcccggtctgcggagggctggatgcggtctgagtccgctctccgccggctccctgccagctgggccacagacttgtccaggtcaacccgaaagctctcagcacaagaggttggttcctcaggggaagggtcttcctcttggatcaagtccaaggtcagcatcccatccgaggtagaggtggaagcctgtggaggaaggggggaatgagtggggaacctgtcatcaggagggattttcggaatgactgcctaaaagatgcaagctgtggtcattttcctctacaagccttccttgaatgagaagtacttttttttagagacagagtcttgctctgtcacccaggctggagtgcagtggcacgatttgagctcactgcaagctccgcctcccgggttcacgccattctcctgcctcagcctcccgagtagctgggattacatgcgtgcaccaccacgcctggcaaagccctctgctcttgactgaaccctcctactgaatgtgctgtttcttattcctttgatagtgacttgaatgtttcttcttctgtgatttagtttgttacttgtttcctgtattctccactctaccataagcttcctgaggggcgccctcttccttggtattgtggactctcagcaattaaactgcatctgatgcacacaggatgctccccatggcacgactgtcctcctccatctgcatcctctgagtcccacacttcagcccccttgccttataataaaatttgttctcttatttccagaatactaaaaatgatgagtattcaataccaaatatgttgttttagtcattcctcacagcagcccttcaaggcaggcatgattactgcctcattttacagttggagacatgcaacttcagggaaccacacaggtagctgattacagtgaggttccaactcaggttctaactccaaagcctgtgttctctgcattatacctgcctgcctctctctctgaagacttaagagctcagaggcatgaaagaaactagcacgttgtatgtttcaggagttcattgtgatcctttctcctccaaa

SEQ ID NO: 4401 - DNA, 1880 bp, Homo sapiens
gagatggagtcttgctctgtcaccaggctggagtgcagtggcgtgatctcagctcactgcaacctctgcctcctggggtcaagcgattctcctgcctcagccacccgagtagctgagattacaggcacgcaccaccatgcccagctaatttttgtatttttagtagagacagggtttcaccttgttggctaggatggtcttgatctcttgacctcatgattcgcctgcctcggcctcccaaagtgctgggattacaggcgtgagccaccgcgcccggcccaatgttatttaattcttacttttattgggccaagacacaaaagggacgctgagactctgaagagaaggaatccctgtgtgtgctgaaaaactattccctttgctaggctacaccaattttgacattttattgggctaaacaaaagacaagaaaaatgcacacaagaaaaatgctagtaaaaacttcttttactagcttgtatagttgcatctgctttcttttcttcttttttttttttgagacagagtttcacttttgttgcccaggctggagtataatggcacgatcttggctcaccgcaacctccgcctcccgggttcaagagattctcctgcctcagcctccccagaagctaggattacaggcatgcgccaccacgcccggctaattttgtatttttagtagagaacggggtttctccatgttggtcaggctggtctcggattcccaacctcagatgatcctcccgcctcggcctcccaaagtgctgggattataggcgtgaaccactgtgcccggccgcatctgctttctaatgtaagagactgatctaatagtctagaacctgacaactcttatggtatcatggattttgtttatatgctttatgaaggtcactgcactgtggcaacagtccaacactactgtaccagctccctctgacacgttcccctccaaactcacgcagtggccagctcactcagggcctcctgatagcgtaggtactcattctggccaaagaccttaggaaagagaaaggaagagtgaggatctctcagtctgagggatctctttagtgccccgaagaaaaaactggcttacccctgtcccatagcgggctgtttcatagccatccaaaagggtatcaatgagtgctttgcgtacacccttgaaaggcgtactagtgtttcgcagatccagcaggtaggagcggaaattcttgcccattaaggaacggggatgccggccttcagaatgaaatgggatctctgtggagaaaacagcacaatgatatctcttctcattctttagtctttttttttttagagggagattctgattgagaccaaaggtataaagctgtgcctgagtggtcatttggtggtaacaccacagttgtaagctacatctatgacacatgatagtgtcatcacacattttaccatcctgcttactcatccatcctaggtttaagatataaactgttttcatagagataaagcatatatgacaagtgttgacagaatggaaaaaattcaagaacaatctatcttgggcttagtgaaaaagcaggtgccacctgtcctttgtggaaaaacaagcaaattactatcatctacttcatgaaactaaaggtctcaagagaagaactttaaaaaacaaaacacccagactctttggagaataacctgcttatatcatttccttcagcaaaatctctaatctagtactttcaaaactctagaatttcctactagccagggatgtgcagaaaggacaaatcctaacatacaaagtgggttcattactctgttccctaggtgggctttcaggatcctagaatggaccctgtcaggtagcccttaccagaggtacgaat

SEQ ID NO: 4402 - DNA, 5141 bp, Homo sapiens
agaggccgtacgtgctctcggcgtgatcgaagggcacgaggcgctcgtcgcagaagcccagcgtccagcgcgctaagctagctggcccggcaggggcgacggcggcgggtagctcgcgggctagcatcgagacgaggctcccgcccgacaggccgagcgcgaaacgggcgcgggcccctgccaggcagcatgctgcgcgctgggccaccagctgcgctagcgccgcacccagctcctgggaactcgagaacaccgagatgaggcccggggccggcgcggccatggcgagggcggcggcggggaggaggaagcgctccctacggccgtcgctagtacgcctgcgcaagggccggccctgccgcttggtttcgagtactttgggtgattgtctttggcacatgcgcagtgaggcaagtgaagcaccgcgaaggtcgggcagtcggtccggccctacccattgaatctttgcctgctgtgcctgagtcgaagtgagttcgggaagccagtgcccgaatgctcaaccttgctgtatcagggagggccggagaggggagctcaagaagaggacgtcctatcgaggtggcagggattttctgaaggagggcgtattttggtgagttttaaaattcctgcaccgccgggcgcggtggctgacgcctgtaatcccaacactttgggaggccgaggcgggcggatcacgaggtcaggagatcgagaccatcctggctaacacggtgaaaccccgtctctactgaaaacacaaaaaattaaccgggcgtagtggcgggcgcctgtagtcccagctactcgggaggctgaggcaggagaatcgcttgaaccggggtggcggaggttgcagtgagccgagatcgtgccactgcaccccagcttgggcgacagagcgaggctccatctcaaaaaaaagtaggggatgaaaatatgcttgttgaattttttttttttttttttttacattttccggacggacgggctcttgctatatggtctaggctgatcttgaacccctgggctcaagcgatcttcctgcctcggcctcccaaagtggtagcattcaggcgaaagccactgcgcctggccatgcttgttgaattttttaagctaaccctcctagtgtggtggtgtgtccctctgagtgcccagaaaggcctccaatcgagttcttgcctggacagagggctggaaggggaagaaggcctggtgggcctggggaggctgggccacttctgagagtgggatatttcagtgatgtgtgtaagcgcagttcaactcacacaggtagtggattttaaaatcagtagcaaattaagaaaacaattccatttaccatagcatcataaagtataaagtaggcataaatttaataaaagaagtacaagactgtacttcttgagagctgtagctgggcttggtggctcacagctgtaatcccagcacgttgggaagccaaggctggacccggtggcagctgcctgtggtcccagctacttgggaggctgtggtgggaggatcacttgagcccaggagactaaggctgcagtgagctgtgttcctgccattccactccagcctgggcaatagagtgagaccctgtctcgaaacaagcaaaagaactaaaactttggtgaaaaaaaaaattaaagatgatctaaataaatggtaagacattccacgttcatggattggaaagtataatattgttaagatggcagtactccacaaattggtctacggatgcaatgtaatccctttcaaatttacaatgtttttgttgaaattgacaaattgatcctaaaattaataataaattgcaaatggccccaaaatagccaaaacaatattgaataaaatacgaggactcatactttctcatttcaaacaataaaaaggtacaataaccaaaactgtggtattggcataaggatagacatataaataaatgattggaactgatgcagaaataaacctatgcatatatggtcaactcatctttggcaacggtgccaggactattcaaaaagaaaggagggctgggcgtggtggctcacgcctgtaattccagcactttgagaggccaaggcaggtggatcacctgaggtcgggagtttaagatcagcctgaccaacatggagaaaccctgtctctactaaaaatacaaagccttagctgggcgtggtggcacatgcctgtaatctcagctactcgggagtcggaggcaggagaatggcttgaaccccggaggtggaggttgtggtgagctgagatcacgccattgcactccagcctgggcaacgagcaaaactctgtctcaaaaaaaaaaaaaaaaaaaaaggaataggccaggcgtggtgcttcacgcctgtaatcccaacactttggcaggccaaggtaggcagatcacctgaggtgaggagttcgagaccggcctctcaaatgaagtagaaaccccatctctactaaaaatacaaaaattagccaggcgtagtagctcatgcctgtaatcccagctattcgggagtctgaggcaggagaatggcttgaacccgggaggcagaggttgcagtgagccaagatcgcgccaccgcactccagcctgggcgacagagcaagactccctcttaaataaataaataggccgggcgcggtgcctcacgcctgtaatcccagcactttgagaggccgaggcgggtggatcacgaggtcaggagatcacgaccatcctggctaacacgatgaaaccctgtctctagtaaaaatacaaattagccaggtgtggttgcaggcgcctgtggtcccagctacttgggacgctgaggcaggagaatggtgtgaacctgggagaaggagcttgcagtgagccgtgatctcgccactgcactccagcctgggcaacagagctagactctgtctcaaaacaataaataaataaataaataaataaataaataaataaaacccaaaaagtctgttaattaataagaaaaactaacagagttcaagcctaagagtcattgggattattttctggccaacttggagggaacttcctagacactattgcagctagaggctttggaacaagaaagttcactgggccactgtctcacctggagcccctggcaatgagtccattccccttcttgtgcctcagtttctgcatctgtacaatggggaccatggtgacacttcctgaagtggttgcgaggttggagagagattagtcagaattcacttgcccagctgggtgccatggctcacgcctgtaattccagcactttgagaggccaaggtgggtggatcacctgaggtcgggagtttgagaccagcctggccaacatggtgaaaccctgtctctactaaaaatacaaaaatgagctgtgtgtggtggcacgtgcctgcaatcccagctactgaggaggctgaggcaggagaattgcttgaacccaggaggcggaggctgcagtgagtcagattgtgccactgcactccagcctgggcgacagagcaagactccgtctcaaaaaaaccaaaaagcaaaaaacaaaacaaaaaaattcacttgctcatctgcacacgagggtcaccccctcagtgtcctctcccagcaaatgctctgtcacctcctgtcccctgaggtagagacaacaaacaagatgccaacattatgacacgcgagggggacagcagaggtgagagtcagttgagagtacagtagtccctgcttattcaaagtttctctttctgaggtttccacagttcaaacatattaaatggagaattccagaaataagcaattcataagtttcaaattgcgtgctgttctgaggagcatgatgaaatctcggactgccttgctccatccctctctgtcccgcccagggtcatgaatcacccctttgtccagcagatccatgctggagacaccactccccccatgcccactcatttgtcacttagtagcctcctggttatgagattgaaaaaccagtataaactgggcacggtgactcacacctgtaatcccagcactttgggaggccaaggcaggaggatggcttcagcccaggagttcaagaccagcctgggcaatacagtgggacctcatctctgcaaacaaatcaaaaaattagctgggcgtgatggtgcatatctgtagtctcagccacgcaggaggctgatggaggattgcttgtgtgtgggaggtcaaggctgcagtgagctatgatcatgccactgtactctggcctgggcaacagaataagactttgtcttaaaaataaataaattaggccacgtgcggtggctcacgcctgtaatcccagcactttgggaggccgaggagggcggatcatgaggtcaggagattgagaccatcctggctaacacggtgaaaccccatctctactaaaaatacaaaaaaattagccgggcgtggtggcaggcacctgtagtcccagctactcgggaggctgaggcaggaaaatggcgtgaacctgggaggcagagcttgcagtgagccgagatcgtgccactgcactccagcctgggagacagcaggactccatctcaaaaataaataaataattaaattaaattaaaattagaaagggaggaaaggatgaaggaaaggaagggagggagggagggaggaagggaaagaaaaagaaggaaaggaaagaaaggaagaaagaaaagaaacaaaacatatttagggctcagtattatggtcagtttcaggcatccatttggggtcttggaacatatcccccagcgattgggaggaatactgtatagactcctgagcttggagtcctgggttcgaatcccagctcagacggccaccccagcaggcctagcgactttcacccagagctctcacaccagccggcctgtacatggaagaggacactgccagggcagccacaggtgccaggacataccgtgatctgagccatcctgcaacacctgcaggaacccacaggcaggctggccatccctcccctgcaaccacaaggtcaacgagggcctgtgaggcccagacactgcagggaggtgcctccccctcggcaggccagcgagagggccaacccgagtgcccctgccccaaggtccctttggtcttg

SEQ ID NO: 4403 - DNA, 773 bp, Homo sapiens
ggggcaaagccaggcataaagaaatggagacgtgggaaggggaccatgttgactgccaacttgcggaggtcagcattgagctggccagggaaacggaggcaggtggtgacaccactcatggtggctgagacaaggtggttcagatccccgtaggttggtgtggtcagcttcagagtgcggaagcagatatcatagagggcctcgttgtcaatgcaataggtctcatcagtattctctaccaactgatggacggagagggtggcattgtagggctcgaccacggtgtcagacactttgggtgaaggcaccacactgaaggtattcatgatgcgatcagggtattcttctcggatcttgctgataaggagagtgcccattccagagcctgtgcccccgcccagtgagtgggtcagctggaagccctgcaggcagtcacagctctctgcctccttccgtaccacatccaggacagaatcaaccagctcggcgccctctgtgtagtggcctttggcccagttgttacctgccccagactgacctggaatgcagtcaggagaaaagctcaattaacagggtatggaagatacatgatgtttccatctttcaacttttcaaataattccctcggatgtatcttctttctccttcactgtgatatattctccccctactgccccataatttaccagcaatagtaggcactacctctaccctccgttagatttcagaacacatttctgtattagcactccaatacaacaatcatctcctaa

SEQ ID NO: 4404 - DNA, 9216 bp, Homo sapiens
gatagcgtccaggagctagtgggtgacaacatggagccccgtggagccgcgcgggcgcttcaggggcaggcatcgtggttttgactcttcccaggggcctggcgaggggacgtgtttcctgagaatgcgcatccctgccggggtagaacattcaagaagtgtgttcaggatggattaagtgggaagaggccgttgcaaaataatgtaaaaccaagatattgtgcggaaagcagtatctgacatagccgagggacaggctgtcggctcattttacatttgggtgggggtggggagaaaggtgatttttatttatttatttattttttatttgctgcatttgcaagcaggcatccccagcctggctcttctggaagcaaacctggtgaactcctgagccctccagcaaggcgggcagggcccgaatgtctggagaggactttggaccgtgtagcgggcacctcccttgctagggggtgcagggtgatgaggaagctctggcccctgaggtagaggatgaaaaaggaccccggttcaagtaaccagaatggaaaatggcatctgacaggaactcctgccaggaacctctccctggttaacacccacaccccatacaaaacaaccccttgaaagcaggcccccttggcaaccgagaagaagctggtgaagacatttcgcctgcgtctgtgaggtggtatcagcaggcagggctgggcctgacatgcacccctccctgtgcttctcggaaaactggtgactgtgtgtcatctgaccttcagcacagaaggtggtgatgtggcaagcccaggcttgctccctggcgcctgcttagccctgtttctctgccaggggaagattccggcagtgcggcctcctccaggatctgccccatcagtctcttcctgactgtatctccaggggtgggttggggtggggtgatttggcctgaaagaaccgtgtggaaagagggaattgtctgtcaaaatgttctagaaagctgggcagcttatgaaaccaatggaggagtcttcactgctgcttcacagtactgggcagtggagtcagccagacctttctttatctcaccaggcatctgagaggtgggtcgtccccgctgtagtgctgtttctgggccccagttgatgtcttaacttgcttttctctatttcaggtctcgaaatctctctaattcacacacatcattcccaaatcccagaaacaaactatggtagattttatttttcaaaaaagagtgggatccattcgcttttgaaggccatggtgggaggattgcctagaggccaggagttcgagaccagcctgggaaacacagcaagaccctgtctctacaaaaaatgaaagaaaaaaaaaaaaaaaagccaggtgcacatgactgcctgtagtctcagctactggggagactgaggcagcaggatcccttgagcctaggattttgaggctgcagtgagctatgattgtgccactgcactccaggctggccaacaagagtgagaccctttctaatacatatatatatatagatttttttttaagtagggacaattactgacatacaaaacataggattctgtaaagcataggcttccctgtcacaaagggaaccaagtctcctttgtgcccttgtatctggagctgcctttgccaccctgggttttcaaggacaaaagggcactgtttcagagggtccttatgtagaagctttgctggcctccaagttccacacagctcgtttttctcgggaaaggaatgtatttaaggagagatgagctgagggtagacaaccacatggatatctctgtcctgccttaaggggccaaagctgtgcccacagtaaggagggtacacattgggcctgggttctgctctcttcctctacaaataagtctaaaaatacctctgcccagctggagggtgagagcaggaaggccggtgtcagcagatttctctagatcaaaacaagttgttccagaaaacagcagcaaacagaggcccttggattccggggtggagctgggtggtgaagggcccgccctgcctgtgtgggtggccaactcctgcttcttcccaggcagacagaggaacaggagggggctgctttggcaacatctggattccagggttagggccctgtctccaagccctttctttcttttctttttttttttgatggagtctcactctgttgcccaggctggagtgcagtggtgtgatctctgctcactgcaccctccctcctgggttcaagtgattttcctgcctcagcctcccgagtagctgggactataggcttacaccaccacattggctaattttttttttttttttttgtatttttagtagagacagggttttaccacattggccaggctggtctccaactcctgacctcaagtgatccacctgccttgacctcccaaagtgctgcgattacaggggtagccaccgcgcctggcccctgtctccaagccctttcttgcggctattgccaatcagggtcactggtctcccgggtgcctggagccccacatcttgttctgaagccaggtcagctctgtggtttccaaacatatagacagaccagtcccaggaagtacccgggatttcccacaggagcccctggaaaaggggagcagaagccgggtaagaaagggtggttcttcaggcttataccaagggcaggacaatgacagtgttgctactactgcttgagaatgtgcagggccccagccctccattctccacgggtctagttctggagctgtggcctccagggccattttgggctccccgctcaccagagatctgaggcctaggccctttctgagccctgaggcccctcagctcagggcctgggtctggaaactgcactgtcactgtgtgctggccgggagcccgcctttcacgcctcgcagccagtgcaggaaacacaagctgggccccacccccaactctaaccggcctcttcctgtgaggctccggcctgctctgcccccacctctcatgtgaccagggtaggccacccctcccagccttgcttcccccattttgaggctcctctcggccctaacatctcttgattctgacagtgtagtgtttcctggaacactcttcacctagttgctgcctagtccacttccactgctccttcaggcctctgccctaaggtcaccactcagccagcctcctgaccacaactctaaagcgccgccccaacttgatctcctcgagggaggggtttcggtctgttttgcccgggattgctgtgccctggcacgtgactctgcactttgttttgtaaaggtcactgagcaccctgaggctctgggtaaatatttgtggactgactgaggaagggagttcccaggtcagctgcagccccataaatgtgatgacaggcccagctctgtggggtcccaggtcaggaggcaggagagggaagaaggacagcggctgctctcagtggactgggactgcctggggtggccaaggggaactggggtgcactctcagccacacgttggcaaaggcatttgagggagagggcatcagagggagggggtctcccatggccctggtttacaaagctgaggtgaggtgaggtgagcatgccccagggctgctgcacctacaggagccgactgtcccaaccccagccccacgggcccttcctccttcccaactgtcctgggccctccctcagcacctcccattccccccccacccccaaacatactgagccctccggctatttttaacactttgacctaatgtgggctggtccaccacatgtgctggaaagcaggccgcccaccaggaaggcgaggcaggggaggaccctcaggagggggcttctcactcttgcatttgacccgtcacctcgggctgcgtggggtctgtgcacgccctttcctcactactgccaaggcagatctaaggggggcttcctctgcccagggccaagccccaggcctcgggctgtgctttacaggaaagaactttgcggtgtcagccccctgcatccggatgtcctgggactgtcccctgttccgtgccatgctagagtgcctgggcacctgccccttaccccaggccttggtcccccgtcctcctgagcactcacccactccttggagccttgcctgagctggcaccctagaacaccctgtcctccttgcctcctcctgcctcttcaccagctcactgctacctctgtctcctgtagccccatcctgtcacagagctcacgagaccttcctgttcccaccctgccacgctgagcgcctgtgtcctcactcctgttcccgcagagagaaggcctgtggaatgcgtggctgggccccatagccctgcctccccgggctgccctgcacctccagcggcccctagacctcctccaaccctccccaccctccttggccaaataagcgagcccagctttcctaggccccacactttcgcctgtgctaacctttccagcctcctccccaagcccacccactgggaatcctggcgccagctcctctgagcagggagcccaggtgctgacatcccactacctccacccctaggtttgcaaagccctctgtcttcaggaccgccagccgcccccactgccagagcctaccacttcctcttgggtccctgctgatgggaatggcctgcactgtgcttgtcccggtggccccatcacagcaccagttgtgactgtccttgaatctctgaaggagccttttctgccccaacccaccttggtctgactgagtgccctctgtgagcaagttggccatggtgccagggcttctgcggggagtagaacccccctgcccgggaggctgctgaccttgacgatactgtatgggaggcctgtgctctcgctggctgggagaacttgtcagggtcactgccacccccacaacaaagtgccaaggtcagatgggcaccggacaaagaagtccttgggaagagctgggactattattctctcttttgcaaattatgtcaaatagttaaaaatagcaggaagacttagtgtgtgaggtggggacaggaggtgctggaagagggctcagggcagctgggaaggaggaagggcccaggggcagaggccggacagtcaactgcctcaggagggaggcgactagtgccaggttgtgctcactccacctcttagatgtctccaaatagccccagtttaagtatttttactaagctgtcatttcacagaaaagcacacatctacagcagaatccgtttccaggacatggatcctgacctttggaaaactcaggacccatcacgaagctgaggaatgcccccgcccaccaccagggaaacaaaccccttaccctgtgttcttgaaagttggggacccccatcatgggcccagtggcaggaagaaggtcagggcagtcaggagccaggactcccactctgagagcgggtgagcccgcagcgccagacccaaggcccccgagattctgtcgtggggcacgaccctggttccaggttgcctgggcgggcagtgctgctcactgtcactgtccctgcagcccggcaggaggaaagggtgagctcagctgccccctgctggccgcagccgaaccagcaacctgcagatgggagtaggctccgccccacccacgctgtccgcccagtgggggcgagaggagccgggccaccacacggcactggacttgctgcttaaaactgaagtcctcagacccaggcccagccctgcacccccattctgggtgaagttgggtagtctgcctactttctttgaaatgtggggtggatttggacagggagaaaaatgccaggtagctctaaaagtcctctgcacaaaggagaagaatgagcgatgagaatctgtcccgaggcctgcacctcctttgggtcagcactgtcagtgtcccttaggctcaaagtcacaggctttggttgactgtccctgctccatcccatgccctctctctttgctgcatttacctgtatcctactgagcctgtcaggccccctcctccaggaagccttgtttgatcactgctccccctcccagtctattgtctgtctttgtgttgggtggtggcctgcacatctgttggggcatcatgtgtgtgcaaagtgacccattttcctggtctttatgttcttatccccggtgtcatctgaaaagctgcctggactctgagctgatgtctccatgggtaactctgttgctaatcctgcaaccctgtgtgcggggagcagttggaactcctgctccctgacaagtgtcagaggcccctggcacatccaccccagccctctccttcccagctttatctgtgccccttgcaccactgttttttcagactgagcatgacagcgtcctgggtcgccttggtcgctgtggcttttctgagtcccagcagcacctctggcctcccgtgtgtctctccatgcactgccacttggctgggggctggccacatgaagcctcagctgtgggtctgcgcaagcctcttgctgggctctggttgtggctggagcctcctgtgtccagctagccccgggttgggaagcccgcaggaatgccccagctgctgctgtaagtggagaatgacctggaaaccccagcctcagaagggacagtaggatcgcatgtgttgactgttctggtcacctctgcttcctgcattctgaagagttagggagagtctggggactggggactgtgaagacctcgtcccactgcactgtcctcaggggcagtctgggcagagcctcttcaggtcttcaggcctctggatccaggtgctggctgagccaggctgtgcgtgccaggctggcaggtggcaaagtcactcctgctgccccgtgcaacccaagcgtagctaggatttgaaaataacagctgttccggcattaaagaaccccaaagaagtccaagacaatcatctgtagggtagtggtaagggttaaatcgtgttcccccaaaaggatatgtcgaagtcctaaccctcagtgcatcagaatgtgacatgatgtgggaacaggatcattgcaggtgttattagttaagatgagctcatggtggagtagggtgggcccctagtctaatctgactggtgtctttgtaagaacacagccatgtgaagacacagacactaaggaagatgccagatgaccacataggcagagactggctgtgcagccgcaagccaatgaatgcctgaacggccagcaaggcaccagaagctaggagcaggcaaggaaggcctctcctatgggttgcagagggagcacggccctgctgagctgaaacctggattttggacttgtagcccccagaactgtgagacaatcagtttactttttttttttttttgagacagagttttgctctgtcacccaggctggagtgcaatggcacgatctcggctcactgcaacctccgcctcccgggttcaagcgattctcctgcctcagcctccccagtagctgggattacacgcatgcgccaccatgcctagctaatattgtatttttagtagagacagggcttctccacgttggtcaggctggtctcaaactcccgacctcaggttatccgcccgccttggcctcccaaagtgctgggtttacaggcgtgagccactgcacctggccgaagtgagttgttttttcggaatttttttttttttttcgagacagggtcttgctctgttgcccaggctggagtgcacagtggtgtgaacacagctcgctgtatcctcgacctcctgggcccaggcgatcctctagtctcagcttcccaagcagctgggcacgacaggcttgtgccaccatgcctggctaattttttttgtttttgtagcaatggggtttcgccatgttgcccaggctaggctcaagtgaccctcccgccttggcctcccaaagtgctgggattacagtagcaagccactgtgcctggcctgggcactgttattcccacgaaaggtcacaggtgcccatggtcatggcattgtgctgccttgccaggcaaagatgatcacacagaggacaaggtgccactcactgtcatggacacccaaggagacggccctgttcccaggactacgctgccacagggacaggtggcttactcctcccatctctggaaacattgtgaaccccaatcccccagtggcgctcatcctgcaggcccaggtcctgggtggctgctgcagggctcagagtcctccaggggtctgctactgtcccttccctcccaggtaggtgttgacagcaggatctgtgggaaacaaacggcctcctgccaggcctggagcatgaggtgccctcaggaagggcatgagcatctgcagttacccaccttggtccccacaggaaccccagagcccctcctgggcaacgtggggctgggagtacaagccgccaagatgagacagcttcactcgggtgctccgtgggcatcaacctggctggcctgagggctgcacaccttgacgtacgtttcatgaaaaccaaacatgcagcctgtaatcaactcttggactgtcacggacacaccctcattatttcatatcatgagctgccccagagtttgttagaaactgattttaataagtcacatgatacaaaagaatgagaacattcaaagaatgagtaaaatactgctttgtcccaaaggacaagcagaaaatgttaaggcacaatggatgctcagaaaacgtaagaagctgaagggaaaacacatcatctgtgtactcagacacacacactccaacccatcacacgaacacaccctcgcccgcccatcagagaagaattcgcctggaatcagctgggggcggtggctcacgcctataatcccagcactttgggaggttgaggcgggcagatcatgaggtcaggagttcacgaccagcctgaccaacatggtgaaaccctatctctactaaaaatacaaaaatcagcggggcctggtggcatgcacctgtaatcccagctactcaggaggctgaggcaggagaatcgcttgagacagaggttgcagtgagccgagatgcgccactgcactcctgcctgggcaacagagcaagactccgtctcaaaaaaaataaaaaaataaaaaaaataaaatcacctggaatcaaagcagcagggacagcctgcgctggagccgccagaacaggcaggcgggcagctccg

SEQ ID NO: 4405 - DNA, 6353 bp, Homo sapiens
cttccaggagagcgcctgcgcgggagggtgaccacaggcggccgggcgggatgtcctgtccgccgtcttcagcccagccgccaccacccataagctatgaggaggagtttacgaccacctggactactaccacctgcgtgacttcccggcctgaggggtccgcgcagcaaaggcctgacgctgctggagcaggcgctgcgcacctaccggctggcgcctggtaggcacgagtgcagggtcgcccagaagctcctcaatggccggcgcaagtgccagccagcgccagctgcagccctggccgcgcactcgcctcagctgagcctgggtatgtgcaccccccaacacttcccccagccatgttcccgggacctcgggagcgtcccccaccgcccggtgccattcgtgctgggcagggtcggccccctttgaggctgccccgcgttagggagctgcaccgcacccccaccagcttgacctctgactgccgttgcaatagcattaaagcctttggaactttgtaggtgggtagaaggggctaggaaacgaagaaaacatctttttaaaaatttatataagggactggccgggtgcggtggctcacacctgtaatcccagcactttaggaggccgagtgggtggatcaccaggtcaggagttgaagaccagcctggccagcatggtgaaaccccgtctctactaaaaatacaaaaattagctaggcgtggtggcgggcgcctgtaatcccagctactcgggaggctgaggcagagaattgcttgaacccgggaggtggaggttgcagtgagccgagatcgcgccattgcactccagcctgggcaacaagagcaaaactccgtctctaaataaataaataagattttcaaggcgaggcatggtgggtcacacctaaataagtaaataaataaataaaatggattttcggctgggcatggtggctcacgcctgtaatcccagcactttgggaggccgaggcgggcggttcatgaggtcaggagatcgagaccatcctggctaacacggtgaaaccccgtctctactgaaaatacacacaaaaaaaaattacccaggcgtgatggcgcgcgcctgtagtcccagctactgggaaggctgaggcaggagaatggcgtgaacccgggaggcatagtttgcaatgagccgagaccgtgccactgcacttcagcctgggtgacagcgagactccgtctcaaaaaaataaataaattaaaaaaataaaataaaatggattttcaaggccaggcatagtgggtcacacctataatcccagcactttgggaggccaaggcagaaggattgcttgagcccaggagttcgagaccagcctgggcaacagggcaaaaccctgtctctatcaaaagcacaaaataagctgggcattatagtgcacacctgtagtccgagctactcaggaggctgagatgggaggatggtttgagcccgggaggcagaggctgtattgagctgagatcataccactgaacttcagcctgggtgacgagccagaccccgtctcaaaaaaaaataataacaataaaaataaattcatatagtttggtatggtttagtaagtttcagcaggcagattgtcagggtaagatggattgttatatatacatttatatatataatatgtatatttatatacttatttattttagcagagatagggtctccctatgttgccaggctggtcttagactcctgagctcaagcaatcctgcctcgggttcctaaaggaagctcacattggaggtgtgagccaccacacctggcctataaggggaatttaagggactctctactatgatgtcccttctcccaatccctttccgcatgtagaagagggttctgttgagtgactggcatttgcttatatttctcagtgctatgcccagtgtaatggaaaaggcacagactggctcaagagcccagggatttcagttccaggccaagctcatccactgactgacagagtcagtcaaacttgtttggatttcagattcttcatctgaataacgtagataacacttatcccatagtacactgcaaagatgacacgtgacagtgaacaagttagtttccgtttaaatattaagaattaggccaggcgcagtggctcacacctgtaaccccaacactttgggaggtcgaggcgagtggatcacaaggtcaggagttcgagaccagcctggccaatatggtgaaaccctgtctctactaaaaatacaaaaattaggtgggtgtggtggtgggcgcctctaatcccagctacttgggaggctgaggcaagagagtcgcttgaacccgggaggcagaggttgcagtgagcgaaattgcgccactgcactccagcgcctgggtgacagagtgagactcagtctaaaaaaaagaaaggaaaaaagaatgagattagagagggccttcattcctcctggaagaacacctgatgtacctgaaatctttgttggtgacaggaaatatgtcgatagcatagggtttcactgttgcctcccacacagggccttcaccatctctgtcatctggagaatttgttcccatcaggaatctcccacctggcagtgggaccatgctagtagcctgtccatttcctgcagataaaaaagagaggtatcggtaatacatgcatatatataaaacaagtggtaatatttggatcgtatgcaatactcatgatggtatgacaaaacaaaacaaaaaatgtggaggtttaaaaatctggctttaaattccttttgcattttgtttgccttcacattcttgttctgccacttagtttgatgggaaaccttaggcaaatttcttaatctgagattcaatttcttttcttttttctttttttttttgtgacgggatctcactctgtcacccaggctggagtgcagtcatgcagtcttggctcactacagcctctgcccccgtgggctcaagcagtcctcccacctcagcctcctaagagctgggaccacaagtgtgcaccaccacgcctggctaatttttgtattttttgtagagatggggttttgttatgttgcccaggctggtctcaaactcctgagatcaagtgatccttccacctcagcctcccaaagtgctgggattacaggtgtgagccaacacgcccggctgagattcaatttcttcatctgaaaaatgaggatacctatggacaactgtagcttgttcataaaagaaaaaaaaaataagtatgaaaaatggggatactatctcactatctcttaggtagtagctgtatcaattaaagtaacatggaaccaggttcaatggctcagagacagggtgcagaagcgaaggcaggaggattgcttgagcccaggagttcaaggttgcggtaagctatgatcatgtcactgcactccagcctgggtgacagagtgagatcctgtctcaaaaaataaaaaataaaaagatagtaataaaatagcatgggtgaaatgttgcgcacatgatagatttgcacttacctctttcttcctctacacaaacccttgccccaactaggcgaatttagacactctaccctaaaatacatctagcactttctacccatccttctgctcatgctgtttctctgcctcttcctctccatttactgaactcttacagttcttggtgattctcaccattatatgctccagaagggaagtatataatacatatatatttttgacagtatatacctggtccctgccataaatgcgcaatgattatcgccaaatagttaaatgagcacctttagacttgtttgaatgcctcagaaatatcatagaattaaaaaggaccggccaggcatggtggctcacgtctggaatcccagcactttgggaggcagaggtgggcaaatcacctgaggtcaagagttaaagaccagcctggccaacatggcgaaaccccatctctattaaaaatacaaaaattaggctgggtgcggtggctcacacctgtaatcccagcactttgggaggccaaggtgggcggatcacgaggtcaggagatcaagaccatcctggctaacaaggtgaaaccccatctctactaaaaactacaaaaaaattagctgggcctggtggcgggcacctgtagtcccagctactcgggaggctgaggcaggagaatggtgtgaacccgggaggtggagcttgcagtgagctaagatcgtgccactgcactccagcctgggcaacagagcgagactccatctcaaaaaaaaaaaaaaaaaagccaggcatgatggtgcacaccagtaatcccagctacttgggaggctgaggcaggagaatcacttgaacctgggaggcggaggttatagtgagccaagatcgtgccactgcactccagcttgggggacagagcgagactctgtctcaaaataaataaaaaagggtctgtgcttcaaactccttattccacaggaggaaaccaagacccaaaaaagaaatatgacttaaagagctggttagcagctgacaggactagattcgggtctctttacagtactgtttccaataggccacacttcttcagcttgatgcaccacttcagtgtctttacaagaaaggatgtctaagcactgtaacttctttcaaggcagagtcctggtcttttgatgttcctcaagatcctgtctttggctctcttattctgacacattcacactgatttcatccattttttttctttctttttgtttttttttttttgaggcagagccttgccctgttgcccaggccagagtgcagtggcatgatctcggctcactgcaacctctgtctcctgggtttaagcgattctcctgcctcagcctcctgagtagctaagactacaggtgcgtgccaacactcccagctaattttttgtatttttagtagagatggggtttcaccatattggccaggctggtcttgaactcctgaccttgtgatccacccgccttggcctctcaaagtgctgggatgacaggcttgagccaccgcgcctggcctattttcagtttcttcaacaaatatatcaccaaggggaaaaaatggatcatcctggcatggtgtctcaggcctgtaatcccagcactttgggaagctgaggcagggattgcttgaggccacagtgagctatgatggcaccactgcactccagcctgggcaacacagtgagaccttgtccccccgccccaccaaaaaaacaaataaataaaaggagtaagtagggaaataatcagattgaatcagaattaagaaataacatacaattgcaatgtatgagctttattttgtccctaattcagccagcaaacgttaaaaaccctttatgagataatagatgaatttgaacagattggatatattattaagcagcactgccagttttttagttgagaaagggtaattattttttcgtgacttcttttgactattccagctgaaggtttagaataaaatgggttatgtctggacccacttcaaaatggctccaggagacggggagagtgcgattccacaggagcaggactggccacaaactggcagctctttaaggtggcccacgagtacgtgagggcaggggtcgttcctcgttacattctcctctttcccttttttttttttttgagatgaagtctcgctctatctcccaggctggagtgcagtgtcacaatctcggctcactgcagcctccgccccctggcttcaagcgattcccctgcctcagcttcctgagtagctgggattacaggcctacgccaccacgcccggctgattttttgtatttttgtggagacggggtttcaccatgttggccaggctggtctccaactcctaacctcaagtgatccacccgtctcggcctcccaaagtgctgggattataggcatgagccaccgcgcccggcctctctttcccttttataagtttgaaagattccagagcaagaagttgaaagcacaaggcggtgaggcaccctgcgcaccgagagcgacctccccagccggcggctgcaggcgcatcccggaagcgggcagaggggcctcaggctctctcccgccagggcggagggccccatcccctttcccagcgcccccggcgtggccggcggttcaatgacctagcctgagccacgcaccaaccaggagcgacagcagggacagcagcggtgatgaacaacccatgctggcatcaggactggcgcgccacgccgcgcacacccacggccccgctgctcatccgccctcacgcaccacggtggcagtcgcctcctccacacatgcgcatgctgctccacca

SEQ ID NO: 4406 - DNA, 576 bp, Homo sapiens
aggccagcctaccggcgactaggatgctttcgctttcgctctcgctttccaatactcgggactggggaaaccgggagaatagaagcaggcaaggaccgccgtgggcacggggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttaggtgagttactctttggttctggggctgacctggagttttgccaggattcattggccgcagcaggatgctggtggggacagggtaaataaaatctgcactcctgcgggcttttattgttgaaaggggcactgacgctctccctggaaacttaaaaagaacagccaagtgaacggatgtgtctttcttttgcagtgcccaagcctgttctaatttttaaaaactgatgtctattaagacccaatg

SEQ ID NO: 4407 - DNA, 1907 bp, Homo sapiens
catagtttgaacttttatttatgtttaattttttaatttttacaagatgccgatagtagctggcttattaatgtacattattctttgatatttcaggaagccacagtgttcaactgtgaactacagagtcctgtaagtttaaaataactttgtttctcaactatgtgatatccaggattttttacaattactttgagatttttcctcatcagtaatgcaaagaaaattgcaatatgattatacaatttatttttatttttttagacaggttatcactctgtcgcccaggccggagtgcaggggtgtgattgtagctcattgcagcctcaaactcctgggctcagacgatcctccttcagcttcctaagtagctgagattacaggcacgtgccaccatgcctggctaatttattttttgtagagagaggggtctcactttgttgcccaggctggtctccaactcctgggctcaagtgatacccagcctgggcctcccaaagtgctgggattacgggtatgagccactgtgcccagcctgatatacaatttcttcctcagacagtctggctctgtcgcccaggctggagtgcagtggcacaatcttggctcactgcaacctctgcctcccgggttcaagcaattctcctgcctcagcctcccgagtagctggaattacaggcatgcaccaccatgcctgaccaatttttgtatttttagtagagacctggggtttcatcatgttggccaggctgttcttgaactcctgacctcaagcaatccgcccacctcagcctcccaaagtgcttggatttcaggagtgagcttttgcacctggcctgatatacaatttctgatgctatagaagcaatgtataactcctaatttactagtgactgctatgcgcttcattaacattatggacatgtcgatcccaaaaatcatatagaaatgttactttttttttgagacagggtttcactctgtcgcccaggctggactgcaatggcgtaaacatggctcactgtagcctcaacctctcgggctcaagcaatcctcctgcctcagcctcccaaatagttgagactacaggcatgtgtcaccacaccccttaatttttgtattttcttttctcattatgttgtccaggatggtctcaaactcctgggctcaaggcatcctcctgccttggtctcctaaagtgttagaattacaggcatgagccactgtgcccagccagaaatgttaaactcactttatggtttcagaacaaggatcaaataaaataaaaatataaaaaataaaatatggttggccaagtgtggtggctcagccctctaatcccagccctttggaaggccaaggcagaaggctcgcttgagctcaggagttcaagactagccttggcaacatagcaagacctcatttctgctaaaaataaaaaacattagccagacatggtggtccacacttgcagtcccagttattcaagaggctgaggtgggaggatcacttgagcttgggagatcgaggctgcagtgagctatcatcgtgccactgcactccagtctggcgacagagcaagaccttctcaaaaataaaatatggtcgaaacgggacagacaaggcggctacctgtaaccctggccgctttaggagctggggcaggaaagttgcttgaggccaggaatccgagaccagcctgagcaacagcaggacccgtctatgaaaaaacaggagcaagtagtggcacatcccaattgtgtcagctaactgggaggctgaggcagtttcgtgtattcttactccactgggttctgctttatcgtattgacagtagacatttcattaaatgaaatgtaaaaagaacaccaatacatacatattaaaattttcttactagaatcttt

SEQ ID NO: 4408 - DNA, 4796 bp, Homo sapiens
agtgaaggtctggcgctgtctacggccccccaggccccggctcccgggaggccgcggcccccgctcccaccctccgcaactttccctccgctcgcgcccgccgctcctccgggacccggcctgaggctccctcccccggcggccggccctgggcccgcggcgcctcctcctaaaatggcaggtccctccctccgcccggccggcctcggctccggcccggctgcgggccgccgggggagccgagcgccaggccgggcggggccgcggccgggccggacactcaccgggacgatggcggggcgctcgcgccgcttcctccggtgagtctcagcctcgggctcccgcgccgcgctcccgccgcggcctccgcagccagcgccgccccggcagcctctctccgcccccggcgctccggctcctggccgcgccgcagcctgctcagtctctcctcggctcgcggttccagcggcgcccggggccggggaggcgacagccccctccccggcaaataccgcagtccccgggccccgattccaggcggcggggccgcacggccggcccggcgcagagggcggcgtcggcgaggccgggcgccgagcggcggctgctgccggcggcttcttcccgaggaggattttgtaaatctcacaaaatggcgcgcgctccgaacctgcgcagcgagaagcgccggggcccgggcggcggcggcggctcctccgccaggagagcccgaaccgcccgcccccgagtccccgcacagacagacagacactcgcacacacccgcacactcgcgcgcacaatcgccctcgcacacgctccctcgcacacacactcgcactcacaccggtcccgcctgctcgccggcggcggcagcggcaccaacagcagcagcaggaacagcagcagcagaagcggcggcggcggcgcccgcaccccccgctcggggtgtccgctctctgaggccgacctgggccgcgatcagcagcagcgacagcagcagtctccccggatacccccgccgcggttgccgccgccacccccgcctcactccaatggggctttttattattattcgggcgggaagcgaaagggtttaaaaaaaaaccaaccaacaaaatggcgacggaccgacccggtcgctatagcaactgtcaatcaaaacgcaaaaccccggctgacgtgctgacgtcctcctcccgccccccagccccgagccggcgggcggggcctgttgctcaggtaacggcagattccgttccctcctttccgtctccccctctgtccccagccaaccacccaaccccctcaggtcacgtgaaggataaattcggagctcgggtccgctacgagtgtcagaggagggcgcgtgattcgcccgggggaggggagaggagggggacggctaggccgagggagggtaggggctggggaagggggggcgaggcggcggccaggcctgtgcgcgatcgcccgccgcctcccggccgccccgccccgccccgcgcccgcgccgactgcggcccggggagcgcgcgcggcctcccgcgccgccgcccccgcagccctagcgccccgcgcttccgcgtcggcgcccgcagccccgcccgcgccggggggaggggcgggctgccccgggcgggggagggggaggaggaggggcgccgcggccttcgggcggggacccgggaagcccaccccgcgcgcccgggcctggagggctctcaccgcggtccgggcgccgcgctcgcctctctccccgggaagcgcggcggccgcgaccgtccgcgcgtggagccggttcttcgaagggctggcgggcctcctagccggaaaatgccggcggaggccgtggtgggggcggggaggagccaccgccgcgccccagacatcgcaggaattccggacgctgcgccgggcccggcggccctgaggctggcacctggctccggtcgggccgcccaggttttgtggcgcccgagaccagcgttgggaaattaggctggagccatcatgaaaactttttcaggcagtgcacgctcgcctgtgcctgcccatctgcttccaacctctccccacctttcggggcgcagcctgcctgctccatcggaatgccctttagatgaatccccttgtgctgttactgtgtccttgtcgtccagctctctggttttcttttctatacaccttctcggtttccagagtcttaattcgcctgcttgtccttaaccatcaaaactctttattaatatcctggctttcgctgatttttattctccctaccccttctccctagctatgtattgctgggtgagctcccgaggcttgaaaacccaagtatgctgtgctggctgcgttgtaatcggtagagagccaccagctaaaaattgtattttgtaccaactctaatggcatttaataaatgtatacctaaaaagagtgtgtgtgtatatatatactattttacagcagagtcactaattgatttctaagcttgattttgccaccttgtgatagtgttcgtaaccaatttttttcataaatttcacaaatgtgacaacagataaaatcttataaacaatattagatgtaaaaaactcgcagtaaatgccgctgtctatgctacatgactcaaatacacctgctttaaatgatttccagcaaaaatgtccttgctacagttactaggacattgatatactaaggtaaccattcagattagcacagactttgaaagaaatccgactaaaccgaaaataaattagtcaaaaagtaattactaaggtaaccattcagattagcacagacttggaagaaacctgactaaaccgaaaataaattggtcaaaaagtggtcgggcaaatagcttgctttcaggctgatctccatgatataaaaaagttgccgtagctggcaaaagttctttcggattattgtttcaaaattgccctgctagtgtgattaaggtccacggtcaacttaattgttttgaagaaagaggaagtggcccagagcgccccttattcagaggagaggtccctacctggttcctcccaagctcaagcttccacctatacaaccaacttcttcctctctgcttgtgggtctccttcctgcccccaccccatcccaccccattcaccaagctttcgcttctatcagagcacatcagcatttgcaacctttaatactaaattaaatttgactcaaatttttattcctggtaatggaagaaacttgtatagttaatcttccaggtaacctgaacagaatatgataatgtctcaagatatgtgtccttgtcttcagttcaaatcaacctagaagatatcggagtggggcagaatcttgagattataaacatgcgggtatagaaggcattgctggtcttcgtatctagaaggctgcaccccttttctccccagtgtgacagccttagacaacattggtcaatgaatgtcatatccaggttggaatgctgtaaaatggttttatacaggcttcacctaaaaacgtaacctgtgaattacagctggctccaaacaagtgaccacatgtaggccggaaggactctggtatagatgccagctgacctggttcacagatgaaatccttgtcatctaagaatcttcccattagattcacttacagatgtgtttattcatagactgttcaccttgaaaagcaaaggccctcagctcataggtagtaacagcctccacttacccagcatgttctagagtatctctaatcctcacagcaacattacatccccattatgtggatgagaaaacaagtcctgagtgattacatgactttctcaaggcagtcaccactcaccagtaagtggtgaagccaggattcaaacacaggtataattgcaaagcccatgttctttctaccacaccaagatgattcaagattatatggagttagagtcttcacagaggtaatcgagttgggtctctagattgaaccctaatccaaaatgactgctgcccttataaaaaggagaaatttggaccaagacaaacgaacacagggaagaacgtacagacaccaggagaaggtggccatctacaaaccaaggcacacctgaggctaccagaagctgacaaagaagcatggaacagattttgtcttacggccatcagagggaaccaaccctgccaacatcttgattttggacttctggcctccagaaattcaagacagtacatttctgttgtttaagccacctagttgtttgtactttgtagtggcactaagggaaactaacacacagatgcgtgccaagatggtggtttcttttggttggcttcatatccgttagtgaccactcctggtgaggcactattctaagcctgaaagtccagtagttggaatctcgctgagagttataacccaaataaatattccaaggacaaacaagcaaaccagtattcctatcaatgctcctcacgccaagcgagaaggtgaacaatttgcatttggtccctagacagtggcatggcgtggcatctgacacccctactgttcttacagacttctgggtaaaagtcttcacttgctgcccttgtacaaactttattgttcgttcgttctttctttttttttttttttgagacagagtctcgctctgtcacccaggctggagtgcaggggtgtgatctcggctcactgcaacctccacctccccagttcaagcgattctcctgcctcaacctcctgagtatctgggattacaggtgcccgccaccacacctggcaaatttttgtatttttagtagagaaaag

SEQ ID NO: 4409 - DNA, 5871 bp, Homo sapiens
aaattggaaaagtaaaatactttattcacagatgacatgattatctacatagaaaatgctaaagaatctagaaaaaagctactagaataagttaactgatctaagttgcttgatacaagatcaatgtacaagtctaatgcatttctatatactagcaataactagaaaacagctttttgaaaaccttaccacttgcaatagcatgcagaaatattaaatacatgaatttaacaaaatgtgagagctgcaaactgagagaaattaacagatctaaataaatggggcagtacaccatgttcaacaattggaaaactcagaattgttaaaatgtcatttctccctaaattgatctataaatcccagaagactttctttttgcagacattgataaaagttgttttttgagacagtttcactcttggttgcccaggctagagtgcaatgccacgatctcagctcactgaaacctccacctcccaggttcaagcaattctcctgcctcagcctcccgagtagctgggattctacaggcgcctgccaccacgcctggctaatttttttgtatttttagtagagatggggtttcaccatcttggccaggctggttttgaactcctgacctcaagtgatccgcctgcctcggcctcccaaagtgctgggattatacaggcatgagccacgggcctggcctgaagttgatagaagttgacttcaaattttatacgaaaatgcaaaggatctagaagtcaaaaaaaaaaaaatgggaaaagaacaaaacggaagcccttccaatacctgagttcaactacagttggccaggagtggtggcttaataaaaaatattcaaaagacaccattaagaaaatgaacaggcaaaccaaacatgaaaatattcacaatatttgtcacaaatggagacaaagaattctatatattacatgtatgtttttcatgcagaatatggaaagaacttgagtcaacaataagcatcccaacttaaaaacaggcaaaaggcacgaacagacacatcacaaaagacgacacggaaaagcaataagcagatgaaatcatagacatacattattcagtgggcaaatacaaattaaaatcataaggaggctagagtggattaaattttaagagactgacaatgccaagtgttagcaaagatatggagcaactggaatcttcccataatgtagtaatagtgtaaaatgattcaaccactacagagggctgtgtgacaatttcttaggaagttagaaacacgtattgcaatggactgaatgtttacatccttgcacaattcatgtcaaattcctaacccataagatgatatgaggtggggtcttggggaggggacagaatcacaaggggagagccctcatgaatggggtaagcttgctagtccctttccaccacgtgcagtcacagtaaaaagacatctacttaaaaggaagcaggccctcactagacaccaaatgttgacaccctcatcttggacttcccagcctccagaactgtaaaacataaatttctgttgtttataagcctcccagttgatggtattttgttatggcagcctgaatgaactaagacacttacaacacagcaattaaagtcctaggtacttacccaagagaaataaaaacacatgtgcaaatacatacttttacacaaatgctcatagttttaagagccgagactggaaacccattaacacatggatgaataaacaaatgatggcttatccacacaatggaatactattcagcaaggagaactactgaaacacaaaacagcttggatgagtctaaaaacatgccaaagtgagacatcagacgcaaaagaacacatagtaaatgaatccatttgtatgaggctctaaaccaagcaacactaatctatgaggatagaaagtggttatctggggctggagtgggcttaactaggaaaaggcaaaagggaacttctttgggtgacagaaacgtttttggttctggcggtggtggttacacaggtggtggtggttacacaggtgtatagatttttcaaaaccttgtacacttaaataggcgttttactatatgaaaattgaatctcaataaagttgattaaaatggtctggtaaaatctacatttgaaacatctctagtaatgctgattttccagaaaatgtagatctcttttttgaattatttgtcctgagacgttcagggttggtagtatttaagaactcaaaatatggcctcatgagaaaaaaattatatcgttacaaaactggactttggggttcatgtccagatgaaattcagaggtaaagactaacagtttggcgaggcggctgtccactgtccatttacctcgcctgctttcgaacagtcctagccaaaaagccatctgtcatggctccatgtttctgcagattcctctcctggaccctattttcttcttcagctgctctctactgatctctggcccagctgaaatgtcacctcttctgtaaggccttcccagctctgtgccacagcaggcaccccctcacctgtgctccttcacacctgagggcacatacttaactcaccctactgtgatctccgtcttccccactacacggtggatgacttcagggtagtgggttgctcatctgttttcccaacattgaggactattccttatagatatcaatacattttgaaatgacacaatgagccagagagcatggaaaatgacaagagctcagttcaacctcagaactgctacaacagaagagttacgtagcgcattgagactgtgcctttcgagtgagacagaaagatacagacaagtaagtaaagaccttctcttgagacctgcctcctcctgtccccactgttccagctgagccaggtgtcaatgccctccagatcaagtagacagttctgcatgagctgtaaggtggcacacaggagggcgtggatgtgcacaggatattgcctgcaacttctaagtaggagcagcagacagtagcagggctgagaagatacttctaacagaatcgtagattatactgatacaaaatgaacaaacaacaaaaaaaacagccaacagctgaaaatttttagaatggcagtatagaaaggacaaagcaagagagatgccaattacacatagatttaggggtgtattttttattgccctgtgctagacagtggacacatggaaatcaatcagatatgatcactgtcctcaggaacccaacagcatagtgacagagatagtctatcacatcattctgacatatgcaagtaaatatagtaatagcagtaatcactgagccacagaagtgtggagagtgctgccaactaagcttgagggaaacacccattgacatgatgcctgaggcttgtcttgaaccatgattcagagttaattagctgagaagagacccttcaacaagaacaaaggcgagagaggtaggaagccacgtggagcacagggaagatgaagcagtcggtgttgctgcagcattaaccgtgtggcaggaagtcaggcagtgggaggcagggctccaggacgcaggaggccttagggcacacgatgggaggcctggagttcctcctcaggacaacagggaaatggctcggggttcatacacgagttacctttcttcaacttaacacatcaaaatgtcctaggtaacattctcctaaatcgtaagattagatacacagttgtgctgtaataagggatttaagtcaaggatggactctgcttaactggggatgaaacttcttaaaaaccttttcttgagacctgtcttctccctgcccctactgttccagctcagagtcaggtgtcaagccctgtgactctcctgaggacagtgctcacagctgaggagaagggctgagccgagtagggctgcacagtggcaggtggcacccactgcaaaagcagccccatccatgactcacaaaattctgacatgtccaaatcttagaaaccacatgaatcctaattccacgcatttccaaacatcactcactgggcgggaaagtaattattttataagttacctgtgtgttcccccttatctacagacctctcacccaaatgtatgggggccttactcaaggagagtccctcttggtgaaccctttgattatttttaacgtttgtagttgagttaaaatctctcccatactgactacattcatagagcttctcttcagtatgaattttctggtgttgaaggaagtttgacctctgaataaagcctttcccacaataactgcacacatagggcttttctccagtgtgaataatctggtgcagaagcagcttggagctctggatgaaggctttcccacagtctttacattcgaagggcctgtccccagagtggatcttctggtgctcagtgagatgggctttctggagaaacgctttcccacattccttacattcatacactctctctccagtgtggattttctggtgtcgaataaggtatgaactcagaaagaaagctttcccacactcgttacattcatagagtttctctccagtgtgaattctctgatgctgggtgaagtttgacgtctggctgaagcgcttcccacactcattgcatacgtaaggcctctccccagtatggatcctctgatgctgaatgagctttgaactccgaataaaggctttcccacactcattgcattcaaagggtctctctccggtgtgaattctctggtgttcaataaggtctgagcgatgacggaatgccttcccacattctttgcattcatactgtttcacttctgtgtggatctgataatggcgaatgaggctcgagctccttatgaaggatttcccacattcattgcactcatagggcctttctcccgtgtgaatcctctgatggcgaataagtaaggagctctgactgaagcctttcccacactctttgcattcaaaaggtctctctctggtgtgaactctctggtgcctaatcaggtctgaactgtgacaaaacgccttcccacactgcgcacatttgaagggcttttctcctgaatgaacgcgctgatgctcaatgagacctgaatagtgaatgaagtctttcccacacacattacagacgtagagtctctctccagtgtgaattctctgatgctccataaggtgtgagctctggccaaagcctttcccacactgatcgcacgtgtaaggtttctccccagcatgcgaaatccgatgcctaactaggtccgaattaaacgtgaaggttttgccacagatatcgcaaggattggcttccccctctatgagctctctctgaagcagaagaaggtctgagttcagaatatggtttcttcctgacttggtgcacacttgagctgtctctcctgtctggatcttccaatgggtcactgtcacctgcttgcagcccctgtcctgagagggggaactccccaggctctgaccttctggatttcccaagagctcccctaatctgggctcgtggacttcctcagactcgggagaggggagctccatcaccgtgagtctgtctgacgtcgtcctatgtgagttttcatcctcagaaatccaggcttcagtcaccttcttctcaccagttcctacattagaatctgaaacaaaagacaacaaaatcatctttccccttacttaacagatggggatctcctgaatcagggcaggataaaatccatatccaagaggtggaaagtgtttcctctgcccctcatcctgacccaacatgctgctacccacagctctggtctcacacccaagcctgtcccacataagatggcttctttgtggctccacttttaacatccaacaccaggacagactggtctgtggtgc

SEQ ID NO: 4410 - DNA, 7616 bp, Homo sapiens
ttgagacggagtctcgctctgtcgcctaggctggagtgcagtggtgcgatctcggctcactgcaatctccgcctcctgggttcaagcaatcatcctgcctcagcctccccagtacctgggattacaggtgcttattaccacactcggcgaattttttgtgtttttagtagagacggggtttcaccatgttagccagcatggtctcgatctcctaaacttcgtgatccgcccgcctcagcctcccaaagtgctggattacaggtgtgagccacctcgcctgccctctttttttttttttattttgagattaaaactaattcttttaaagtcactactcagctgaaatttggcctgattataaatgttgataataatttcttcctggctcaacaaagttgttgagcttccttctgtgcacacattgaaagaaaaccagaaattgtacagtcgtgatatgaattagagaaggaacaggtggaaaaggatggcaacacacagagtccgggggacacacggccttaagatgaagtgaacgagtagacactgaataggatccacgtaaatgaacggccatttcaaatcattcacatcccaaacggaggttcatctgtcttctggttggtgaattatatttattaggatcttatttttagcatttcattacaagtaataggtttgggtaccttatttttattgtttttactcatcagttatgaataaggcataccttagaaacttgggttaaattttttcaagttataccagtcaacttggtttaaatacaactgtactaacttgctttatcatgtttcctgtttaattggatgagaattacatgcacttattcagttgttctttgtgtttataggaaaaactctgttctcagctacctcattatgtagtattgtgcttgatcccctgccaattgagaagaattcaacacattctgttctttaacaaaagcttggaagcaggcagtcagaggccttgaggaatacaattctctaaggcctgttttccattttactacttaaaaaaaaaaaaaaaagaaaagaaaaaaaagcacttacaaccaggaggaataataattctcctagagttgctgcaaactgattacttgaaactcaacttgaactttaaagagtctttaaaaggctgttttcataatgcagaaaagtagtctatttaaacgccactgctgtgtaaaacagggggctcgatttccattcttgttagcatcagacaagaaaatgtgtctatctgtcatctgacccagtatttgggatttgggtgcttgaggatactatttttttcatttcttataaggtgctattgtttcccagaaatctttaattttgatgaaaatctactcattgctaagatcctcctcacttaaagtgtttcctcagtgcagagttgaggttggcagaactatatagagttggatgatactgaaaatcatgaatgatgtgatttgttccatgtatctgtggaacatccctcaccttcctccggtatgcgccttctgcactccacacgtggtcgcctccatcctccctagtgtctgtcagcttgcctggtcaccaagtcaggaggaagaagatgaggaggctcaccagttgtaggcaagactcttcctctcgggagatcttgtaataatggcccagtttcagggcacagttgtacacattctacttaaatggaggagttcagtgatgccgtggccaaaagagttatgcccatttctaaaagcctggcatatttggtataacttaagcaccaggtaaaatctggtgcttaagttgtaccaagtatagccaagtttaactgtcgttgtgtattaataagatttaatttttatgcttgtgcttttcagagtaaagggcttgctttcaatagtagaatgacaaagcttctcctccaatgacaatctgttagcaccctgttgacttagctcaggacatgagactgacttagctcaggacatgagacatttcctggaagtgatttccatgagaacaaaggcttattcctttaacttaaaccccaaactttgttattttaattattttcaggcaatcatctttatatactttccttacaaacccagtggttgagagcataggccttggtggcaggtgcatctgggcttgggggcttctgccacacttactactctgtgacttgggaagctcttaaggctcccaaggctccgtttcttatgtggaagaagaatagcaggaggactcacctctgcgggttgttgtgaggattaactgggtgatgactgtaagcagctgggagagtgccttgtgtgcagtgaccactgttgctgccaccatgattatgtcacctctcaacatggggtggtgggaggccctgtggatgaggccaaggctgcctgcactgagtgtcccaggccttatagctttccacattctcacgtctgctgccacatgatatacaagtaaatgtattagaagttggtgttcataaaatacttttttttttttttttttttgagatggagtctcgctccgtcacccaggctggagtgcagtggcgccatctcccaggctcaagggatcctcctgcctcggcctgccaagtagctgggactacaagtgcacaccagtatgcccagctaattttttgtatttttagaacaggtgtggtttcaccatattgcccaggctggtctcgagctcctgagctcaggcaatccgcctgcctcaacctcccaaagtgctgggattacaggtgtgagcatccagccagaaaatgatttgctttctagacccatatcacctctctccatctacatctctagtatttaaattcaacacaattctagatagctgaaacagcccaaaatatgtgtttagaatacttagagtttgttataaataaccctctgtttagaatttgcccagtgaaattctctaataatacttaaaactctttactaaagttgaattttccttttttttcattgaaatagcaaaggtagtaatctgtattggtcaaagaaacgagataattcctagatctctgttttagaccagtagacctaactgtgctttcttaacttggatgttacatgaaacttaaaaacaaacaaatatgtgttacaagtacttgtgtgtacgtgcatgtgtgtttgtgcatgtgtctgtgtgtgtggaacttttgtacctttgcataaagaaggttatttaacaaagtggtacaaacagtgaactacttaatccttctatggtatcatacacttcttttcctggttaggttatgagactggcagaggtaggagtatataatgtgctcagcttgtcttgatttcaataagacatttgataaagtcattcttgatctctgaatgtgaaaaggaagtagaacagccgggcgcggtggctcacgcctgtaatcccaggactttgggaggccaaggcgggcagatcacctgaggtcggcagtttgagaccagcctgaccaacgtggagaaaccccgtctctattaaaaatacaaaattagccgggcatggtggcacatgtctgtaatcccagctactcgggaggctgaggcaggagaatctcttgaacccaggaggcggaggttgcggtgagccgagatggtgccgttgcactccagccgggcaacaagggctaaactccatctcaaaagaaaagaaagaaagggaagtagaagtaggatttaacaaaggaccgagaagtcggctgaatagccaggttcagacagtgttggcaagaacggatctttggcaagatcacttaaggtgagctactctagcagcatcctgtttgacatttgtatccataacttgaataaaaatatagaaggcaaagaagagtgctgggcaagatgtgttgggtgttagatctgcaatactcttcatagtgtaatggctaaatgtaaagtcttacgtctcggttcaagaaagcacgttgctatatgaaatttcagaaaaaagttttgttgcggggggtgggatattgatcatttgaacatatgccagttgtttctcctgccctaggggaggttggcacggcaaccttcccactccgtaggtgggtagccttgctgatggggcacgtcgtcaccaagggacctgattgttgtcatggttttgtcttgtcctcctccctggtgaaagtctactgcagttttattctcagctctggaaggagagggaacgagcctctgcctgtgtgtcctgacccctcttgccttgtttttgatctgctcaggccgggtgcagtggctcacgcctgtaatcccagcactttgggaggcaaaggcaggtggatcacttgaggtcaggagttcaagactagcctggccaacatggtgaaaccccgtctctactaaaaatacaaaaattagccgagtgtgttggtgggcccctgtaatcccagctactcgggaggttgagggaggagaatcacttgaccccaggaggcagaggttgaagtgagccaggattgtgccactgtactccagcctgggcgacagagggggactctgtctcacaaaaaaataaaaaattaaaaaaaaaggtctgctcagaaataggggaaacacgggatcaagatcattagagatttataggctgggatgcacaccatgtcttcagagctagccggctgtgtcttctccccgtttctttcactggtgaataacctttcgtttgaaccagccttgattgttctctccatgttccactgtggctccccatggacactgctaggtggaatctctgagaaaacaggcacttcgcagtcggcgcatctttctctgccagcttagggattgccgtcaaggtggaggaagggtattttggccatgttcggagtcgttgtttttactcactcttcttgggatagctttcccaccctgccctctgctcctctgtcccaaccctcttccagcctggtttttttactgcttgaattatgtatccaaaataaaaaggaaaagaaaggtgcagttggggcgggttgttgggggcgaggagaatagcccttctggttcttcagaccacataatggccagagcatgagcctcacagatccctgagcagacctgcatactagcactttccacaaccagctggccctggctgtgagagtcagatctgtccccaaggctccaggtcagaacttggacccaggtgccttctgaggcaccgccaaggacacatcccagcgccttaggcacctgtaggctagaatgacaccttccaggccagccccagaggccctcagggctccccctccaagccgggagggcaggcaggcacaggccccgctcactacctcagcacccagtgcagccccaggctcccggacgtgctcggcccggtggcctcttgtgtgacaggccctctgccatgtctgtccgcagagccgggtggggaccctccgtgtgggtcctcctctgtccctttgcagctcgcattcgccagagcggagcgcagcccttgtttccttctttcctcttcagctctgacttaaaaacacactatgttccaaatcgttgtgggatcggaaactagaactgcttgtttccaggagagaccaccttttcatattttttttaaaaggaatttgtgcttcaaaagaaactccaaaaaataaatttattgttagtctagcatatgctcattgaaattgacttatgttttattttaaaaaatcatgtaggatctggtacatggggcgggcaaaagggtatcatcagcttaagaagtaaagaagtgagccttccatttgtgtgggtgataacatctttttcctagatcgtacctcaaaattcaggctctccatgaaaacaaagataatctgaataaaaattgtgtgttgggaaatgtatcaagtgaccttcagttaagaaaagcacaggctgtttattagcacaacttgcttcattaaataattcgtggctttttctgccactggggttcttttcgttttgaattcagcttgtgtttggttcctcggtcttgtaccccttcagttcgccggcgacgtaatggtgataccctttgttttttgtatcataccttttgtgaattgtgacaaccatcccgtaatcattgtggcctcagcagaagttttgaacaatctttgcagccactgttggggtgtgtaccagcagcctggaagtgaccagcagagctgacaaaagcaccccctgctctgcccacctccgcagagtcctgtcctcatcagaaacggtatcgcggatgctcctcaggtaggcgtaggcagacttcattgtgtgttagcagtgacagtgatgtctgtacctatctgtgagtgagacccattcatgacacactagaaatgtgtacattcttttgttttccatcacgggtataggtcttctgccatgaaagagaactatcaaggaaattcctgaaaacaagatttgtaaattcgatttgaccctcccaaattcagggctgctctttgcagtggtccctggcccagcaggtggccggcgtggctcctgttggctcatgccagtgttgtgctggaccctcgagtatgtgactgtcacccttgtccaagactggtttttaacagtcttgatttgtcattttgatgctttgaatactataaggaaaatgccacgaataccatataaataccacaccaatctgttgaacatatctgtgttttctgacatgggacctgcagaatagtatttcttttaaatcctgcaactttattatctagtagaattccaagtaggtctgcttagacacatattcagtgaagattgtattgtgtgtgatattatcctatctttaataaagtcctactactgaaaaacagggatttgcaatgaaaatcatagctaaataggcaggtttagaaagttcaaaatattggaagtgctagaaggctgcaacttgtaaaattgtactccccaagttcagtaggatagtagagaagtcgtgctaagttgatttcattgaaatgtcacgtctcacatcctgtggtccaaaggtactagtttgttttgtggaataattttctgttcacttgctgataagaaatttagcagtcagaagtaatttttaattaataacctttctttttaaaagttgctttatggtttacaagtaatactgatgcaaaaaggatttgttaacctaaattaagtagcacgcactttgtttacatgcttcagtatattgtggggttggtcccttctcacgaacccaggacctgtgcttggggaacattttgccatcatgctgttctcttgtaccaaggatcagtgaaagtgttttatcttttttatgtagtttgtattgactggattttataactgtaagaaaacagaaacagagtgttgtattttgatctgaaatttgtgtatgctaaagtaattttgttttatgtattggaagttcacttaaaaacttgaaatattttctagaagggtaccacacaaaaggaatcatctttaagctgtttaattaacctaataaaataatttgatggggaaggcattctaattgtttctgatttttagagtggttcctgctaaatcatcattatcaatacagcttgatttgatttaagaa

SEQ ID NO: 4411 - DNA, 952 bp, Homo sapiens
tgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacat

SEQ ID NO: 4412 - DNA, 1126 bp, Homo sapiens
cctagatggaagagcctactgcacacctaggctgaatgggaccagcctggccaacatgttgaaacctcaactctactaaaaatacaaaaattagccaggcttggtggcatgtgcctgtaatctcagctacttgggaggctgaggcaggagaatcacttgaacctgggtggtggaggttgcagtgagccgagatcaccccactgcactccagcctgggcgacagagcaagactgactcaatttaaaaaaaaaaagataaaaatggtgcatctctatagggcgtttaccatgcctggagcttgtgggactggaagttgctctgatacgcagcctggtctacaggaagaattctatgtatatttgctgaagagacaaagaaggatgtggatgaattggatgtggagaatgagaggaaagaaaatgtcaaggatggctctaatttctggcttatgcaactgagtggtgccattgagagagactctctctcttgccttcttggttggcacactggggagaagcgagctgcagcgttggagaggcccatgtggcaagggactgagagcagcctctggccaacagccggtaagcaaccagtgagcaaccgaggccctcagtcccacagcatgtgaggaactgagtcctgccaatgatcatgtgatactgaaggagggtctttctttagctgatcctacagatgagaatctagcccttgtgctgcctcatgagagaccctggagcagaggccccagctgagctatgcctggattcctacccacagaaactggaagacaataaaagtgtcgtttatgtttttttattctggtaaaaatcatataacatgaaatttttccattctaaccattaaaaacatgtctttttgtgtgtgtgagacagggtttcgttctgtcacccaggctagagtgcagtggtgcaatctcgactcactgcaacctctgcctttcaggctctagtgatcttcccacctggtcagcctcccaagtagctgggactacaggtgcgcaccaccatgcccagctagtttttgtttgtatttgtagtagatatggggttttgccattttgcctaggctggtctcgaactcctgggctcaagcgatccaccctcaa

SEQ ID NO: 4413 - DNA, 3977 bp, Homo sapiens
agtttaagaggctacagcagggagggagcgggggagggggcggcaacggtgggggcgcccagaccctgcgggggaagtgagtcacccagaaaacgcagcatcggcggctggccgttaacccgctcccggccagggaggagatgtgggcttggccggccacgccctccctgctggaccaagcccgtccctgccgcccaccaccccgacttcacttctcacctcttagcgtcaggagccacctcgcctcgcactcgaaggcactctccaggtttgagattcaggttgctggcgaccagaccctgcacagacaagccccggcccagccgggttagaggacaaggcctccactgctcgaagtgtccgggggtggctgggggtgggagtggggttgttcccgcccggcatcctctgaccaagccaaggggaagcctggggaaaggattgagctgtaatttccagcctccgattgtctatgtggtcctgggaaagtccctattcccaccggggttggcttcagtctgtaacgtgaaggttctagaagacaggctctagaagattttgcagattggcttgggaattttggactcaagagtgacttgggagatggggtgctctgtcccatcgcagatggagaggatcaggctggggaggggccgacacttggcccaccgtcacactgaatggaggggccggcccctctgctggagaggaagtggctaggggcgggcgaccccactattctccttcaagcccctctctgcaaagaggcccaggggctagagaggagaccctgaaaaacacggcctctctgcattagggagaatagccctgcagtcgggctgtggctgggctggctcagggttaacaagattgagcaaactgctgggcactgctgttccctggcaccccgagtgggtgggcaagagttaactggtttgagtggtttcttctgccagaaacttgaaccctttccctggggcccgaggaagattctcacctccctgccaccccaacctcccagcttgggggtggtggaagggaatttcccccgccccccccgccaccagcctggacacaaccaccctccacccccgacctagaagggcccatcctgggcagcttgtctcgggtcctggcaacttttcagcgttctctggagcagagggtaactctgccctggcctggtgaccgggacagctgcaggggggaggggacaggaggctctttggggtggaggagggggaaagggatagtggcctgggtgtcccccagttggccacacccttcccacgctcacttctcagagagctgcagaatgtcaaccctgggcagaaataactgtgctttcagaccctggaggaatccagacaattatcaatgcagagaaggccttgagggaccatggcgcccacccccattttacagatgtggccactgaggtccagaaaagagaaggcactggttccaggccacacagctggggctagaatctgctcccgatctgcccagctctcctctggccatcagttcctgccctatcccctggaccttgggggggggtccccacactcacacaagccatgattgagtccaggaggatgttcccgggcaggcgcaccagctgtcagaagactccacccgagagagatgggcccccggacgctcccacccttttaactggaccggaccgggtgagccccgccccctgaaagttcagccaattgcaagtcaggatagggctgggggccactgggggcggagtccgtggaattttgaagccagttttggagcagaggtgaccaatcagagtggcgagctgctgccccccctcaccccgccgcccccggccagagtccaagctccacctcctattctccttcatccctctccacctccccaccaaaattgtgctgtggcagagattgggggaagccagtggaaaatagtttgatgatgagctaggcccacaagttggcgggaaggggcctgtggccagcaggctgggctcagggggtgcccagagaagatggctgaggaggtgcagggtccttcagggaatcagagctgggggagaccaggccactcccgggcagggaccagggcgtggctcctgctgcgtgcgcgtctgcagagggccactgacttaaccacaggccctggccccacccgggccttccccggaagcaaggactgcggctgctgcagcgctctctcgctggctcctcgggaaggctaaagaaaggctgggccgggcgccaagcctgaggctgcagggcttggctaaggcctcgggcttggccgcgttcaggggcaggcaggggatagtcaaagcgccctggcctgacagcctcaggcctgagagtgtcaagcttaggagatggcccagggtggtccagaccaggagggggtggggtcctggctctgtgcaccctgtcctttctcttttttatttttatttatttatatatttatttttgagatggagtctcgctctgtcgcccaggctggagtgcagtggcgtgatctcagctcactgcaacctctgcctcccaggttcaactgattctcctgcctcagcctcccgagtagctgggactacaggcccccaccaccacacccggctaatttatgtacttttagtagagacggggtttcaccacgttggccaggctggtctcaaactcctgacctcagttgatccacccgcctcagcctcccaaagtaatgggattacaggtgtgagccaccatgcctggccaccctgtctgctctcttaacatctcctctgaggcccggcacagccctcccttccctgagtgttcagcaggtattttactgagcacctactatgtacctggccctgggctctgaggattcaaagctgaacccctcccagtccccactctcaaggagcgcatagttggggtggaatctgaccacaaccacgttaagaagtagatgatgggctgggcgcagtggctcacgccggtaatcccagctctttaggaagccgaggcgggcggatcacctaaggttaggagttcgagactagcctgaccaacacggagaaaccccatctctactaaaaatacaaaattagctgggcatggtggcatatgcctgtaatccctgctactcctgaggctgaggcaggagaatcgcttgaacccaggaggcagaggttgcagtgatccgagatcagtctattgcactccagcctgggcaataagagtgaaactcagtctcaattaaaaaaaataaaaaataaaaataaaaataaaaagaagtagatgatgatggctgtaagggaagccatgagaaagtgctatggtgggctggcggctgcatgagtaaaggaggtgggtcgtgaagggtaggcggagaagtgcctggctttccaccatgggcagaagctccagaatgagaaggccagggctggagaacagtgttccgggcatgtgggggaaaaacggggatgaggctgggaagccaacaggacctggaccatggagggcctcatgggctgggcacagggcttggacattgttgtatgggaggaggctggggagccagggctagagggagggtgagtactgaggccagatttgggctctagggaagatcactgtggcagagaattgagggtgggtgggaggggtgctcaccttacactcaggaacctggtggaggaaggggcgtggggagcactgggcaaaatgaggggcatgctggggggttgtcacggggacctccttctccacctggccgtcccccttctgaaactgctggcaccaaagagggacgaagatgcggaccaggagtgactcacatctggaagccaggccaacacacccaccctgcctctcaggggcaccttcctccagatgcccaaagcccactctggtacaggatgagaggggagtgtgtagggccgcaaggcggacccagagaggggatggggttgcacccctgtgagt

SEQ ID NO: 4414 - DNA, 2715 bp, Homo sapiens
atcgaggtatacctacataaagtgtactgatattctgtgtatagcccagtggatttgtacatatgtatgcacttgtgtagccaccacccagatgaagatactgagcaggtccagtaccccagagctaccttcatttctatcactttcccaagctgtcatccccgccggctgtcatgggaaccctgtctgtaagatgcgacagtttgggtaaaggagtttggtcattttaaagagtgtgaaaggcagagaacagagaaatcaaaaccttgcagggccaaggtgggtggagagggtgtttttcttttaacatacatgggcggttttaaggagaaattgaagcagcctgttcagacaattgttttggtatctggccccaggtctgtggttcctaacatgacttgtgatattattttaagtgggcagatggctttttgatagcttctttatctttcgatctcagctcttgcaaaggggaggttggtgctcattgcaagatcagcgataagggtttctttgtaggtcggtggctttcttggtgagtacatttcaacatattattgttttagaacctgtgtgctgccagtgacttgcagcactgttgaagactagccaccctttgtgacctagccctcttgggaaatggcggaggatctcagggtatatcccttacctgtgggagccctatcagagggcttcctgttgaggaaatgttggctgtaggccctctgtgcactgagcacagccacatcaggtgagggcatgggagaagtccgtggtagccatcaggatagagttcagaaacccaaatggctgctttccctgggttgctggaccaggcatttggtaactctaaagcttagagatgattcatcgacaagcatttattgactgcctactgtgtgctgggcacagtgctaggttccagcagggaaagagatgcagagtggtcctaagatgtcacagggcttgtgggatggagtacagaggatttgttgtatgagacctggctgagcccctgctcttcgccaggcacttcactgagtactatattttcatgcaaggtctggtttaattccgacaacattccctgtgaagtagagggttttaaatttctctttcctggatgagcaaactgaggctcccagagtccaaagtcctagggctggtgtggggaaaagccctcctgatcttccttggcacttgacactaccctttggaagtgtcctattcttcttaaaagtaaagaccaagagagcctcaccatggtcttcaagcaccctcccatcccattccccaatctggcctccactggctcatagtcttaacaccagtggtctttctgagctcctgtcaccatggtctttctgttactccaaagggcctcgctcctttctgctgcagggcctttgcccctgctgtttccttcaccaggaacatttatcccgtaccccttgcagtctcctccagtgttgatccctcagttctaagaggacttccccaggggagcctgtccaccccagtgtcctcgggcccctggctttttcatagcactcatcagcccagcacgtgctaagctttgttagagaatgtcccatggcagagcagatgaacatcgccaccagtcgaggggtcatcggccaccctgcctagcagttctactatatttttttgatccactcgtttctcctctgaagtgactctttcaaatgttctttaccttcagactttctctcctgcttcaaaaaacaaaacagaagccataagaatggaactccctataacttgtggcccccaagtctgcacgctgatttccctcccctgtgttacagatgacgaggagtcccttcttgctcaggccacttctccctcctgtgctctgggtcccagtttctgctacttgctctagaatctgacatcatcagtcaccttttctctcctggcaggttttctgctgccctccttgcttgatcctctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaactctctggcccttctctttctcctggctcttcccttagcttcatgtatccaaactcggcatctccacttgactgatggcccaaataattcctcaaactcaccttgtcggggactgcattcatcacctctcccacagtgttcccaagcagcctctcactcccctacctccccacttgctcgttttgcttttcagcatccttaagtaagccctgcctgaccctgtagattgggccagggacccttattctagggcattctttccttttctaaaggcactgatcgcagtttgtagttatatctttattagggggttgctggatgactctctgccccgctagactgtaagctccgtgaggggtagggacatggtctgctttcattcaccactgtattcctgcaggcctgccacagtgcctggcacttagcaggtgctcaataaatgtttgttgaaataa

SEQ ID NO: 4415 - DNA, 4820 bp, Homo sapiens
ctccagaacaaaactcgtacattgctggtcccaaaagggaggtggccaagtggggcagggctgtggtggaagccctgagtcccctttctgaccttgcaaggccttgattttcctttctgtcatttccccctgacggtgtcacttctctgcctttccttcccgccgtgcaagtgtgtcggccccgtgaccccagagtcgtgtgtcccctagacttcctaggacgtatctattgtacacacctataaatacctgtgttttatgttgatagagatatatactgtaaatagcatatatacttgagcaatatatatgttaatatatactgtgtgcgcagtccgtggacacagccccccgctgtgtgtgcacacgtgtatgggcgtgatggcctccaccccgcaccgtctgccatacacgcgggcacatttgagccaccatatatttttaattcaagtatataggcaatacgattattacagaagccgatgggttccctcagacctgacttgagagaacaaagccagcagctcaaagagcctgtgacatgggacgtgggaagggtgctgagagcccgctgtggcgtgggtcatgccttctgcaccccactttccccaggcaagatccctgggcgcccttatttggggggatgttgatcccgagggaggagtatttggaatttcttgcttttaaccagaatgccccctctcccctgccctcgccagcagcctcaccctgaagacctgggcctgctgaatgggccacacgctgcctgtgtcctgcctccgtgggtggcactttttacgcaggcagcttctctgttttttttgttttttgtaacctgcaagcttagaaatctcaggttgtgctcctggggctgctcctggggactggcctcgtgtcatggagaaaagcatgtgtgtcggggcgcgctggggccagggtatggctctccgccctggctggctctgcaggggtggtccctgttcaagcccgctccgtgggagctgccccctggggaccctgctcctcggtcacagggggcccctttagttttcccatccccatcctgctcgtgtaaagcttggtttatcttctcggcgttctgtgtgtagcgtagtcttggtttggtctccacagctcttcggggtggggtgtgagtgtggtttttcccaggcaggggccgtctgcccttgtcccccagctatctcctggtctgctgggtgggagggtctctccaggccccagaccccacttggaggggcatgtgtttctcagaggggctccatccgcagttgcatggaactccttacctgtttgccgtccatcccccggaggtaatcagaggagtgggcctgttgtcttggcgctggcggatggggcaggtgcctggcgggggaggaagagggctctctatgatgtggaatttttttttttttttttttgagacggagtcttgctctgtcgcccaggctggagtgctgtggcatgatctcagctcactgcagcaacctccacttcctgggttcaagcgagtctcctacattggcctcccaagtaggtgagattacaggcactcaccaccacacgcggctaatttttgtatttttggtagagacggggtttcaccatgttggccacgctggtcttgaactcctgacctcaagtgatccacccaccttggcctcccgaagtgctgggattacaggcatgagccaccgtgcccggcctcatggaatttctaggggtgagcaggtgaccctggggctgccacttgagctcctggagtgtgtgtcttggcccctgtgtggttctccattaagaaaagctcagatagtctcaaccccaccctctccccttgctgcactcagagtaccagtgggagctgaaggatggggaggaacagagcagtgaccacccctccctgccactgataagttctgcctcgtcgtggggctcccctggttcccaagacaccccttcctccctcagcccgtcgtcctaacccagcaaagatctgggcattgctgactctgcacctccttcctccatgggcatctccaggaccgccctccttcaaggggcactgcccacaccactgtcctcagcccgaggcatgcatctgagctggagaggcttgcaggcctgaccctggtagcttcccctccccaagattcagaggcggggacccaaagcctcactccaaaccactggcattctcacctcctctcacctccaggcaccaggctgctggtgggaaaggaaggagctgggggatcagaggcttccagtgtggcctccggaagcagcagcgtagccagggtgacatttgttcagcaggaggaggcttggtctggaggggcttgcccctctgaggtgacagaggatgccctggaggtcaggagagaagactgggaagacaggaagggccaggcccctgttaaagcccagggcactatttggtgatcttcaaaggtgaacacaggccacctcccactggccccctcctcctggccacattttccagggataccctggggagtcctaaggccaccctgggcccctttctgagcctagagatctggatgtggtgacaaccagggcttttcccagccccagctaagagagggggctttagggcaagagcacctcagccctgcaatggggggatctttttttttttttttttttgagacaggctggagtgcagtggtgcgatctcggttcgctgcaacctctgcttcccaggttcaagtgattctcctgcctcagcctcccaagtagctgggattacaggcacccaccaccacgctcggctaatttttgtatttttagtagagacagggtttcactatgttggccaggctgttcttgaactcctgacctcaggtgatccgcccaccttggcctcccaaagtgctgggattacaggcatgagataccccgcctggccaatgggatttttgacgccacttcctgagtgaagcgctttgcatggggatgggaagaagcacccccaaccttctagtccgctccgagcagggcctggagcattggagacattggttagtgtaataggcagagcctgagtgaggccggggggcttctccaacagagaaaagacattggctttgggtaccatgctgagggagggggttaggcctggtgggggcccattcaaaggaggccgggctcggtggcttaggcctgtcatcccagcactttgggagaccaaggtgggaggatagcttgaggccaagatagcaagaccaacctggtcaacatagcaagaccctgcctctacaagaaaataacgaaagaggccccagggaaggaagccagccaggagcagcctggagcagaggcaggagcctgaggcctgagccatggcatccagggacagcctggtggccgagagagcttgtggctgtcactataagggaagaggagctatggaaattggaagtgcagggtggcctgtgtgctaggagtgggggtgcaggcctaggtgtgtttatgcacacgtttgtgcatgtacctgtgagcgtggatgtgttcctatgcattagagtgtgtgcgtgcacgtgtgcagagcccacacctgagatatgggactggctcttggagtattttgagttctcagtagcagtcttgttgtcaggccttgagtgcagaaatgattaggtgagtgagggcaggactcgaatgcagaccctggctccaggggagagggtggggcgtctctggtaggacggcctcaccccacttgtcagaactactctggaggggggcaaaggtgtcaggaacagtttgagcagttctggctcagggtcattcatgaggttgctgttgtctgaaatcttagctaaggattggaggatgcacttctaagtgaggcctggctgtaggcaggaggcctcagtccttccccaggtgggccaacccacagggctgcttgagtgtcttcacaatatggcgctcggcttccccccagagcaagagattcaagggcccagggtaaaagccaacgtgttatttttatccctagcctcagaattcacacgccgttgcctccaccatgctctggtttgatacagcccagctctgattggaaggggctggggctgcccgtgctgactcttcaaaggcatcccatcctgcagatggtgttcacagggagagtttgtgggggccggcactccctcatctactggggctcattctggaagaaggtccagaagaattggagacccctgcccctcacccaaactttggaggtggcagggtgaacagcaggccaagttcaggtcccaagacaggccaaggccagtgcggtttcccttccactgcctcagtttacctgtattcagaagacagtctaggaagagttgagcagagttccctctaaaagagtagggagctgataacagtcccaagccctcctctttctctatgccaaaatcatttccgttatcctgagatgggggtgagtggatggatggtgtactgaggggcctctgccctgcccagagcccccaccatcgtagtgggggcaggggacttcctgcccacaaccccctccaaccctcacctggcgtgcccgggtcaccagcagcagcagcggcgttccatcgctcccaagatctgggtgaaggggagaacctgccatcttatccctacccccccggggccctcaagcttattttcttgttgaagaaacacaaaaccctcgagattcatgtactgtatgttggagaaaaaaaattacctaatgttcccccaaaaaagacagtatattttgtactttgtaaagtgttaattaaaat

SEQ ID NO: 4416 - DNA, 1344 bp, Homo sapiens
gtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaa

SEQ ID NO: 4417 - DNA, 7296 bp, Homo sapiens
agttccgtgcggggccagctggcggcggcgcttccgggcccccgtggccgccacggcctggccggcctgggatgacaatacttgaggaatcctcgctggtgctgccctcctgccctctgcttggaacccctcccctaagtgtcagtgagtggacgtatatatttggatcaatcgagttgcaccctttgcctcccagatcagttcctccggcctccctggctgagcagaaggacagctctggacacttgtgtcagcacccagcccacgtgtccctgccacagcttcatataaggtatgccggctcagccgggcctggtggctcacgcctgtaatcctacaactttgggaggctgaggcaggcagatcaccttgaggtcaggagttcgagaccagcctgaccaacatggagaaaccccgtctctactaaaaatacaaaattagccgagtgtggtggcacatgcctgtaatcgcagctactcaggaggctgaggcaggagaatcgctttaacccaggaggcagaggttgcagtaagccgagatcgcgccattgcactccagcctgggcaataagagcgaaagtctatctcaaaaaaaaaaaaaaaaaaacaccatatgccagctccgtctggctttgcagtctcatacccagttacgtagcccatcagctgaaagcccaatgtacaccacaccctgaatcagatgttctccaacaccatcagtgttcctcaggaccaccctgcaggatacatttatttgtaaccattcttttcttttgcttttagagatcttgctgttgcccaggctggagtgcaatggctattcacaggtgtgatcatagctcactgcagcctcgaactcctggtttcaagcgatcttcctgcctcagcttcctacttgggactacagatttatttcatctttttttttttttttgagatgtatctcgctctgtcttgctcaggctggagtgcagtggtgccatcttggctcactgcagcctccgcctcccaggttccagtgattctcctgtctcggcctccagagtagctaggaccacaaggcatgtgccaccacacctgactaattttgtatttttagtagatatggggtttcaccatgttggccaggctggtcttgaactcctgacctcatgtgatccaccctccttggcctcccaaagtgctgggctcacaggcgtgaaccatggcgcccggcctatttcacctttagagataaagtcttgcccaggctggtctcaaactcctgggctcaagcgatcctcccaccttagcctcctgagtaggtggaactataagcgtgagccaatgcacccagatgtccccattctttggatgaggaaactgagggtcaggaggctccccagacaacttggctggagctagtagagctgagatttgaaccctagtatgctgatccttaagcctcctctgattccatgccctttctctctgcagctatgaaactgagggtgatggtgaagctaaaatgggtcagggatgagtggggtgccatgagtaggggggtgtcagggccaagcagggagtcaggttgggcagggcctggggtgaagctccctttcatgttgtcatccttttactgaggccagagctgcagctggaccccagtatttttaccacaggcatttttacccccactctgggtcacctcgtccttccaggtttggctaacaggtggttcagtgagagggttcagggcgccctcttgtggcccctggtgtatcaaagtctggcgccccagcttgtggggctgagttaagacagaactgggtaccggctgggctctggactacaaaattcaggctgggaccctatcccctatccatgtttccttggctctgtctctgtttctgtctttgtccataccagtctcagcctagtagtctcttttcctcccttgatctctctcatctgtacctccccaggggtacagatggcaggctgatgagctgaagatgcaaagaagggtggcatcctaaaaagaactctaggttcaaaggatgctgacacttgcaagctgagggaggacagaggctgggaaggagggtgtagccagggtgacctgcaggactgtccttgctcccagctcctgggtggcatgtggggcctgctgaccaggcaggagcagggggaggacaggaccccatttccacaggaatgtttcaggttctggttcttagtcccaggaagggaactggattccaggagagaggacaggaggatgaggtccacagaagggcacaggaaccatgctttgatgctgagacaacctgtcaaggctcctgtaaaggcccagcccctaatttcctgcctctgtagccaccttgtacctccaccacctccctcccctcatgctcagagcagaatgtaggccagggcaccttacagcatccagagtacttttattgccagaatccagatacagcctgctcagagccccatgtggggccactcaggaacaaggggagacagatgccaggcatgtatgcaacagagaaaatccagctgcacagaaaccctgtgggagagcagctcagtccagcgtgaaggcgtctttgggaaccccacctagaggctgtacccttttctcggcctgtggccagtcacccacttagagcctactgccatgaaggcagccctgactctccatgcctgctgccacagggagatccatggagcaccctggggcagacagaaagcccctaggggggcctcaggggacccctggctctctcagggtcccattcaagtttctgggctagtcccagcactaagctgggtgctggccagggtggataggagccccatcctcagccctgtgctgacccacttggtactagtgagaccctagggcagggtggcagtgtgatggtggggttagcaagaggtgcagctcagggaagctgcgagcagccttggctgcttccttggattccctttctccataggttcccagaaggccatggctccaacccctgctctcatccttggaaccacagtcccagggtgaagggaggcagcttcagtcctggggccaatagcacatccgaggaaatcagggcccctggaacacagcctgcgggactgggggcacatctgctgcccaatccagagcttgaatgctcctggtggtaagggaggtaggagtggagtgagatgtcccagggcctgggaaccacgaagaacgcaacaaactgcccctgcctgcaggagctactaggctcgcccaggaagccagtcaggctggccaccagctaagccacagggaagccagcagctctagctacccatgaccagtggcaggcctatctgtggctggtgtgtgggaagggtcacccgaggggccaggagccgatccctgggacctctgggtacaggaccacagcccagtaacatccctcataggaaggctgcggggccagggcccagtaggcaagtatgaaaagcccacaggaataggggggacacatggccccaggcagggactgggaccagggcccagccagtccaccctgtggagccagtcctaaggtcacagcagttccaccatcagcagcattcttgccatccagtgtcccttgagtctagactctcatttcttccttcttcactgccacagagaaaggataacaaacagcacttccccatggcagatgcttcacagtccaagactcggggccttgaatggtgagtcacaaactttgcaaaacgcgtgggccatgacagccccagaggccaacagcaggtccacggccgagccacaggagtcctgtggcacaggagtcagggcccaaggagcacacgtttcagataggccagggtggtggcgttggccagcatctcgatgtgctcgctgcctggcagctcctgcagcaacacttggtgctcctggcggctctgccaggcctggcactgcagggcactcttcaagttcacagtaccatcgccgtcaccaaagcagattttagggtcacggtcagggaagctctcatagtagaaggagtctggtgtggggacgccagtaccatagaggcagtgcagctgcacgccaggtggcatcgtggcttccaccagcccttctgtgtcctgccgcatgagccagccatcttcaaagccgatgtcctggaagaacttgcggtagtcccgcagtgtgtagttgattgtgggtgtctgcacgaacaccttctcaggtgaccatgtgtagttgtagggcagcagccagctggtggagacagctgaccgctgctgctcccggatcttcaggggcccgatgactgggatccggttgttgtctcctgcagggagaaggctctggtcagtctgtgcttaggaatgccagctggttgggcagcatgttcaccaccaggcccctgccagaccccagccaggggcccagtccacagtcccgcatctctacccggttatcatcattgtaatcactgtgactcccatccctgccttggctctttttttttctttttgagacagggtctcactctgttgcccaggctggagtataatggcatgatcacggctcacagcagcctcaacctctcaggctcaaccaatcctcccgcctcagcctttggagtagctgggactacaggtatgcgccaccatgcctcatgcctggcaaatttttccttttttttttttttgaagtagggtctcattctgtcacccaggctggagtgcagtggtacagtcttggctcactacaacctccacctcctgggttcaagtgatcctcctatgtcagcctcctgcatagctggaactacaagcacgtcccaccacgcctgggctaaaaatgtttccactttttatacagatggggtcttgctatgttgcccagtttgcttgccttggcttttattgtttctctttatttttgctacatctgggaaccacacatccaagctatgttttgttttttttgctttcctcaccagggagtaaggcggcacatacccacagggtgatttatgatgcttccttgcctgtaaactctaccatcctccaagtgctgatcaggcctgtgggcactgacctagtctaaagtgagtcagcaggttggcaactcggagatgacatgttctgctttcccttttatgacactgaactgtgtaccagtttttcttttcctaagctcagaccagcgttcagccagccgtggcctcattccacccacttgcatgtgcgctgacctgggcagccaggcgtgctggagacagggcacgaggggaggctgcagatggaggcggagtccctatacacaggaatgtgaacaacacaaacacccggcagtcagggaggcctccaggaagtaaaagctgcaacttgggaacaggggcctctggcctgttcaggatccatggtcacccatcaccccaccctgtatctgaaagcagggaggcctctcagactgactgtagggcctcagctctgcctgctgtggcctggctgggggacccctgaggcaaggaaagcccctaggggtgcacggacttccacctccccgcaccacacacccagtcctggactgccaaggcaggacagaacagcttcccagcctttgaaacaaagctctaaggggactcacagagaaactctgaaaggggccggggctacctgtctaaactcagggtatgcccacatccgtccctccaggcccaggctagaccgaagtggtggctataatgagtcctcactaaatctgagtgtcttccagccaactcagagtcactgggcctgacccaatcacaatgccagtagaccaagcaggtcaagcagtggcaggcacttgagctcatgagatgcttggcacagccctggctcatagctcccaaagtgagggtccataagcctcccccaagtcctagcagagggaggaaagctcccttctagaggaagaagctctactctacagctgcagctggtgagctgcaacagtcatgaaaagacgggggaggagccataaaaggggtggctttcccaattgccaggcaagcaggcccagccagatctgcacctgcttcctccctgtgttgcctacagaggctccgtgctgcccacagatggaggcgcaactcataaataaaaaactgtagtctagaggccaggtgcagtggctcatccttgtaatcccagaactttgggaggtcaaggtgggcagatcatttgaggtcaggagttcaagaccagcctgaccaaaatggtgaaaccccatctctactaaaaatacaaaaaaatctggccgggtgcggtggttcatgcttgtaatcccagcactttgggaggctgaggcaggcagatcctcctgacttgaggtcaggagttagagactagcccggccaacatagtgaaacccagtctctactaaaaatacaaaaattagccgggtgtggtggtacgcgcctgtagtcccagttacccgggaggctgaggcaggagaatcacttgaacctggaaggtggaggttgcatgaaccaaaatcacgctactgcactccaacctggatggcagagtgagaaagaccctgcctccaaaaaaaaaaaaaaaatgctctagccttcctcctctgcggtgaaggtggggatgaagaagtaaggatggggtaagagggagggatggccaggcacagtggctcacacttgtaatcccagcactttgggaggccgaagcgagtggaacatctgaggtcaggagttcaagaccagcctggccaacatgatgaaacctcatctctactaaaacacaaaacttagccaggcatggtggcgggcacctgtaatcccagctactcaggaggctgaggcagaatcgcttgaacccgggaggcagaggttgcagtgagacaagattgcaccactgcattccagtctgggtgacagaaccagactctgtctcaaaaaataaaaattaaaaaaaaaacagggctgacccaagagaatagtcattgtggagaccaaagcaactccattttggatactaatccaccatgttggcttctgattaaccccagatccaggaaggccactgagatttccactttatctactgtttcttgtgcacgtacttaaccataaatcaaaacagcctctgtgttatcatccttcaatgttcaacacatcgcatcggagtcgccctttccctacagaatataagctctgggtctgggggctaatagtgtggggatccaccatcttgtcttgcccccacctgagacacagatgtggcttctattcgtatgtcccta

SEQ ID NO: 4418 - DNA, 517 bp, Homo sapiens
gaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctc

SEQ ID NO: 4419 - DNA, 456 bp, Homo sapiens
ccgcaggtaaaaattatacttttatttgagtcaccaggagaaagattcacttgtggttcaagtcaaatgttcagaatcataacaggccagaaaggtttgatcccgagcacaagcccacgagggaggggaccaaaacagaccaaaatgagacaacaaccccatataaaaagatgaactggcggcttcacacactcacacacatacacatacacacggatgaaatgtttggacagaggcccatgcccgttccatccagagagaaaaccaagaagtcgatcaagggggaagcctgccagaggagggagcccgcagaagtggcagaagaaggcttcagttggcaaaagaagctggaagaggggtaggaatcacaagctgtcgcaggttttaaaaaacagagacactgaagaatggacgggtcacgcccaggacggatgcgatgccgtggaatgtgctgaa

SEQ ID NO: 4420 - DNA, 11018 bp, Homo sapiens
gctatagggcggcggcggctctgccatcagcaccgcctcttcgtaacacggtggtttggacatgtccgattccgctgcggagtgggaggcggtcggaggaggtgaggccgccggttcccagcctctcgcagaggccccggccaggggccgcccgcgccccagccctagcccgaacccgagcccgccgccgcccgtgttctcccggaggctgcggatggaagccctgagggtaagcagcgagccctccaacgcccgcccacttccggcggcccggatcgccccctggcggaggtcggtactcaccttggcgcgggtagctccagggccgtggcggcaccgacaggtgcgtaggcggcgggtgcgggagcgcgtggtggtgcgggtgtgggtgcgcgtgcgcgtgcggctgcgcgggcccgtggtgcagcagcgggtgcacgtgcacgtgcggatgcgagtgcgcgtgagccggcgcctccaggcggctacggtgccgccagcgtcactcggggacccgcggccgggggctgcccgtggcaggtctcaagtcgtgcgcgcgccggcgggggacagcagcggcgcccgctccttcccatggcgccggcgggcgcgcgggcgtgcctcacccggggccgcgcgggacctgtagggcagacacggggcgcagtgaaggcgcgccgcggcccccaacgacttcccggcccccgcccgcgccctgcgcagtccggggaaagcctcctccgtgggaacctcgcgctccccgggggcccggtgacgtcaccgaggagggtgacgtcacgcctcgaggtttccccggtagggtttccccgatctgagccccggccgccgccgcggagcccgggcgccgaggggagccgaggcgggccagcagggggcgcgcgaaggacggactccagctctgagtccgaacgagagattcgccatccgcagtcccggggccaaagggtttcaggagcctgtgcgcaccaggtccctgaagaggcgtctcggcgccgttgctgtgcggcggggaaagggtggtacatctcctagagccccacagacagccacccgacgccctgtacagacgcctggcagcccctggctgcccaaagcccggaacaactggctccgcaccgcgccctccgggtctcccgccgctcccgtaggggggctcaggcgggtggctccgactggtaatgcgtgccaccggccctgcctttgtctgagcctagcgcgccgcgccgggcgtgggccacactctcttcctttcctccaggcgccctgcctgctccaactccgcttccccgcctcctgcccttgcacagccccacttggctctgcctctgtcttcaggccgccgtctccctttccctctcgcggaggggaggaaaactagatgagggttggaagctagtctttcgtacccacctggtcctgcactcactccagatgggcatctctagttccgcttcctcctctccacagctgcgggtgagagggggaaccttgcaccctaagagggaggtaggagggagccctgactctgagagtgaagggtggcaggtgactgctcaccgcccccacagaacagaactgagcctttcctgaatgccttatacacacaggtttgaacgaaagcctttggggtaactggaatgattcctattttacagacgaggagttgggggaacaactggctgtgtagatggcaggtggtagcaccataatttgaacccaggcctggccacaaaactctagcctgagtggggtggggggtagcgctgcctgggctactttgtgggcctcttccaggagccccacggaccctaccctccgcgtgcccgaggcacacacacactgcttcgagagccacagggagcctgagccccaggctggggggaagccaggccatggccaccccacacttctccccagatggctcctgtctgactccatggctgccttcagccacgtgccacttggtgcccttgccagtccccttctcctgggcctgcgttccagaacagacaatggcaggaaccatagctctgcccgccccctcgacaaccctgccatgaggctgccatggtgacgcagcccagataaaaacacgatgctgccagtcactgggagttaattacatctgttattcttttcctgagccatcaggaatgctctgaggaaactggcactaactagaggtcccccggtctgccaggcaggaacagctctgggtcagaaaaggtaactctggggctggaggtgatggggtttagctgaattagaaatatctttcaaggaccacgcagaatcctctcttcaacaccaccttgtctgtggtggttgtgcccatttgatagacagggagataggctcagagaggggaatgacttgccccaggtcacacagctcagaaggggaggagctaggatttagcctgagtctgaatccaaactctgtgccagatgtaagtggcagccatgggggcactgggcagacaagccagctagcagccaaaatgcattcccatcccttcccaccagggccctggcatgcctgatcaccagcccgactctgctgtggaatagcagtgtgagaaagagctacaggatgaaggggagatgtaatggcagcgccaggttagcaagagacaaaagagagggccctctgtgccctgagggcgcccagctcagcaggtggggcattaggccatacagggcaggccacgcccaggacctgctgggtgccgtcatagctgcattttataaactaggcaactttgggccaaagagaggaaggctcttgcttaaggtcacataactagccccctggccccaacctggctccacccccaggtggagtgggtagggatttgacactgaacgctgtcttctcggcagtgccacagcaggcccacgggactggaatcctgtctgaagcctccctcccaggtgctcagtagactctcatctaaccgaccataggtgctcaatacataaacatcagaggttcattcagacctttcaaaatgctctacctgaccaggccagacttggcaaagcctcccgaaaaaaccatgcccccttactgctcctttactatgtgagctcttgcccttgtctgggagcctttcagactcagagcctgcctgcagcctgctgctcccagccactccctccactgcccacactgctccagactggtagtagccaatacgtgcctcctcctacctacccaacacattcaggtgctcggagcgatgccctgcagatggaccgaagtctgccatttgattactcacgttctgtttcctgtttctcttttcttactttcttgaaggttatttgaacatgttttagggttgcatcttgatttatctgtagtgcttttgaaccatatcgctctgcatgttttctcgggccacacactcactgggagcacggcagggggatgaaagcgagacccttggtgagtttcttaacctccaagttgcctctgtttcctcatcggtgaagatgaagctaatcatgcaaagggtgtggaggtaccaacagacattagctctgatgatggtggtttctgagctgaggatgcagacatgtgtgtgtccccagggtgctccctgcctgagggtgggctccacactcactcttcgaagcaggctacagggtgctccctgcctgagggctgggcaccacagtcactctccgaagcaggctacagggtgctccctgcctgagggctgggcaccacagtcactctccgaagcaggctacagggtgctccctgcctgagggtgggctccacactcactctccgaagcaggctacagggtgctccctgcctgagggtgggctccacactcactctccgaagcaggctacagggtgctccctgcctgagggtgggctccacactcactctccgaagcaggctacagggtgctccctgcctgagggtgggttccacactcactctccgaagcaggctacagggtgctccctgcctgagggtgggctccacactcactctccgaagcaggctacagggtgctccctgcctgagggtgggctccacactcactctccgaagcaggctacagggtgctccctgcctgagggtgggctccacactcactctccgaagcaggctggcattcttgttagttggcagatgagaacacttggctcaaggagcttaaatgacacccaagggcacacagagccagggcctggctgcattgctgtgggcacctcccacactgccctgtgcacacttcagccttacaggccaaagcaccaaagatctgctactgggtcctttatctcagcaaagagcctaccattccttccgtccgccgcatcctctgcagggtggcatttgtccacttcctttggtcctcctgccactgccttggccaggccagcatcgtctctcccctggcccccatcaccatgcttgccactgtgctgtgcccctgcccagcctagtcactcctcacaacactacgctgcctcaggagccaatctagcatttaacatggcttagatctgggcctctcaaatttaagcaggcaacagaaccacgtggaggctgttaaaacagtgctgggctccattcccagtactggattcagtaggtctaggatggggcccgagtttgcattttaaacaaatttccagcagatgctggtactgcagggccagggagcacactttgagaaccactgacctaggtgctggcctcccgaatgagctcctgccaaggcctctggggctcacctgagccacctcacccctcagggatgggaagcccaatgatgccaggatgttccggggtggccagggccgagcaccatcggccttaccagctggcacccagtaattggctcaagaaccacctatggaaggagatgctggagggctcgttacctggttggtcttttagctgtgggaccgggggagtacctcaagggctggctctgtgtccaattcattcctgggaaatgtcagccattcaccaaaacgtcactcagagaagagccatcacccagcccccgcctggcagggcagttcataagcaagtggagaccccatgtgtctacgtgaatcaaaggaaaaggctgtacggaggcacacaccagggctctggggggtggggatggaaaatcccgggcagcaggggcactgggtcacacctggacttgaggctagagctgctggtcttcaagggaagggacaggaactcagagcagggggtgagggctggggggcaggacagactgacagcctgtcctgtgtgccttgcatacgccaggcccactactggtctctatgctagttatctaaggaaaactcaggaggtggctgctgttctctctacagacaaggatgtaggctcaaggagtgggtccagctcaggtctccatagccaggtggtgtgaagcccgggtgatgacaaagtcctcggtcccggcagcaagggcatttcagggagccactggtgacacccttacacccttcccacatcaacacagaggaactgaggccagagaggacttgacaggacttgtctccactcccagtcagccaggcttggagctggccagaaccgccctccgcctaggccagggtactgagtggcaagcacccttgcttgcaggtagatgacctaaccctgacaccaagccaggaacccagggcttgggaaactacaaataagaccacagagactgaggcctcggtgggcttgtaggtggagagccctccctcaggccagtgtctactgcgctcagctccggccctcctcagggcagggttttcagagaccaggttcctcctctgaaacctcagcctgtggctctctgtgccttcatccccgcagctggcatggaaataatgatctgacctcccaggggaggcggccccacgggcgtgatggtgacaccctgtggggggcagcctgggtaacatgcagagtgccgaggggtaggcctgagctcaaatctggcttctgccctcaccgagccatgtgatcccatcctggctactcccatacctgagctggagtttcttcagcagtaggaccagggtgccgaggggacaacagaactccctctgatgagggatcaccctgcagcctcaagaggctcaaatgcagaaagcagcccctggtgtcacagtgtacacagcctggaggcggcccagcaaaacctgcggtccctttcccacggaccagaggtctcagacacaggacccttaggttggacacagttctcagacatgttttaaaaacaatccatgttcacaatccatttttaaaaacattctgattaattgccaacatttaaaaatccaggagattttatataaaggtctggatttctggttcatcttgaaaattggacagtcaggtcataccaagtccacatttcacacagtgacaaagattggagctgagcggctccctggcccgcctcactcattccatttcccccctgatccttggaagcatgtgggtttccaatgcctggagctagactgagcacccacaggctgcagcagtgcatggacccatctttgctaaattttctctcccacagccaagactgcaagctgagcaggccatggagcccatgagccgaggaccagggcttggggttttcccaggggactgaggcagccctttgctgcttggtctcaccggagaaaatggagggagggaggaagtgaagaagggagggagaaagctggccccatcctataatgcatctgggggagcaagaatgtggctgatttagctggaagaaggaaaaatgtaccaagacccgaaagacagggaatgtcctcactggaggaaagtgaaggaagaaggctctacagttcttctcctgggttacaagagaagttagctagcaggcagagaggagctttgcccccagagaagcctgcagtgtagactcagctctgccacttactggtagtgtgaccttgggcaagtcactcacctccctgagcctccctttagagtcttcatctctaaaatggggataataaacttaccttgcgcaactgttgtaaaaaaaaattaggagataatggatgcagagcactcaacacaggtctcacagagcaggaagggaatgaaaggcacccgtgagtaattccccaggcgcccctgcctgcaggagactcaggcctgacctccagggcaccacccatctaagggcatcttatgccaaggcctccaatgccccagatgccagtcacctctaggatgcctccccggatgggaaaggaaacccaaggacggttgtggtcgctgggatcctggatctgaagcccgcggtcggggctggcatctgctgagtcaggcctgggagagctggcaggagggccatttctctctccagcatgatgcccgctgaggggaggttgggaggggagccagaggtcatttcctctgagtcagaggccattctcctcccagaggagctcccctggcggaccaggcacctccatgtggcgcgtgcctccctgccggccaacctgcatgctactcagtacagttggggcattgtgctcagacaagaaaggggcacttgtgatccagacaatgggctgggtcgctcccatttggcctgggcttcagcttccctgggtcagcaatatcctttcctctgctcctgcccactctgcttccacccctccctggagaatggtggctaggaacacggagcagagactcaccgcgggcccatgcccggtttggcacgtgcctcggccgtgaggaggaggagggatgcaagcttcgctcctctaccctggtgcccagcaggcgtacaccaccacatgcctactaggaagccacggggaggaggacctagtgccgaacccacagccctggcctccgtggacatgcctcccccctaccccagcagggaacagatgacccctagagagcgccccactgtctaccccgaggtccaagcttgcagaggccactctgaagttggctgtccatcggcctcttaactgggctgtttttcgtccaacttctctactgcacttaagatgatttgccaaaaacccctccaccaccatattagctggaacatttggggttgaagtgacagaactcccaaacaaataggtttgagctgtaccccgtctctaccaaaaaaaaaaaaaaatctgcacgcctgtggagaatcgcttgaatccgggaggcagaggttgcagtgagccgagatcacgccaccgcactccagcctaagggagggggtgagaccctgtctcaaaaaaaaaaagagaaagaagaaagagaaaggacagaaagaaagaaaaataaaagagaaagaaagaagaaaggaaagaaagaaaagaaagaaaaagagaaagaaaagaaaaagctttgagctcaaaggggactggttcatgcaactggcaagtcccagggtagattctagctttggtcacagttgcttccaggtgttcccgcaatggtgtcaggcacgtatctgcttctgtttgcatcactctcaggcaagctcaccccaagaagtagcgaggacaaccccaacagccctaggctcatatcctgccatctatccctggaggaaaacggaaccccaattccttccccatcatttgagcaaaatacaagcaaacaactccatgaatgattctttttggactcatttgggctgagtctctatcagtgaaccaatctaagtgcctgtgtgttaagggagaggatatgtgctccttatgcaaagggaatggcctcccagtacccgctcccttttctttgtatacaggcaccctgatttcaatgggggaatcactgccccacgggtgccatcctggtgaaactgtgaacccaagtgccctgctccctgacagtgcacagcaggcaggtatccagcctggccactcagactccttgagtttgcaactgggctcaaagaggcaaaaccaaatggctctatcatcttggttctggtgggtgtctcctgatgagaatggagcccacaactaagaccccgaagctcctccatatccttggaacaccttctaagttagcgggaggacagttctgtcacttgcaacattcccacctggctctctcactctaggtatgtgtgtggagtatgcgtgtgcagggggtgcaagcccagccccgtctaaaccacatggacagagactgggggtgcttttgtacatgctggagcaaacaccccaacacaaccagtaaaaacccttcagggaatcccctaccttccagatgaggccccatctgggccttaaccctgtgatccttaatctagctttcaaagctggctgtgtctcactgacttcagctccagccattccttgcttccacccctggcctcccatgctcagccatcctaaaccactaaagccctagaccatccatctggctcctctacttgggtacatctgaccctgtgtcctggagggcaccaattctgacaccttcagggtcaaggggcctccctgtttggtgctgccccacccccaaccctgtcagctctagaatcctctcttccacagtgctgatcacactgggtcccgctgttcccacgtctgcctccctaccagactgagctccaagctgccaggggcctcgtctccatctgggtcccagttcccaccatagagctgggcatggaggacagctcagggaagcttcttgggaaatgaattctgggagttccctctgccaaggacccactgtgttaagagctttaaggtgagtttaaccctagccaagaagttccctggatgcctccctagcccaagggggagctggccagggtgtcctgatccaggtgcaggcagagtgcctcagggtcctgcacatccacctggcacgcgctctcttgcatacctgcccagggctgggctttggtatgacatgctaacacctacctaaaaatcccccactcccacctcataacagcctggggcagaggggcaaacccaccccaggctcctttctcatgatacatgggtaggatccagctttcccatcattacctggtttcctccccaccctgcaatggccacttaaccagttggaagaccttgagcaggtccccactccccttacttcccttaggttggtgggaagcagcaggcactccacatgtcatgagtggggccacaaaaggccccttctgccaggctgctggcttggcaccttctggctgtgcttaagccaggtggttagtttggtactcagcaccactccccagcaggtgggagtcctgcggtggcttgggaactcaaggggctggctggctgctttggtggattctcacagctgcccagaaaggtgatgggtcttacacctacctttccatatcagggaagcgcctgtgcagggccaacttgaaaagtggccaggctggggcttgaacctggaactgtcagctacaaagctcacatggctcctgcagcactgggtgcccagtccagaggccaggaacaagcttgatggggcttacggggcattctcagggagctggggacactgggagtctatagagcagtgatggggttgccagatctgggacagactggtaggcaacaagctctcagccccagagcccaggcaggaagctccccttgagtgcctcccagtcccccttcctcccaggtgaatgtccacttcgaggccggctcaaccaccgtcttcagagaactctcccacactggccacagcctatctgccagcgtcacccactgtctaggtctttgcccataatgtgtcaagggcaaaacagaggggtggatatgatgcacgtgcctcagcccggggcccgtacatggctggcgtccagctgggccaggggagcaggaagacccctggagcaccggaagcaagaaagaggcaggcaggggcggctagccaggtttgtgctcggactattcacacagagacatgtggcagcttacgttggacaaaacgagtaataaaaattggcttta

SEQ ID NO: 4421 - DNA, 2363 bp, Homo sapiens
gattgtgtgagctttgttggagcctgcgtacgtggatttatcgctgccacggtctgcgtagctccagaggtttaaccataggatagagaaaccagacccttcttcagcatcttccctgggcattgctgtgagtttaggccggcccgttttgagcaggagcagcagcggaacagtagacctgctggaggaagtggggctgcagatcagagacacagcattttcgtcaaccaaacttcttgaagccatatctacagtatcagctcaagtggaagagcttgccgtcaaatgtacggaaaatgcacgtttccttaaaacatgacgggacctcttgaaagaatgctgtgattcttggaaacctgacaattgatttggcatacttagctctttgatagtgactgtgtaataattcatacttcctcatatatgatcatttcacatgtgccacatatataggataatatctagcagttctctatatcttcagaatgaagtttttcttggttttcttgacctttgtaaaagcagaatactgattctatttttgatgttgatcagtacttgtttattcttacactttctgcccttcaaactttcataaaatcctttacaaaatttaattttatcagtagatagttaatattaattgtgccacagtgctaccagtagcaaactaagtggaccattatttgttttgcagtaagatgccaagcatggcagaattagaagttgagcttcatcttatggaccaagggagataactttaaggttccagctccattaggctgagttctctaggcaaatgattgtcttacttacttcgatatccccagcacctaaaacagtgtcacatagcattcactaaatgtttattgaaaagaagagttgattaacataatacaaagctattttttcttcctgtatttagcaggaagactataattgtttctctaaaaatgtatgaatcaggactttgttgacttgaaggaaaatgttatctttttcacagagattttaactttgatgatagcttttaaaaacatgataaatacttttgtcctcaaatgattattttaaaaagtcttttttttttgagacagagtctcattctgtctcccaggctggagtgcagtggtgcgatcttggctcactgcaatctctgcctcctgggttcaagtgattctcctgcctcagcctccctagtagctgggattacaggcgtgtgccaccatacccggctaattttttgtatttttagtagagacaaggtttcaccatattgaccaggctggtctcgaactcctgacctcaagtgatccacccgcctcggcctcccaaagtgctgggattacaggcgtgagccactgcacccagctaagaagtctttatttcagaaaatgaaagactgtctagaaagaacgaattttttttcctatttatttctatggttactgcttttacacttaatattttttgttttcggtatttttatatgtttgattgctgtctttaaagtgccttatcagatttatggctctgtactatgaattttggagctttacaagttatttacataactctaagttactttgcttccaatacatcaaatttaaataacatgattgtttttatattatttgaccttagtgacaatgtcctattttatttgttctgtatcttatgtcgctttttggtagtttgtattatgtgtgaatgattaagccaactaattctgtaccatatataacttctggatatctttgatatgacatcttaattctttgtagatatggtgatgtgtacagaatgatattctgaagctccacaatggtgcattgaaaggctgcagatggatggccaaagaatagttttgtttagcatattaggtctagttctggacttttttttttatactttaagttctggggtacatgtgcagaacatgcagttttgttacataggtatacacgtgccatggtggtttgctgcacccatcaacccatcacctacattaggtatttctcctaatgttatccctcgcctaatccccaccccccgacaggccccagtgtgtgatgcttccctccttatgtctgtgtgttctcattgttcaaatcccacttacgagtgagaacatgcagtgtttggttttctgttcatgtgatagtttgctgagaattattgtttccagcttcatccatgtccctgcaaaggacatgaactcatccttttttatggctgcggagtattccatggtgtatatgtgccacattttctttatccagtctgttattgatggacatttaggttggttccaagtctttgctattgtgaatagtgcctcaataaacatacatgtgcatgtg

SEQ ID NO: 4422 - DNA, 6088 bp, Homo sapiens
gcggggtggtagcacaggaggggttcgcaggctctgcggccgtgcgtggcggggcgtgggggcccgcagggcggaagtagctcggagagacgggctggggcagggcgtgcgttcgtgcggtcaaaatccactggtggcgtttggggtgttcccgtggacgcggcctcccggcaggcggacctccaccgggtgggcgcggcaggcgggctgtgcgggcaggaagagcgacgagcttgagagtgggagatggggtgcaacggcgggcctctccggggaggtgacactgccgctgagacccgaatggaagggcgcgcccggcgggggaacagcaggcgccgaggttcgctggaagcagggaagggaggcccgggtaccggctcgcaggcccgcgcgagcttcgcggcagcggcacggagcgtgtgaacggcgcagcgccgaggcttcatccatcggccggtgcagggtccgggcagggagcactgtcgaccagggtccgaccctgggagagtccagaggtggcgcctctggcagggacagaggagggggtgacgctgtaggggtgcaggcaggaggctccgcgtcaactccccacactgacggggcggatttttttttttttttgacagagtctcgcactgttgcccaggctggagtgcagcggcgcgatctcggctcactgcaacctccgcctcccgggttcaagcgattctcctgcctcagcctcccgagtagctgggattacaggcgcacactaccacacccggctaattttttttgtatttttctggtagagacagggtttcactatgttggccagactggtcgagaactcctgacctcgtgatccgctcctaggttcgccttggcctcccaaagtgctcgctcctgggcgtcccaaagtgctgggattacaggcgtgagccaccgcccccggccgagggcgggttttgttctctgctgtgcctgtcaggcagtcgttgccctgtggttatttgtggagggattgacggtgcgctgagcttcagactttgtctgaacagcttcgtggcagcaaggaagggagaagggaacagatccaagccgatctttgggaggagagaaccagcatgacttggagactttagatgtcagagcaaaggacagggtgcagcttggtgacccggagtgggtgggtgggtgaatggatggatagatagtggggatgtggtctgccatcactgccctcttccctgtgtgggaagccagctcttggtgacttcctgccgagacccactccctctggccctgtccgagggtgtcaagtgtgcccttgacccttcaccctgggctaagggatgtccaaggagttggggacaaaggcagctaggaggaggagctacctcccgagtctgctgcagtaagtcaccagtgtgttcctgtgggtggaggctggcaggcccatcagtctggtttgggtacccgttggatttgggtttgatgacatgtaaagtgagttagagtctctgcattactgtcacacctgctgtgcccaggcatggaagattaagtggaacagaggggccgcccccctgctgaaggggccccagagtcggcgctaggggagggggcagcctcggtggtccaggcaggcataggcggaattctctgaggtggcattggagtccagtggtcagaggtgctaaaaggccccaaacctagagcccatgcccagggccccactgacacctggtgggcaggggcagcctggtgaccccacatgacatgggtgggcgtgacgcagcaccagctgggccgacagccctccccctgctggtttttaatgctctgcagtaatgtcatttggcctgcgaataagctttcacacattttatattaaatctacaagtatgatttattcaggcacttacgaatttaatcaaatttgtttctaaatattactgatttttgttatcaaatgtgccatcagctgttgagctttgagaattgagcatcctggcttttgccattttgaggatcagcagaagcatgtctggaagaaatgtgagaaaataaaactcaggagcctacccccaccctgcccttccaggagctcagccccagagccaggctgctaaggccatggaggctgagggcagtggagctggggtttctggagcctcaggggccctggtttgctggaagggcaggcagggcttcatggagggcattaggcagtggccagagccctgcagtgctgggcatgggcttctcgtgggctctggccacggccctgagctcctccccttaccttcccagagcggagggtcacctgctgagctgggcacgggcttctcgtgggctctggccacggccctgagctcctccccttgccttcccagagcggagggtcacctgctgacagtttggggcggctctgtctttgagagcatgccctcatgaaggcagaatgtcctccctgcctccatcctctgtggcccggtggctcctgcagtgcctgccctcagaggctggtggcctgggacacagggatgaggatgggcttggtggtgctgcaggtcacagtgggtcatgaaggagctttgggggtgttgcattctctggtaaagcacagcaagggagcccttttacccactactaaaacctggctctgcactgaggccatgcgcagcccagtcaggtggacgagggggtaacgactggaccgtggggaggcatcagaggaggagctgctgagaggcgggtcaccacagcctggtgcctgtctggagagggtggggctgggggaggtgctggccaggtccatgggggtggccaggctgggtctgaaagggccttgcgctggtgtggggtgagcttggtctgttgggagagtatgcagttcattggggcctccctggctccaggtttgcatgtctgaggagtgggtatcatcagggcctggggcctctccagtgggcatgtctgaactctcccagggttgggagcctgtgctcatcacaagctcaaagcactccatttctgctaccatgaagtcaaggatggtgactgtgagccgcctgggacctgagctgcctgggactgtgactgaggcacccggggtgcctcttagggccttgggtttgggcccatggctagatgagccttggtgattctgtggtattgcctgggccaggtggacccaggggcagctgcggctagtccatttggagctccttcaagccgaagcatccaacaccagtgtctgtgaggtgtgggcccggccccaggagcggggcctgggcagccccgtgtgttgaggaaggaaggcagggcccccgctccccgggcctgaccccactgcttcagccccctcctgcctgcctacagcctggcctcgagggcccatcaggtgaggggaccccacctgcaccaccccgtcctacctcctggaggaggccttgcccctgacaggcagcctccagccctcccaccctgatccctgtgtgggatggccagagcatgcccagcatgctggggttcggcggtggggggcatctggagggagggacatgtcagttcggggagggatgagcagcctaagtgactgcagtgctgggccatctcctgcatggtggagctcccctcgagccgcctgtctgcagggggctctggccagtagtgcagccgggcagggtctgtacggcacaggctgcaccagcctccatgcagaccagtctgtgtgggagtgggggtctcagagggcccagccggcctatgccatgagcatggtgctggcccagagggggagctgaacagcagctgggtcggtgcgttacctggtggggcagcagacagcagctgccctggctggggttcaagccccgggctggcctggtggaatcccctctccgtcacccccaggttctgttcttgcaggtgtcaggcctggggccttgagacagacctgcagtctccaccacagccacagtgggtggggtctgggtcctcacggaggtgatcctccacccccacacctaccttgtgcatggcagtggtgtctcctggagctggtgagaccccacctcactcaggaaaccccccagacgcccccaggcagaagtggccatactccagggcctgcatccctgtgccccacagtgcgccctggccggttggttgtaggaactcagaaaagcaaagcaaacaggatggttccctgctggacacattacattccctgctggacacatttctattgcagatctttagtccaggattccagggtagccaaggtcacctgagtcctggggactctgggcctggtctctgaaagcagccagtaagacagagatgggaaacccagcaagatggagtgagccaagggcacagttgggtccaggcgcagcagggagctgcctgggggtgacacacacttgacggaggccactgcacacaccctaccccggcctgaacttgagcacttcctttttttttttttttttagatggagtctcactgtagtccagatggagtgcaatggcgtgatctcggctcactgcaagctccgcctccccggttcacgccattctcttgcctcagcctcctgagtagctgggactacaggtgcccgccaccacacccggctaatttttttgtatttttagtagagacggggtttcaccgtgttagccaggatggtcttgatttttcgacttcatgatccgcctgcctcggcctcccaaagtgctgggattacaggcgtgagccaccatgcccggccaagcacttccttgaacacagaggtgaccatgaggagggaggcgtgaaccaggatgacggggcagcagatggagcctgcctccctgagacctcaggtgaccgagtgctggactgcctcctcctgcctacatggctgagaaataaacttctttttcaaaccactgtgacctggggttttctgataccctcagcaagcctgttcctgtggcctggtgtgggtcccctgacctgtggcctgggctgcctgtatccggcctgcccctctgctccgctgtaaacctgtgatggcagtggaggggcttggcctgggcccgccccaccgcgaggtcttcccctctccgagttctgggtgtggtttcagttgagccacgccgttggactgggccggcctggaggacagaaggcacaggctcttccacatacctggctcgtggcccatgggccgtctgctcacgggagccctgcaccaggccatgcagagcagtgaagtcaaaacctcgtttcccaggtctaaggtgaactgggagcagggcaggagttggctctgtcagatgccacagttgtttggggacagtgtccgtagagaatgtgtggcccccctccgtggtctagggtggagcgtggataggccggtcactcctatccctgggcccaaggctcttttcccctgccctcccgtgggctgggaactgccacagctcagacaaaaatcggccagggcagggtcctgaggcttcagtcccaggctccttagggcacccctggtgacccagctccagcactgagtttccagaggccttgaggatttccctgggatgccagatgggcccttcctgctgctcctggggtcatctaagctccaggcttgggtgcagccctgggcccctgccacagacgccctgaatgcacctgcccctcccggtccccacgcagcagcctcctgagctgcggatcattttcctaagaaggcattctacttgtgccagtccttacttaaagacccctgctggtgctggcagcgtgctaccgggaaggatggtatctcctgtgcgtgtcctgtgtacgctggcctcacacgtgtgtgcctcatgcgggctgtgccctcagtcctatacgctctccccaaccctcttttagggtgtcacaggagaaaaatgacacattcctaaatctctaacacatgggcttgaaaacaagtctgaggatgccctgcagaagggccatgggcatggacatggagctgggtggcctcgtgcactgacctttccctcttcctagccccaggcccgacctagaggccacagcccctgcggacaggctgtggggccag

SEQ ID NO: 4423 - DNA, 4660 bp, Homo sapiens
cttcttcctcttcccagcgccagcctcgccgccgcggcggggggcgggcgagaacgcgattggctgaggcgcgcgcgcgcaccggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcacgtaattgctgttagccacctatccccaccccctttttttaactgtggaatctgagtcaggtacagtggcttacgcctgtaatccctgtgctttggaagactgaggcaggtggattgcctgagtttgagaccagcgtgggcaacatggcgaaacactgtctccactaaaaaatacaaaaattagctggggttggcctgcccctgtagtctcagctactcaggaggctgagataggaggaatgcttgagcctggggaggtagggaagtcaaggctgcagtaagccatggttgtgccactgcactccagcctgggtgacagagcaagaccctgtctcagaaaaaaagtatggaatctggacagatagatataatctctgaagagcagattgcacattccttacacttaataccttatcctgtttaatcttacaataaccttgtgaagtagatggtattatcctgtttttgcagctaaataggccgagacctaaacaaagaggatgattcctccaaagttgcctggctagcaaggggtggaacatttattagtagctctctctgcttgtttcttctcttctgtccttgagggctgtgagaggaagaaaactcttctacgcatctccatgctgtgtcaaagtcaagctctagcacagcctgccaggctatttggggaggcctcaacttctatataaatggcccttgttcttcccaagaggagaatagagaaaggctgttttccctgtggtggattaatggtatgagaatgcagggacaccaagaatgcatttccta

SEQ ID NO: 4424 - DNA, 506 bp, Homo sapiens
tgccacaaaagacctttaatggcctcctatttattgttcttttgttcatttgttagagttgaatgaactataataacttgtctgacataataagaatgccacaggtataacagataaacctggcaggtggtccaggaatgagagtgtcacaaaataatcactcaacacaagggccacagacctggagattcttcccagccatccctcactcctgccccaggacacaacccatgcaggcagggttttgtgccaagggctggtccagttctcactaaagtgtccaggattcctgggggaatcctgccctcaaaggagggacttttgtcataaaatcctccctgagtctgtcttttatgtgagccaagatttccatccatccggcgctgtgtaaagatgaatttaaccctagcctctctcctatcacactgcttctcctgctgtgtcccttgggcctaggccaggaaagtggggtgccagataggggtgcagacacaagtcctcagtgg

SEQ ID NO: 4425 - DNA, 10094 bp, Homo sapiens
gtgctccctcccctcgctgctcaccttggttcccaagagccgggcggccgcagtaagtaaagccatggcgggcgatctccgggatctggtggggaggtaagaaagggagagagctgcggcaggaacaggagccgccgccgctgcaccagaggccgcgccgacgggttgacaaggttgaaaggaggcggctgaaggaaagagtagacgaaccggcggcggcgcccagcccggggtcctcaaggaggccccgcccactggccggaacccgagcccgcccctctcaagggactctccccgggcccggccattggtccggtatggaagcggggcgggaccttagcccttgacagcagttgtgacggggaggattggaccgcccggattagggctaattaagggtggatgggtggcgggcggggaagtgcgggtggctaaataggtgcctgataactcagttaacttccctcttggcttttccctttgaccttaacacttttggggttatctctgaggcgaatgctaaaggagacgctccaggactcgacctctgaaggtccttggagccaattccgtaatatgatcatggaaactgatcattgcctgatccttctaccgccttggcgcgctttcttgaggaatgtctttggttaatggcttcacggccatggaggtgacatcatgtggacaacaggctaggatgccagagttagctgctcggtggagatcatttgaggtcagcagaggccacgatattatagatactaacagaccccgatatggggagaaaagcaaaagcaggagcctgaatatccagtgctttgtgagctgtcagttctgtgtgtaatggcaggaaatccaagtcttaactgcgcccttactatgaaggctttccgagccagccacagcttctgggtcatgggcattagtctcactgccactctggtcacgtaaccccacacagcagctcaccccactttagccacagattaggagccgcagactagcccctcatcgaagatcccctttggtcacattctctagggcctctgggccacttctcctacttggcagtcttctatgctctcttatcttgtgctccccagagaccatgacacgaccctgaagtgatattccgcaccactttctaaatcctctgggtagacgaggcttcaggacttttgtgcctccctaagcctgtcgtagtcattgaccccaaggacaagagcatcttatctacaaacctccagccccaagtgaaaagccttttttttttttggagacagatcttgctctgtagctgaggctggattgcagtggtgcgatctcagcctcctgagtagctgggattataggcgcccgccaccacgcccagctaatttttgtattcttagtagagatggggttttgccatgttggtcagactggtctcgaaatcctgacctcaggtgatccacccgcctcgggctcccaaagtactgggattacaggcgtgagccaccgtgcccagctgtgaatagcccttttatctcaccacatagcagtaacaaggatcacaggtctcagtatccacctaagccaggtttagatagatctcctttacaaagaaccgagtttctagcttggacttggaaaaagagatagaaaacccctattttctcttcttaattttctttatactcagcttcacacctaacaaccaatgctcttctggcctggggatcagatagttaggtctcaggaaaaaactttaggcaatgctccagaggagcactgacctcagctacctttgaagaccccggtgacttcaaagcttcactgatcaatatttgctccccatttagcatctcataaaggatttccacataaccctagaatagtctgacctggttccttttctctggttaattatccacagagactaaccagcagaccacaggactgaacttcagtgccccaggatgagactaccaaagggacaattattgagaggccacaggatcatctgtcttggagctttagtgattgggtggggaacagcaatgctctaagcctctcgacactgggtcccagagcccctagtgccatggggactttatggacttgttttgaagttgtccaatcctgacatcgactgctataagggcaattggaaagcacaggatcaaagcggctaactggcatctcccaggagctggcctagattccttctcaacactgatgggacctggggaggttggagagaatgttaaggaagaaagattggcatgaataaagcagccaagtgagctctaggtccaggtataactaagtgcttgggaacttgaaggggcaagggagagaaggctgagaatttaggttgttgtgaccttgggaggacctctttaaagtgtagggaggcaatagcaccccctagtggcaaaggacaagtgggctaataaaatctaaatttaaacccttaaactacaaggtaaaccaaacgcctctatttaatagataatagctaaaacttaaactggaggatcccttactatttgcagatactatctaaatgtggaacatgcattatctttttttttttttttttttttttggagatagagtcttgttctgttgcccagcctggagtgcagtggtatgatctcggctcactgcaacctccacctcctaggtggcacacgccgccacgcctggctaatttttttttttttttctattttagtagagatggggtttcaccatgttgcccaggctggtctccaaagtgctaggattacaggcatgagccactgtgcctggcctggaatgtgcattatcttaatctttgcaacaactctaagtttcaaggtattaaaaaataaaaagaagagaaaaccaagacttagatgaagtatcctacccagtgtcatagcttgtaattggcatggctataaattcagaccaaggtcagcattactaggctgtatttctttttctttttttttttttgagatggagtctcactgtgtagcccaggctggagcgcagtggcacaatctcagctcactgcaacctctgcctccctggttcaagcgattcttctgcctccgcctcccaagtagctgggattacgggcgcatgccaccacactcagctaatttttgtatttttagtagagacaaggtttcactatgttggccaggttggccactgcgcctggccctaagctgtatgtcttacatgatgattatgattttttttttttttttgagagaaggtcttgctctgtaacccaggctggaacgcagtggcatgatcgttgctcactgctgcccaacttcctggcctcaagcgatcctcccacctcactctcccaagtagctgggactacaggtactcaccaccacacctggctaatttttccttttttttttttttagagacagggtcttgccatgttgcccaggctggtcttgaacttctgggctcaagtgatcctccttccttggtctcccaaagtgttgggattacaagcatgagccaccacatctggcaattgtgaactatcagctgcaactcagtaaggggatttttgagtcactgtcaactgtctcctggagacatcaactcactgtgttgctataaagatatttcggccgggcatggtggctcacgcctataatcccagcactttgggaggccgaggcgggtggatcacaaggtcaggagattgagaccatcctggttaacacggtgaaaccctgtctctactaaaaatacaaaaagttagccgggtgtggtggcgggcgcctgtagtcccagctactcgggaggctgagacaggagaatggcgcaaacccaggaggcggagcttgcagggagccaagattgtgccactgcactccagcctgggcaacagagcgagactccgtctcaaaaataaataaataaataaaaagatatttaagccaagcaaggtggaatgtgcctgtagtttcagttgctagggaggctgaggcaggaggattgcttgagcccaggagtttgaggctatagtgcctaatgatcatgcctgtgaacagccactgtactccagattgggcaacatagtgagaccttttctctaaaaaaaacataaaaataaaagataaggaactatagtcttactcatctgtaaagactttcacatccatatgtgaactagataataaatggtgactcccagaatacataaaggtaggagagacaaacattcagcatttgaaatgaccagaaagggggctgggtgtggtttctcatgcctataatccaggcgtggtagtctcagcactttggaaggccaaggcaggaggatcacctgagaccaggaattcaagtccaccctgggcaacatgatgaaattccacctctacaaaaaatgtaaaaattagccagtccaggtggtgtgcgcctatagtcccagctactggggcggctgaggttggaggatcagttgagctgaggaggttgaggctacagtgagccatgatcataccactgcactccatgtactccattccagcctgggcgactgagcaagcttgtctcaaatactacagcccaggcattgtggctcactcctgtaatcccagaattttgggaggccaagacaggcagattacttgaggtcaggagtttgagaccagcctggccaacatgttgaaaccccgtctctactaaaaatacaaaaattaggctgggcgcagtggctcatgcctgtaatcccagcactttgggagactgaggcgggcagatcacctgaggttgggagtttgagaccagcctgaccaacatggagaaaccctgtctttactaaaaatacagaattagccgggcatggtggtgcacgtctgtaatcccagctacttgggaggctcaggtaggagaatcacatgagcaggggaagcagaggttgcagtgagccgagattgcatcactgcgctccagcctgggcaagagcgagactctgtctcaaacaacaacaacagcaaaaacaaacaaaaaatgaccagaaaggtaaaaggggtgtcttataaggaatagtcaggaaaaatggctgaacagaggatataatgcttttccactacagattactagaatcagagggcatacattcaaacttggagacagtttttcaagccatatttaaaaagtgctactttatacagccacttggagactccactacatagaatgaggtataacagaaagatgactggactagggattagaggatgactggactacggattagaggatcactggggttgaagtcttggctcctcgctgactagcaagacacttaatctctctgagcttagtttcttcatctataaaataggaataacatctatttcttagagttgcaaagattaaatgaggccaggcaaggtggctcacatttgtaatcctggcactttgggaggccaagaggatcactggagcccaggagtttgagaccagcctgggcaaaacagcaagatcccatctctacgaaacattttttaagttagttgggcctggtgatgcgcgtctgtagtcccagctactcaggaggctgaggtgggagcattgctggagcctgggaggtggaggttgcagtgagccataatctcaccactgtactccagcctggacaacacagcaaaaccctgtctcaaaaaaaaaaaaaaaaaaaagaaaaaaaagattaaatgagtgtgtatgtgcttgttatacaagtattcagcatatattatttcccttccccatgctatttattcctatttatttatgacagggtctggctctgtcacccaggctggagtgcagtggcaagatctcagctcacggcaacctcctgggcccaagccaccctcccacctcagcctcctgggtggctgggactacaggtgtgccctgcctggttaatttttgtattttttgtagagatggggtttctccatgttgcccagactggtcttgaatttctgaactcaagtgatccgctgcctcagcccccaaaactgctgggattacaggcgtgaaccactgcacctggcccctgtcctatatttaaaggaatattgtacctatgaatgctttttaagttaaaaaatcctataaaagttttttttttttttttttcggccaggcagtggctcatgcctgtaatcccagcacttcgggaggccaaagtgggtggatcatttcagatcaggagttcaagaccagtctggccaacatggtgaaaccccacctctattaaaaatacaaaaattagccgggcatggtggcaggcacctgtagtcccagctacttgggaggctgaggcaggagaatcacttgaacctgggaggtggaggttgcagtgagtcgagatcatgccacttcactttttttttttttttttttgagacagggtcttgctctgttgcccaggctggagtgcagtggcgagatcatgactcactgcaatctcgatctccctggctcaagcagtcctcccaccttagcctactgagtagctaggactacagatgcctgccactatacccagctaatttttttgcatagacagggtcctgctatgttgtccagggtggtctcaaactcctgggctcaaaagatcctcctgcctcagcctcccaaagtgttgggattataggtgtgagccactgcatctggactaaacctttttttgagtcgcactttattgcccaggctgaagtgcagtggcgcaatcttcactgtaacctctgcctccctagtagctgggattataggcgcatgccactacacctggctaatttttgtatttttggtagagatgggtttttggcatgttgcccaggcttggtctcgaactcctggcctcaattgatctgtccacctcggcatccccaagtgctgggattacaggcatgatccactgggcccagccctaaaacgtatttctaaaggactaaattttcacataataaactttcctgttatatctgtacctcatttaacactgtcttcggaaatgtttgttaagttctaacattttactgataaactaagttagaaggcatctgaagcttgatcagatttacaaggttaagagcatatgctctaccaaatactgggctataatttattataatgaacctccagagggttcagataaattcatgcattccttgtgatatgaattaaaacatgtgcaaagccaggcatggtggtgcttgcctgtaatcctagaaactcaggaggccaaggcaggaggattgcttgaagccaggagttagaggctgcaatgagttatgatcatgccatttcactccagcctgggcaacagagcaagacccctgtctcgctaagatagtaataataataatgataataataaaaaaaataagaggtttacaaagtgtatcttcctgctgggcacggtggctcacgcctgtaatcccaacactttgggaggctgaggcaggcgggttacttgaagccaggagtttgagaccagcctggccaacatggtgaaacactgtctctacaaaaaactcaaaaattagctgggcatgatggcacatgcttgtaatcccagctacttgggaggctgagtcaggaaaatcacttgaaccaggaggtggaggttgcagtaagccgagattgcaccactgcacttcagcctgggcgacagagcgagactctccctcaggaaaaaaaaaacaaaaaacaaaaaaaccccacaaagtgtatccttaatcaagcctagaaggtaacatccaccctttcctatataggacatatcctttgtgtaccaatgacaaagtctctccagctggagagttcttaacagctgtactttgacaaaccagaaaggtgcatcacaagtaacttgttactgattaacattaaatttatttatttaaaactatgaataatttgttttctaaattaaaacagttttaagtttccagaagagaactctctttattgtatttgagacagggtctcactctgttgcctaggctagagtgcagtagtgcaatcacagctcagtgcagcctcagcctcctgggttcgagagatcttgccaccttggcctccagagtcgctggaaccacaggtgcacaccattatgccggctaatttttgtattttttgtagcaatggggtctcactatattgcctaggctggtctcaaactcctggactcgagtgatcatgatccttccaccttggcctcccaaagtgttgggattatgggcacgagccaccgcatttggcttgaagagtactctcatttatacttctgataagctttctgatggaaaagaaaggcatttttaggcacgaagcacgaaatggacagcaccttgggtatactttcagggacatgaaaaaatgtaattattacttatatgcatcatagaagaaaaaataagctttataatagttggtttggaaaactagagcgaacacagcatttcttatggatgatgggagaagatggaattaacaccaggctgatattagttgacaacaaatatcagagtgcttgctctgtgctctagttaatttgtcagatttcacagggatttttggtacaagaaagctttgtggaatatatgcattctatgcgccaggcttagtgcaaggtattattagagaaaaaagacttaaaatagaaggtactctatagctatattagatcaggtcagcacttgggaaagttagcttatagacccagttttgccattaaatacagaacttcataaagttctatggcttctctgggcctcagcttcttcatcaataaaatgggcagaggtgaaccagacgacctctaaggttcctttagattctaaaatgatgtaatttttaaaacctttgaaatgtttattcaggtcttctctccttgaggtgttcttgggaccggagatattccatttgaaaccctgagacaaccatacctcaagctcagagtgcttaagaattttctgccaggtgcggtggctcacaccagtaatcccagcatttggggaggccaaggcgggcggatcacgaagtcaggagatcgagaccatcctggctaacatggtgaaaccccgtctctactaaaaatacaaaaaattagccgggcgtggtggcgggtgcctatagtcccagctacttgggaggctgaggcaggagaatggtgtgaacccgggaggcgaagcttgcagtaagccgagatcgcgccactgtactccagcctgggcgatagagcgagactctgtctcacaaaaaaaaaaaaaaaaaaattagccggtgtggtggcgggcgcctgtagtcccagctactcgggaggctgagtcaggataatggcgtgaacctgggaggcagagcttgtagtgagccgagatcgcgccactgtactccagcctaggcgacagagcgggactccatctcagaaaaaaaaagaaaaaaagaatttcccaaaagaaggtatcctttaggttttcatccctatgccccagtctggaatctctacacacagaattgtggacagacttatagtccagattgacaatggctagtgatagatacactttattgttgccactggcatcaaatttaaaagcttaggctggcaagcaaggcctctcattaaacaaccttccttacctcgtctgtccctatccgataaagcccttacttttcagctgagttggtcacatccattttccccttcctgtctctgttcttgctggtccctccatctggatgggcagggaaggaagaataatgcatatccgttatttccttcaagaccaagccctgtcttactttatgtttcaacagccatgaacacaagggatttctagaattctacactaccatacactatgttcccctgcttcctcatggaggttcctctattctccacaattagactctaaagacgtggtattgagtgggcactgactgaaagcttatctagtttatgagtggagtggaatctcagaaggtagaagaattaaaggttcaggcctctcctacctttatcctgtatcaatcccaaaactcttctttctcctccattatctttcctgtctatataactc

SEQ ID NO: 4426 - DNA, 2510 bp, Homo sapiens
cttccttgctgactaagaggaacagaacacagagcagcctggcggtgtcctaccaacaagcctccgtttctccttcctgtacactagggctcctgaaactcacctggtaagcgctccagaaaagcagcaggtggtgactttagggtaggacgggccaaatgggagaatccccttaggtcggtttctctggttctcaacttcttttgaaataacgctcgcagaggaggtgggctttctgagaactgagggaagtaagctctcaggacttccggtcgccatgatggctgtgggcagtcaatggggtcagtgcaagcatctgggccatctttaatgtgggcaggaaaaaaacacgattacacttacttctgcagagtttataatatccttgttcattatttaaaataaaatatctaagacataggtaatagtatattttaaataaaattgaagcaatatatgaaatttctctggaattcatccagccactctcagctgttaccactatccagaaacgtcttaatccgcctgcatgatttatgtatttggtttgtattttaaatatcattttctgtaatatttaaaagttgtatttgcttggtatcctgctatgcattctcatgcaatttgatttttaatcaatattacttttttttttttttgagatgaagtctccgtctgtcacccaggctggagtgtaatggagcaatctcggctcactgcaacctctgcctcccaggttcaagcgattctcttgcctcagcctcccgagtagctggaattataggtgcatgccaccacgctcggctaattttttgtatttttagtaaagacggagtttcaccatgttggtcaggatggtctccgtctcttgacctcgagatcagcccgcctcggcctcccaaagtgctgggattacaggcgtgagccactgtgcccggccttggtttctaaatactattttgaagtatctgtggagaaatggttacttcgagggctggggcaggaatatataagataacattggaacaaattctgacgccagaacatgaagaaatatttgaaaaaggatggggcatattgactgaacacagaagacaaacatgcatgacctcagcctaatcgtgagaaaacatcaaagaaatccaaattgataaacattctgtaaaataattggccatgctcagcaaaagtgtcacaatcacaaaagacaagggaagaataagaaacggtcacagcctggaggaatctaaggacataacaactgagtgcaatgtgagatcctcgattcgatcttggagaagaaagaggacgttaagagaaatattgacaaaattcaaataaggtctgcacattaggtaatggtaagatacgttgacatcaatttcctggttggatacttgtattacatatactattatgtatataattattatattacaattacatatacagttgtatattatatataatacaataaatgtatatatatgattataatacaataaatgtatatatacagttttatatataacaactattatacatataatacaattatatatatagctaacatcaggataggctggttgaggatttatatgaatctttgctaattttgcatgtttaaaattatttcaacataaaaaaattatatgggtcatgtagttttttgtgcagtttaattctaggcaccatagtttctgttttaatgggtgtattttcttctttcaaggaattgggatagtctgttgtattaaaaacctattcatttttgtacattaagattcttctggccaggcgcaatggctcaagcctataatcccagcacttgggaacctgaggcaggcagatcacctgaggtcaggagttcaagaccagcatgtccaacatggtgaaaccccatctctactaaaaatacaaaaaaaattagccaggcatggtggcacatgcctgtaatcccagctacttgggaggctgaggaggagactcactagaactcaggaagcagaggttgcagtgagccaagactgcgccactgcactctggcctaagcaacagagggagactccatctcaaaaaaaaaaaaagattatttctctaacttactggtttatcttttatagcttatttcaggtgatttgttgtgtttgtctatagagtaaaataacatgtctaatgagttataatttaatgtccttccattcaatcactgtatttcaaatttattccaatattttggaataagcttccaatattttaacttaaatagggaaggtcatacttggtattttcctgacctcagctggaatgccttcatagtgttcacatgaacacatttggcctgagagagacttattatgccgagaatgtgtgtaaccctttttacttaggaattgtgggtggagtttttccccccgcccaagaatgattgttaatttccgtccatcattttcctttgattgttcttcatctcgaaaacaaataataaaataataaaataaataaataaa

SEQ ID NO: 4427 - DNA, 5870 bp, Homo sapiens
acacggctgcggcccgctgcgctgcttccaaaacacacagccgggctcgcgggcgagccgaggcggggggcgcgggctgccagggccatcgatcagccggctccagcgggaagggcggccccgggcgcggcgggaagggctgggccccgcggccggcgcggcgcggcgcggcccctcctcggctgagcgcactcagctcactgcaagagaaaagccgagccgaggcggccgcggtgcaggagcgagtgggccgggcgggttcgggaggggaagagcggccgctggggcgcgccgagcctccctggccccgagtcgccggggtcaggggacaccctgtaggcgcgctctttctttgtgccctggggcgacgggtccccctggccggcggcccaggcggcgccccccacctcgtgggacttttctttgaaggcccggagacccctggggcaaaactcccacgggccaggcctgccgctggagctaaaaagcggcatttgcgcagttgggcttgcctggaaacttggcaaactttggtcggatcctcccctgcagagcgagggcctggcctggcgaccccctcatttcaagtcgcttctagggacctagcgccctaagctcagtggccttcagggtgctgcgagcgagcggggcggcacaaaagcgcgttcggtccaagccaggccccttcgaggactttgtgtagattggtacctaagtttaatgccttttgagtttctttttaaacagtattaatgtaataattaatgtaataaaaagaacaaaggacgaattcgttcgattgttttaagttctgtgtaatgtttaaaaccgcccctgcttcagtgtatggcttattattgcttcaagatgttttaaaggccctttaagttgacccatctcgctttgatgcttcatccagacatcgtgctgcttaaaacggagtgataatagtatatttcgagccgcttcatgtagctacacagtattgtaaaattagtactcggtaacctcaagtagtgaaatcgcatattttaaataacgcaagtccaggaaaggccacgtggaggatacccagaaccgacgccggctcatgggacgtcgtgctgtcccataagcttcatctttaaaatgtaaagggtgtgagttttttttttcttcataatgaataaaagacattccagaaaaaaaaagagttggattcgtgtcaattactaattgccatttattgatcactgacatcattaaatggctgattggctgccttaaggtttgcattagcggaacaccgtgctaggaatggctggtgaaactggctcatagtaggtgctcaaaaaagtacgtttttttctccagggacacagtgacgagaacttgaagcacataaaccatgttttttaccttgttcatgtgggtgtggacgcaaaggggaagagcgaaataggcctgtcggagaaaagtgtgacccaagataagaagggagtggttttgatatggaaggggcaggcggcaaaggagaagaaaagccattttaaacagttaattagtgaacactgtgttcggtgccctgtgggaagctgctcaaatgcaacttgtcggaaatgaatctatctagtgctgggtagctcagtgaaggacaccatcattcttcaaagtgcccaacagggtggggcgcggtcgctcacgcctgtaatcccagcactttgggaggccgagttgggtggatcacttgaggccaggagttcgagaccagtctggccaagttggcgaaacatcgtctctacggaaattacaaaaattaggcatggcggcgcacgcctgtaatcctagctatgtagggaggctgagacagggtgattgcttgaattcaagaggtggaggttgtagtgagctgagatcatgtcaccactgaacagagtgagactctgtcaaaaaaaaaaaaaaaaccaaaacaaaacaaaaaaaaaacaaaaccccaacagaagcacctaagcctttcttctcgctagcagggcatagcccatgtttcactgagtcctggacctccttggtcactacccactctctggccactatgctggcccagcctgttgccaccatgtcttgttggtcatcctgtcatcctgtttgtagtatgggctgaagcatgaaaaaggcattggagcacgggagtaagagtgccctttccaaaatgcaagcctgatcgtgtcagtcccttcaatggcttcccataggatgaagtcctaagctttccacccctgctggcctggcctctgcctgtcattacagacacttcttcctcttctctcttcctactcttttccagcaacgctgaacttctttccgttcctttcttccaactctctcttcccacctctggccctttgcacatgctcatttttctaggtagaaaagccttgtcttctcaacctgacctctactcccatttccctaaattctatacatcgtttcagtcttgacttaaatgacattttctccaaatatgtattctctcactgcacctttggacaagttgaggtgctctggtaacatctagtggggcgtgatgggagatgtttgggtcatgggagtggatcctcctatttcccctcttgtaacactttccgttcttgtagttggctatttaatgatctctctgtggcactagactggaaactctatgagggcagggaccttgtcttttcagcaaaaatgtattcccagggcccagatgttcaatgaatatttgtcaaaggaataaatgtggtttatgagttgcgaggagggaggagtcattctgagctgaagaggtgagtgggggctatagggaggcaagtggcagtgaactatacctccatcagtccaggggctttgaaatggtgaagaggagggaagagggagttaccccccctgagtgcttttaagcaacagagtgagatagtaaaagcgatgcctgggtctttttaaaattcctaacactagcacagtgcctggaacatggtcaggtgttcagtaaatcctacatgacaatctcaagtgtgatctttgtggtagctgctttgcgctttttccttgctgacagcaggccagtctggtttaggtgtgggaagcctatcctcagtggaggatacccatgcctggtcccagcagaggaaccctggttactcccagccaatcccagtgtcttttgccagtgactggttggagggtaggtatgcaacctagttctagcaagtgggacatgaagggaagtgtgctggggtttttttcctgatacaaggaaatccccagacctgctttggaagctgttaggtgaggatgtgatgcttgaagctgtagtagccatcttgtattcgtgagagaaagccaacgtttccgtttccatgtggatagtttttttttttttcaagtcattctgttttcagctcaaatgttgcctcctcaggaatgacttccttgaccacacaatttaaaacataccccccttcctctttgctatggttcagatatttgtcctttccaaatctcgtgtcaaaatttgatcctcagcgttggagatggggcctgatgggaggtgttcgggtcatgggagtggatccttcatggatagatgaacactctccctgaggatggggaataagtgaacacttcctatgttagtttcggagaaagctgattcttgaaaagagcctgggctaggcctggtggctcacgcctgtaatctcagcactttgggaggccgaggtgggcagatcacctgaggttaggagtttgagaccagcctggccagcgtgatgaaaccccatctctactacaaatacaaaaaaagatagaagccaggtgtggtggtgggcgcctgtaatcccagctacttgggaggctgaggcagaagaatcgattgaacctgggaggcggaggttgcagtgagctgagactgcactgttgcacttctgcctgggcaacaagggcaaaactctgtctcaaaaaaaaaacaaccgagcctggcacttccctcctggctctcttgtttctctcttgccctgtgatctctgcacacactggctccccttcaccttctgccatgcaaggaaggagccttccaaccagcagaacagtgagccaaataaatgtgttttctttataagttacccagcctcaggtgtttcctttacagcaacacgaaatggactaatatgcccattcattgtttagtcattgtcctattttcttttctttttttgtatatcgttaactaaaaaccccctttctttttttgtttatttgctacctttttttcttattaggatgtgagctctgtgagagcagggacattgttttattcactttttctcaagcttctagaacagtgtctgacaaatagaagtagaaggtgttccataagtatttgttaattaatgtatgacagctaagctaccccaggacaataacaccatgttgaaatggattcaggggctagtggacacaagccactgcaaacctccactttctcttttgtgacttacatcacagtatatcccatctcaggcagtctcttcctgctacacaaatacattttcttgagatttcttatttcttttccaatctactttagagcttttctatttcttcccagggcatttctcctcctcgtgtgatgacagacaaagctaccaaggcagaaaagtgtcatgtgcttgtgaatttacgagcagcacagatacatttaccttaaaggaaaacaaagctatatgatttgaagtaaaattagaaatgctagtctaagaattatccatctctaaaacattacaaaaggtgtggagattctctgcatcatctctgcaagtttccacctttattatctatccatccatctaatttagaattgccaggaaataccgaggttgagttaggtgaccatgagttctggtgaagatcagactggatgtatgatccactcccacctccagaagctctcagcatttctagtgcaggtggacagttgtcttggattgtgtttggcaggacagtgcaatccaaggacagtggcacagtggaaatgttggttcttgggacctaactcagagaggtaaaacagaataaggctgtagagaaatagccaagggattggtgaactggacattccaaataggttgaagaatgggtgtcttgggaataatggagtgagtgacctggaaggttaggaggtgagttgtcagagaatggggacctacctgtaagtttagtatttagaggtgaagcagtcctaggggatggtgcggtccagggagtgcctgcggaagtgggagaactagaagggagtggagaagatccctgaagatgaagagatgagtgaaaagagtgactggggtgttaaacatggttccttgtggatcctgaaattactcagagctatgggcagagtaagacttaggccctcaagtcatgtcttaattccattaaaaaaaaaaaaaaatgtctgagaaacatggaagatagccaccaggagagaatggttagaagatatcctttttctatagttaaatctgctttccttgaatcatgattattcaaattaaaaataatcacttgggctgggtgtggtggctcacacctgtaatcccagcactttgagaggctgaggcagacagatcatctgaggtcaggagtttgagaccaacctggccaacatggtgaaaccctgtctctactaaaaatataagcattagccgggcgctgtggcatgcgcctgtaatcccagctactctggaggctgaggcagaagaattgcttgaacccgggaggcggagcttgcagtgagccgagattgcatcactgcactccagcaggggcgacagagcaagactccatctcaa

SEQ ID NO: 4428 - DNA, 9387 bp, Homo sapiens
agcggtcaccccaggagaacacgacaggcggggaggaggaagttgcctccgatcggacgaggcagggcacgggccggggtcactcctggtcgatttagagggacgtggaaagggactggaggcccccactggcgccttcccaaggacctgagtgcctcctcccccagctgccagaccagggcgctttatccagctggcgccctccctcgggccccctcactgggacagaagaaaattcaccacgaagtgagcagtctcggtgaatagcatggtgtccagccggtctggcccgacttcggcctctctttaatacctgcctgggcgaggagggggaggcctgaaaacccatattccccccgggcccggctgtttttagcagaaggccaggaggcgtcagctggcagaggggttgggggcagagctggtctctctcgtgaggtctagtctagtctgcccccactagccgcttcagtgggagggggctggtcaccagatctccaggttccccagagacactcctccccagggtcaaggacagaagtgcaaggacaaacagaggcagcaggagggggccagggacaggaaggtcagctgcccattggagaaacccttcctcatcccacccagggcttccagcccctgctcacacactttttttttgagacaggatctcactttgtcatccaggctggagtgcagtggggcgatcatagctcactgcagcctcgacctcctaggctctaacgatcctcctgcctcagccccccaagtaactgggactataggcactcaccaccagacctggctaattttttgtatttttttgtagatacagggtttcactatgtagccaaggctagtcttgaattcgtgagctcaagtgaatcaccggccttggcctctcaagtctaggattacaggtgagccaccatgcccaacctttttttattttcttttttcttttttttttgagacagggtctcaactctggcacccaggctggagtgcagtggcacaatcactgctcactgcatcctcgacctcctagggccctagcagtcctcctacattagctggaggattgctgggattgcagcagctggaaccacaggcctgcaccaccaagtacagctaatttttgtgtgtgtgtgtgtgtgtgtgtgtttgctttgttttgtagagacttttgccatgttgtctaggctggtctcaaactcctgggatcaagcaatctgcccccctcccagtcagcttcccaaaagtgctgggattacaggcatgagccaccactcctggctggcctcccacactcctgatggtgtgctcaggcacaaatcacgcctcaaagggcctcctcttctcccaggcttaggcacaccctgacctgctccccatggctttcatgggagccttttccctaattctatgcatgcttaaatggcagctcctcagccaactctagttcaggaggctgctggggctccaggactccctaaactgtcagcaaagtcctgacactttccttccccaaaactgaaaagcccttgatctgtttaaccctctctttttgcagaagaggaaactgaggttcacaatcgggcagtgaaaagccaaaagtaaaacctaggctttctacaactctgcctgctcctacaaaaggtgagacaacccttctgtgtgtccttgtccagctcagcatggggttcagggctcagagcccaggctgggccctgctcctccctgacccctggggatcctaaggaacatgctggcccagctccccttcccacactgccagtttgggctatttcccccccagtgactcacactggctgccggagagagtgggcagctgttctgagcccccagagcccagtacaggccctgacttgccccccaagttctgcagccatatttgggaatttaatgtttttcctccttggggactctccttcccttaatcccttccttttttccctgtcttcaaccatttttccttatcttcagcctcaccctccctgatggcttcttccataggcagacaaacaggctctagtctttcatatctttgaaaaaaagaaagccctccctcaactccacatccttcgccagctcccctctgcagccagcattcttgaaggagttgtatacacacgttgtttctacttcctcactcagcccctgcaatctggcttcctcccccaccattccacaggaacagcctgccaaggtcactgctgacctccttgttgctaaatccaagggatgcttaaaagtctttatctgccttgaccccttagcagtggccagctttgacacaaatactccttcctctttcagatacttttaggcccttgtatttctggacactgtgcacttttgattttcttgctatcttatgggttgctgccacatggcaaatttcttatcctttgctcactgcctaatcatggttgttcccaggcctgctacagtctgtccccagggagtctcatcagctcccatgccttcagcatccagcccatgtcagaaactcatgtctctttctcagtccagccctctccccaaccccacacctgcctcctggacccctcctgctggatgtcccacctctcaggaaacaggctgcatacctgccctccctccatgttccccagcttagccatctcccagttgtctgaacctgaaatctggacttggttctagattctgccctctctcgcctttttttttttttttttttgagacagagtcttgctgtgtcgcccaggctggagtgcagtggtgcaatctcggctctctgcaacctctgcctcccgggttcaagcaattctcctgcctcagcttcctgagtaactgggactataggcgtgcaccaccatgcccggctaatttttatatttttagtagagatggggtttcaccatgttggccatgctggtcttgaactcctgacctcatgatccaccctcctcggcctcccagtgctgggattacaggtgtgagccactgtgcccagcttctctcacccttttcatcctcaagcagctatgaaaacctgtcctttcaggacgtacctaaaatcccatagcttctctccacttccgccaccaacacttgagccaagggcccatcacctttcacctcctgcagcagcctcctgacctgtctccctgctgccactctcaatcccctgtgtggtctgttcctatagggcagctgggtgtgtctttccaacataggaatatgtctccctgcaccatgtctttagcatcaagttcacccaacccatgcccctgccaaccccagtattggggcattcctcagtctttgcctgggtaacagcttctcatccttcagttcaagcgtccgttcctcatgagagccatttccaaactcccagccaggcaggtggctctgctatttcttctcctcacagcaccaaggcctctcctctgtggacatcgcaagcagtcattcacaaactagtctaatctgcagattcctgagccctcctgttctagatcctggggatgtcaggaggaggacagtccagcccctggcccctgtcatgtaatggggaagacaggcattaagctgagatcaggaatagatacggacactgaaggcaacacagtggccatgcaggccctaaggatggtggtcagggggactgtctttgagggtgatctgtggggtcaggggaagctattccaggcagaagggatggtgtacttaaggtaggaggaatgttttgtgatgatttgaaaggtgtccagtgtggctgcacaagtgatgtgaagaagccattgatgaggtttaaataggagactgacccagctgcgtttgtggtctttataaaataattctggattggaggaatcaattgaggaaggaaggagggaaacctggcagggagctgccgggataattgggtgagtagtaaggggggcctgactcagggcagtggcagtggatttggggcagactgaactgtggttgcctgtactggagtcagggaagagggagggaatgagaatgattctggtcttcctaccctaatggtgggtgggagagggcagtgggaactggaccacccatatccctgtggtgaccgtacctgcagtccctcatccatcctttgtcttttttcttttttttttttttttgagacagagtctcgctttgtcacccaggctggagtgcagtggcacgatctcagctcactgcaacgtccacctcccgggtacaagtgattctcctgcctcagcctcctgagtagctgggattacaagcacacgccaccatgtctggctcatttttgtatttttagtagagacggggtttcaccattttggtcaggctggtcttgaactcctgaccttgtgatctgcctgcctcggcctccgaaagtgctgggattacaggtgtgaaccactgcgcctggccatctttttttcttttattcatgcagtgacatgatctcagctcactgtagccttgaccttccaggctcaagcgagcctcctagctcagcctcctgagtagctgggactacaagcacacgctaccacacccggctaatatttttaatttgtagagacgccatgttgtccaggctggtcttgaactcctgtgttcaaaagatacacctgcctcagcctcccagagtgctgggattacaggtgtgagccactgcactggcctcatcctttttcttttctttccttcctttccctttcctttttccttccctcctttcctcccttcctcccttccttactttcctttttctttctctttccttgcttccttccttttcttctttctttctttcttttctttcttccttcctttcttcctttatctctcttttctttctttctctctctctttccctttcttttttatttttgagacagagtctcactctggtgcccagccaggagtgcagtggcatgatcttggctcatggcaacctcaacctcctgaactcaggtgatcctcccgcctcagcctcccaaatagttgggactacaggcatgtgccaccacgcctggctatttttttttttttttttttgtagagacagggttttgccatgttgcccaggctggtctcaaactcctggcctcaagaggtctgcccacctcagcctcccaaagtgctgggattacaggcataagccaccatgcctgggcacccatcctttttcttagaagagcagatggaggcccctaagaggtagaaggctgctaataaggcctaggacaaggcagaggggaggagaagggaaagttgggtccgagtccggatgtgatgaggtttcagggaaagtggcatctggggtttcctcagagcctggaaattccactgtttccgggaccactctgagatccccaaatcctgagatgctcaaaccctgaggcccagtccttgtaagtcctgggggccctctagggggtgtgagtctgtatctggaggtccacaatcccctgacaagtttcaaggtggtgagtaggattcttgaccgtccctaatgccaatgtacagttcgggtgaggcacaccccacgcctgttacctgcatgatcccatgtcatcctcatgtaatccttggaggcacatagcttatttattcccatggcacctatgagacttcaaagggttaaagaacttgctcaaattcacacggctaggatgaggcagagtgaggatttgaaccaaggtttgactgacatcagagtctgtgcttttaactcctgtgctatattaagtctggcgacccccctggttgattggctcagtaagaggaggaggatttgtgggggatttgcttgtggttggggtggctgtccccctctcatatcaagcgatgggaaagggtagcgctgacgtcgattattgccatggtgatacagcaaccctttccctgctgtctccatggtaacctggggggtccatctgtacttcgccccctccttctaaaagggggtcccttagggaggggctggctaataaggtgtctgggaaataagtcagggaaggcagtgattggagcatccccctttgcctggcccctccccattcctcaggcccagagagtaaggctgggatctgcattgggtcctgcactggggtccggggacagatgtaacctttagggtgagggaggcagctctgtcttttccacctggggattcccttggaaattcccctgcccccaatccccccaccaagttcttaggctcctgaacagaactgctaggaagttggcagagagaggcaagagggtttcctcagccctcttcagggctggacatcacccaacccctggggacagtgtctttggctgtctggctgtctgctgtcccttgaagccaaaggtaggagcagcagccgtagcagtctctcttgcttatcaagtggtagctttggcagtgattcctgcatggtgctatacatacaggtccttactgaaactttctaccaggtgtcaattagccctacttaacagatttgaagatggaggctcagaggggctaagtaactagctcaagactgcacagttagagaaacagcagagttaggacttgaactcagcactagtttcggccagtggctcttccagtggaaaggagtaagaagaaacagaacaggatggaagagaagagaaataggagaatgaagtgacccaggtaggagcctgtcgtgctctgcctgcctgcagaacaaagttcaaactccttcacctggtacgcaaaggtctccttgatccagcttctcttctgttaacccattcctggatcccctgcattctatgctctgaaagggaaaatgatgtcagattcagggctgggttctcagtaccaggcatggcccaggaaggtgttgatgaaaattgatgaactgagtttcttgaaattgtccttcactttcctgcctccaggcctttacccacaatgcttcctccccaaagggaatgccctttctcttgctcatggacattctagagctaactagccccattggcaaggactgcgtctagaatctttgtatccctcacaaatcaggtacgtgggatgtggcagtaactggtttctaaattttttttttttttttgagatggagtctcactctgtcacctaggctggagtgcagtggtgcgatctcagctcactgcaagctccacctcctgggttcacaccattctcctgcctcagcctcccgagtagctgggactacaggttcccgccaccacgcctggctaatttttttgtatttttagtagagacggggtttcaccatgttagccaggatggtcttcatctcctgacctcatgatccacctgcctcggcctcccaaagtgctgggattataggcgtgatccatcatgcccagcctaattttttttagagacaggatctcactctgttgctcaggctggagtgcagtggtgtgaccttggctcattgcagcgtcaaactcctgggctcaagcaatcttcctgcctcaggctccccggtagctaggactacaagcacacgccaccatacctggtttttttgttttgttttgtttttagagatgggatcttgctgttttccatgctggtcttgaactcctgggctcaagtgatcctcctgcctcagcctcccaaagtgctgggattacaggcctgagccaccatgcctggcctattttttttttttttttaaggaaaggagggttgagaagagaggagaaggaagtgggagagatggaaaaaaaggaagaatgagaaggattcactatttgggggctggcagagtccaaagagaccagctgatgccttttttttttaaaccagtgaggaaataggcccttttagtaagcctcctacatggggactgcctgggagagcattttatgtggaaactgagaagggtatcccttttgggtgacgtggaattttaaggtgctctagggaaagcttggacttctctaccctatgaggattagaggagggtgttgaatcaattgtccttagatctcaggggacaggagactgaacctgacctttaggttacactccccccgtaacaaaattggaaagtagaatatacgggctcattaaagccaaattggaaagtaggaaatagttgtttagcttaaatactagcacctccaggcaggcttcctgtcatgggcccctccgagggcagatcttaggtcatgtggtctcaggatgctgaggagtgtgctagactctcattgggggaccttgggtaagtctcaaaggctcagttcactcatctgtaaaataggaagttaaaccaacgtctttctttctctctcttttttttttttttttggatagagtcttgctctgttgcccaggctggagtgcagtggcatgatctcagctcactgcaacctctgcctcctgggttcaaggaattctcctgcctcagcctcccgagtggctgggattacaggtgcgtaccaccacacccagctaatttttgtatttttagtagagacggggtttcgccatgttggccaggctggtctcgaactcctgaccttgtgatccacctgcctcggtctcccaaagtgctgggattacaggcgtgagccaccgcgcctggcaagccaccatttttcaaatggcctcttccccaatctttttatgatcacttcagtcctgggagaaaccaaggctcaggatggactggggcagctccaaacccttccaataaggaaggtcccaggcacctagggccacaaagagcaagtcgcagaactttgtcgcagaacttctcgctcgagaggattaaaatgggtctggtcgggtgcctgtagtcccagctacttgggaggctgaggcaggagaattgtttgaacctgggaggcagaggttgcagtgaacagagatcatgccactgcagtccagcctgggaaacagagcgagactccatctcatagatagatagatagatagatagatagatagatagatagatagatagatgatagatagataagatagatagatagcctggtgtgggtggcctatggctgtattctatgttacttgtcggtccacctcttcctcctgttccccgcttctgtgggttgccagggtccagcacagtgatgtgaatttcaccggagaatcaccagagggttagagagatggaccagggcagggcccaagggaaaggctgcccaggaggggtcaggaccagcaagatacgagaggagtgaagtggcgtaggttgaaaggcggaagggcgggcccctaaggctgggtccaaacgaggaggctgcggaagggaaagtgttattggactgggcagagcagctggtgggcccgacggatagacatacactgccagcccggag

SEQ ID NO: 4429 - DNA, 1022 bp, Homo sapiens
acaacagacaactgaggtaacgtccactcttcgaaggtgtgtcgtccaccacgtcaggaccaaagtccaagctctccccgtaccctaaggaggccagaactcgcccccatgccaggcacagatcccccagcccggagccggcagtgcagctcagagcccttccggtttacagccgcggaaaaacaactcggaccagatccgggaggggaatgggggctgggtggccaaaattcagtccagaggatcgaagcggctgctttaacagaagttggggctgcgtaacaacagctccaagcaaagcttcaggctgatcggaaagatgaggaagcagaaaagagactaaagacagacggacaggatggctggggacaacgacagggacccagtgaaaatacgggcaataccgagggctgtaaccctaacacgggcaaatttggaggggctaacatgggcggaaaccatccgtaccagtcaccaccactgtctccagctgtcccagaaccggactcttcctgccatcaaaatggcggcggcgacggcagcggtggtagcacctacgctggcggtgagcaggcaaaggaagttgcttccgagcgcgtcgaaacgatgatgcgcacgcgcaaagtaggcctacgtggagccgacctgccattggggaacctgatggaataaactgctgtgagagggagtattgaaaatacttctcccctggaccttgttcccaggctccgtgtgaagctgaacactccgcatgatctccctgccaccatagcaagctatgaagttcattacacatgcaggtagcagacaatacagctctgcttccatttctgagcacctacggtagactgccattattcagtgtgccagcctgtttccaagcctacaatgtatagttcctctagtacgtaaactcattttttttctcagagagccaagtagagacacaggcagttttcttctcaaaatgtgccagaaattccaaaacaatctcaaagcattaaaggctatgtgcacaaagt

SEQ ID NO: 4430 - DNA, 9395 bp, Homo sapiens
cccagagccactagggccctgcttcttggggtgcgaggagctcggaacagactgccctccctccagggctggcaggacaggcctgggcaagaacataggtttgtcctggaccgtgctgagtgtgtggccagctgcagccggggcaggggcaggagcagggctgccagggccgagaacgatccccgtgctgtgtgcagagctctctcctttgccctctgaggacacgcgtcactggacttcgtgactgctccaccctattccagaaggacctcatttcaaaacttgaacttcagtcacatctgcgaagaccctttttccaaataaggccaccagcattcacaggttccccaggaggacatgtcttttgggggaaggggtgtctccggaaggtcacgtggctgctgggacagcactggccctttctgtggctgttgcctcctctgtgaaatgggcctggtgtgttcgagcccggaatatattgcccagacatcagtctcacagaccactgcgcttcaggaaggagaacttggaaagaagaccaaagacaccaccggaacaaaggagccgggtcccctcctgcctacctgccaggtgcatatacagctggaggcacaagtggaaatcttggtcaggctgtggactgttagttcattagagaaccgtgtgtgacagtatccttcctgctggaaagtcaccagcccgtctcacagggccaggcagggacgggccctggggctgctgtgtcccaacatgtggccttggaccacaggtcaccatgggggcccaagaaggggaaccaccttggtggtccagggaacaccgcagagtgacgaggcggggaaagaccctgagaactgtccccagcacagggctgtggctgccctggcctctgtccatgcgtctgacgaagggcaccgggaggtgaaggccgcgggaaaacaagccccgctcccgtcctttgattctgtcccagcacacggcaccggcagagccccagcttccccagcctgtcatcctcccgaggccgacggcacagaagaatggcaggcccaggacacactgagctcccagagcaagcggcgggtcaagcatcctttatcaactgcgaggtcttcgaggcccaaaagaggtgccctgagtcgcgaagtacccacccttggggcagccaacgccgcagccctggctccaggcccaggttgtccggagtggagccacactcgagcctggcaccaatctgggagctcctgagcgcaatgtcctgtctgtccctgcatgaccctgagactgtctgagatgcctcacagagagatgccctggagtcccccacaggcaggccagcctggaagcttctctggaaagtgagctttggcagctcgaggccgagctgtggccgactcctcccttggttaacacagcctgtacccagctgggattcactttgaggccctggggcttgccctatttcctgccaggagagcggggcccgaagctccatcctgtcccccaaaactcagacgtggaagccctaaccccggtgtggctgtacgtggacatggggcctctacagattaagggtaagtggggtcctcagggtggggcctgatctgacaggatccttgtccacacaagaggaggccccagacagctcactctcccacaaggaaacacagcgagggggtgtctaggagccaggaggccgagcaccccgcccagggcatcagggtccctggcctggcggggcctctcaccgactctcccgccggcatccaggtagcagggccctggcaccagaccctctgaagctgagacccacccacccaggcctgctccgctcttgctgtcacccccggagaaagcggcagtcagggcgtgaggtgaggaaaaggggctgttggaccctgcatggcagtggctcccgtgccggggacgcggtgagcctggcctcctccctgcaagggaggacagcccatttcccaggggaagacaccgaggctcagacaccctggccggggggcggcaaaactagaatcccaaggcagctgcacatctagcacctgcccttgccctctctccgggagggcaccctagaagcccacagtcctgatctggggttcggagagcaggctgggctgagctctgctgggagcgcctagaagcccagctatgggtccacgcacacactcaggtgaagccaggcccagaagaaggaacagctctaagccacagcccaggggggcttctcagtccacgaggcgacccctccacaccccagagccacagacagccaaggtgtgggtgaaacgtttttctcaccagaacagcccagcagctgggcatgtgctgtgaccactgagggggcctttgtcagaaacatcgtctgggggctggacgcccccacccacaggaagaggagaccaagacagggccgcacacccccagccagatgagggccagatgagggaggcggcacctcttcctccaggaagctcctcaggagggacatcgggaggggctcagggggctgccttcaaggaagctcagtgaagctcagagaccagtctgaaaaggaatgtcctccagacctccaccctctcaggatggacgtgttactcaggaactgtcccgtcagcttttcccgtaacacatgacaccccacgtgaacctcccaagagcagatgggcccagtgctgtccacccgaacgcaccttgggaacagaggtgtgggcctccccccagcagcgcatgaccctgcacactgcacccagggtcacagtgggggtggggagggacctgcccactgctcacggctgtgggacctggggcagggcaccccacttctctgagtctaaggggccctactagctgaagaaccaaaggaaaaccatcatttcaaaactgtcacgtgacacacaaatgcaggcccctgccccacagcccagtggcacacacgtatttaccgcctgggacacgggaccgtccagaagtgccctactcataggtgtaggtcacatccaggggtctcggccaccgggacccagggcccagcagctcagcaaagccattcagccggggtctgagccctgcccaggggaagcattttcccctcctggggtgaaggacagcaagaggcacgccgccctggcaggctgcggctttctttcctttttgtggacagagtgaaagggcaaatttgctccaggggaatactgacctccaacagtacaatgtgggaggagaaggaaaagaaagtttttatgcaaccttttttttaaatctgcccaactatccaatctgtaactgttcaaggagagattagtttgttctgccgctgacggctgcagcccaagcaaagcacaaagcgccccattgtgtcctccaggagggacgtgctgctgctgctgggctgggacggcagagcctgtgccctcgctcccaccctccgccctgcaggcgaaggcccagccaccctctccttaggcaacagcctgcgagtggactcatgggacggtgggtcagatctgaaccctcatgagtactgtctccctttcgaaaaggctgggactaactgtagaacctcatgtgacacctaagcctgcgtgtccccatgccccagcctaggggcagccatgactcccccaagacgcggaggaggcaagggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgacgaggaggaaacaggtcagccaaggcctacaggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaagggaattgctggggggagcacggtgggaggacgctttcaacagctaacggaattataaacctattatgtattcaagtcgaacaaaagctctttgctctccctaccgaaatttgtttttacaaaaatcacgttcccctcctaaatctttcctggctatctgatgagcgcagccaagcaaaggccttcacgagcaaagcaccccttccgtgcccacttctgggaggcacaggatggatttgtctcctgcccgtaaaatgtcactcaggcccaaccacctccctgggcaacttctgagtgcccgggagccatggaatgagctcgtcttgccttgagtaaggtgccggaacctgaggtcccaggaaggttcagaattgggacttcctgccagccctgtcctgccagctcttgggtggctctggtaccccgggcgactctgagaatccctggtcagacacatgcatgggggatgggctcgagctcctgaaggattgacctgggcaaccttccagagccacctgggaatcaagtgggacttcccctcgacgatgaggcaggtaactaacacctgctgcagactttgtacagattgatacatttgataaagacagtctggccccagcccctggagctcgcctcgctgtggtgaggtcagtatagcccggcactgcatccccctgcaggcccaggttacctgcttggtgtggagacccctccccagctgcagccagactttgtcctaaggcgaagtgccacgtacagccagcagggggcgccaggagcaaggcggaggctcagctaaagctgcgtgctgggtgctgggtgctgcggggcactgttcagttcacagcccaccagtggcacggtgcacacaggagagcctcccagccctgaggcagggccccacacaggaggaggcagcgtccttgtgtctgcatgttttggcctggccgtgcatgggggcggggcagctcacagcttgctgggtgaggaccttcctgcctctaggagcaaggtccttgccctgtcctctgcagccctggggtcctacctgcctcccctacagccatgtgggaccaggcagcctctctgcagccatcggtgactgcgagtcaccagagcgtgcatccgccgggtgcctgcactcagcgaaagctccacagctccaggactgggatcatctctacctgaggctctgggagagaagagaaggaggccagctcctaactgctctgctcctaggctggctccaacatggatggagacaaactcagaaggaactgcagacagaggcatccctgctggactcaagcaacagggccccccacttcaactgtacccaaccacgggtgggatccagtgccaaggacagtgtgtcccagggtctgtgaccacacaaatgggaactgcttatgaaaccccagcccgacctcaccgcggaatggcagtgtggaaagggtggaggctctgcaggcagacacagaacacagatctatggagtgtgtgttaaagggtccagagacacccagcaaaataccaactgtgtcagtccacgtcaacagagaacacaggtgcaaaggggcgggggctgtttcacactcactctctttattccttctaccagccccaagagaaaaagcagctgggaaaaaggctcagaatcagtgatttccccaagatcacacagcacaagaccaaagtctgggccagccagccttaaaacctgtgcgccagactgctctcacctgttcccgaatgctaacagtggacacgtctgagtgatggggttaccacgtttgttttgttttccatgcttacctcatcttctttaaaaagcagacagaaacacagagacaatcccacacctgcccatggaatgatgaatgaatcacagcatgaccaggagcatggccccgtcgggggtgggtgaggggcgacagcacgtgggactctgacagacccagggtgagatggctcgggtgaggtctgcatggcaggcatagcccctgccaggcctggaatgttccacatcgcccccaggtgaggttacaacgcatcagctgggctctcaagattcacagacatcgcagcgtaaaaaacaagaaaaactgccagagcccctcccagtggtggccacgctgtcccacgggagcactcctgtgtccccctctgggtcggatttcacttgctgggtgattttcccagagggaaatctccacgttgtacagcactgcagagctgcggactgggaggcacccggggacgggacctcatgccctgtgaaggacacacaggcaaagcctcgaggggccgccggtggggcctgggggacgtactcacccttcccgatctggacgaagcccagcaggatgatcagggccagggccaggagcttggcggcggcaaaggcatcctggacccgggtggcggccttcacgctgtagcagttcacggccgtgagcagcactgtggagacagagggcagcggtgagttccacgggcagacagacgccagctcaggggtaggctgggaggtgacgaccccacccccaccccagggccaggtccaccagaaaaacaagctccttaaacagctccagtcccctgccagcccttagggcacgttctgactttctgagacctgttttgataaacttcgcagtcctttcaggtctaagggctggatcccaggtgccccttaagatctgcaagggacctttcctcaccccccaccacaccaggccatggagtcccacctgtagtcaggacttcaagtggggtcactgcctccagagacccaggtgagcaaggtgaccctgccacttggaaggcgcccattacacctttttgtacctactcagcaccctgacctgactgtgagacccacgcacagcccgactgccggactccatgagggcggggccctttcctcaaagaggatcttctgtggattccaacagaagtggggtgtcccgctttcccggaactacctggccagtcacctggggacggcagcctgggaggggccacaggggcctgtggtgagcagagcagaccctgctgccctgctgctttgggggcatacgatgaaacccaaaatagcaccgtgtgcttcagaagcctgagtgaccccacacagatggccagaacgcctgccccaggaggcgctgagatgtggggtcaggcacgctcagacaggtctccagacaccagcacgtcctcctgggccctgtaaggcacccagctctgagcctctgtgtgtgtgtgtgtgtgtgtgtgtgtgtgtgtgtgtgtgtgtgtgtgttgggggttctgttgcaatatataggcacgctgagccactgtgtgtgtgtgcgtgtgtgtgtgtgttttggggggttctgttgcaatatgtgcgcacgctgagccactattcagggatctgtgagctggtggggaaacagccacccccacaacttaaaatgaagtaaaatcatattaatcccgaggcactgactccacgacacccctcactgcctgctgcactacccttcactcctctgctcacgaggttatctgtcgctgtcagcagcttgaaatctgccagtgggaacgtctacaccccagaagtgggcaaaggcccagcacgggccacccacacagctcagatctcacagccctcccggcaccgcaccactaagactgcaggaaggtgagagcatcagaaaggccgtgggctcctcttctctctttccccttgggagtaacgctcagaaaggtctggccagccaaggccttgaggactccagtggcttttccccagctgaacaaatcctgtggaatcttacaatgtaagcaacagaccccgaggaaagacatccatgctaattaactaatgacaccggaaacgtcctgaggtgcgggacgggctgccgcctgcctatctctcagaaattaaccaccccgctacaattctgtggatgccagagcggagacggctactacacaccaggaaagtctggttgaaaaatgtctgaaagtcagtgttttcgctgctattcctaaaataaaatacttgaaattccggaacttccactcctcacccaaactgaagaggtgattcttcacctcttcccagggctcccagggacatggagatgttaccagtccagagctctccagtccaaccctcagggctcagcagggtcaggtcagtgggtctaggcagctccttgtccgctgcacagggcaaggggcaggtcctggcttgccagtcccatttccttatggttggggggagcacgaccataaaagaaactgagcctcggggacctagccggcttctggagagctttctggattcgcaagaggccggctgattgcatcactcgctcattcatgcccggagggaggcggggagtgggtgtggccaagccgcactcgaggctgcctctccccaaaagggagagaggcacgctgccaccactgaactccagacaccagacaggcgctgcggagacactgagcactgccctcgcggctgtcacgtctgcggctgtcacgtctgctagggggttggggggtccaggaagggcagcgagttgcccagaattgcccaaccacgggctgtcctgccacactgacgtggtgctgggtaatgacgccatcagggctgtcactgtgggtgggacagaggccaggacccccccgcccccccccccaccgccagcctgaccctgcctgcccagttccaacccagccgctccccaaccaaaaacagtctggaggggctgacgggtgccaccgggagggttcaccagatcatctcctgacgttggaaataaccacaggacagacaggcgggggccgggtcttgaagtcaggtggggagcaaaatggccatagaacaaaggggaccttatatttattccttttataacaagaacataaattttcatgttcactgactttgggtgatgagt

SEQ ID NO: 4431 - DNA, 2226 bp, Homo sapiens
atggtgctggattggcacaaggtcaggtaccaccagagcagaatgtgggaaggtgtcccagcaagcgcagctgcctccgggagtccggtgatgtggccccctcagctggccagctcagagctctgtgttgggttcaggacgggctggtagccccaagcgcctgaaaacccaggaagaggatggtgtggcttgcttcgccgaggttatcctggggctcatcctgccgcagaagtaactcctcctgtgtgggcggggccgccaccaaaggctgcctgattcagagcactcagggagtcctttcgtcagggggaacccctccacatcctaccaatccctttctagaagaaatagcttctctagaaaaggaagcctgcagctttaaggctgattccaaagatagttctcgtaactccatgaactcttaatttgcaactgaagctgagagtcagaatgatacgactgaggaacccaacaaggtccagaaaaggaagacggatagacttcgacatcagggctccacaatgatctacctggaggctaaccagggcatccagggaaatcaatgccgaaaaggaagggagaggctgtcactagttcaaaaccaagcatagcagagtgtcccagttgtggagaaggaccagctaggagtgaaggaccagccaagactgagaaggaacagccaggagtgtcacagtcacccctgctgagaaggatagtcaatcccagaggtcagtggagaaggacaagacagtgccagagaggagcagcttctgtgacaggagagtagtcacagaccctcaggagaaacccactgaggagccccttggggaccaaaggacagtcactgacaaatgctctccacccctcgagtttctggatgactctctcatttagaaatccgaaagcataaagatagggaggtggtgatggagcacccctcttcaggaagcaactggtctgatctggagatctccacggtcagattctctcaggaggaacccgtcccactgaaaccctcagccattccagagccttcttccttcactactatgtcatgtacctgcctcatttttacagtagtccttggtgtgagtatgtcagctagtgcaccagcagccccaagcctgccggctacctgtctgtgagcagcagcagcaatgacgcagcacaggctgggaggagcagcccgagtgcctgagtgattcttcccccaactctgcagtgagcgcccataacgtctccagagatgtggaggcctcagaggaaggcagctcccagaattctcactcatttcacttctccagaagctcgggaggaaaagaggtgaagcaaagaagaacattccaagaggagatgcctctgtgtccttgtggaggacacacatccagctccctgccaaagagccactgggagccaagcctagagcagggcttcactgatacccactgtcatttggatatgctgtattccaagttgtctttcaaagggaccttgactaagttcagaagaatttacagcagctccttctctaaggaatttcagggttgcatctctgacctctgccaccctcaccctgacaaattgcctacggggggagctgttgaaagagaatctggtctggggggcctttggctgtcaccctcattttccatgttactacaataagagtcaggaaagaaatcttttacaagccttaaggcaccccacgactgtggcatttggagaaacaggcttcaattactcctacaagtgcaccatgcctgtcccagaacatcacaaggtatttaagagacagcttgagctggctgcgtctctagagaagctttggtgatcctctgccagcaagctgacgaggatctgctggacaccatgagaaaatgtgtgttctctgactacaagatacacaagcattgcttcactgcagctacctggccatggaacccctgctgaagtactttcccaacgtcggtgggcctcatggcagtcctgacgtactcctccacctgagaagcccgggaagtgctgaggcagatcccactggagagaatcatcatggaaacggatgctccctacttcctccctagccgggttcccaaaagcctttgccagtatgcccacctgggcctggccttgcatacagtcctggagactgccagagtcaaagatctagtctcccacaccctggccactttgcgtgagaacaccagttgcctctacagtctttaa

SEQ ID NO: 4432 - DNA, 1940 bp, Homo sapiens
gccagggccatggtgtcggggaggcacgggaccacgcggagggcagcaaagcggctccggcgctcctccgtccttcctcgccgccgacgtcggcccgccgccccttcttttcctttgccttccccccgcgccgcgcccggagaccccgcccagcacccagcggctcggctactcccggcgcgccccgagagctacggggatgagaggcggcgccggcgcccgggtgatacagccggcgttctgtacgtcagccaccgctctgaagagagaaaagcggcggtgtcctgcggagagagccgctccctccactgcccgaggggagcgcgtcgcctcagccgctcgaaagcaggaaatgggcggcaaaagcgcagtcagacaccaactggttctggactgcccccgagaggcagcgagcagcgctcccgcgcttcgcccgctaggagctgccgccacgtcccgagctgcgccgctcgcgcccctccctgctccgagtccccggtgggggctgggctgcggccgagtccggtacccgggcccccacccgcgccgcgctgtcgaacccgccgccggcccgctctcggcgccgataatcgccggcgggcatcccgcagaggctgccgccggctccgccaaacagcagccaaggcatagccgggaagtccccaggccacccgttccccagcacccttcggggaattcccgttcagctctacaggaggcgaaaacggaacaaacgaaaaccccttaacagtgaaaccgggcccggcgatggcccgggtggcgactgcgacgactcgacgcgtgcggacacaagacccgtctcgcgctccgctgctcctgtgcgtccggacgaaccttagagatcacttaaggaggctcgcgcgctactcctcaccacgtgaccgccccgccaggccgccccccgcgccgccatcttacatccgggacagaggcggcgtcccctttccctgccttggcaggcgtcagcgtgctaccagaaatcagccctgaaagaggggaccccgattccacgtcaccagagtgctgaggcagcgggcgatgccctccatcggctcagcgggggggagtggagtcccaaacttttttcggcctttgcccgcaaagaagatggcggcgcatatcgccgcctaagcggacacgttgtaccctggccgtggtttgaagtttccggcacctcctttcccaaccagcaaggacacaaccatacgagccccacccacgcggggtggctgccgtgctacattccgcagaaaacaggcgggaaagctgcggcacagcccgctttaaacgcaagcttttgggacttctggttttggctttttctttttaagccaagttagggagaaggctgactgccatggagccacttctgcttttggcccagacaacttacgggattttttttttcctcccatttagagattttttgtaggaagttaacaaattattttaaagaagtagttagggcttgtcagataaaatacaggacgcccagttaaattggaatttcagataaccagtgttttggcatatgtgtgttacatatatttttaaaattgtttatctgatattccaatttaactgcacattctcaatttttaatgactgtatctggcaaccctatcagcctttacccctgaaaatccagactgcttatgacaaaagtaaggaatggagggaaatgaaaagcatgtttacctacaacttagaattgtctttgcccagactttgatccttcatggaggccagagggccgtggtctagaacaaaatttggcagcaactcataaagatatccttgtataattccctttctggcaaagtaagattttttttttcttaagctatcacgatgtaattttggacaacagatcctcttggccaagagtttaattgcaaattaaaaattaaataactggc

SEQ ID NO: 4433 - DNA, 59461 bp, Homo sapiens
aggcagaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggcc

SEQ ID NO: 4434 - DNA, 59462 bp, Homo sapiens
aggcagaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggcca

SEQ ID NO: 4435 - DNA, 2001 bp, Homo sapiens
ctttttgatacagagtttcactcctgtcacccaggctggagtgcaatggcgcgatcttggcttagcgcaacctccgcctcccaggttcaagcgattctcctgcctcaccctcccaagtagctgggattacaggtgcacaatatccagctgtgacaggacagtggcttcttacagcagctgatttctgcctgacttctgatgtttctccaggaaaaaggaaacagggattttttttttctgggaaattgcctcattgacaaatgtcagcaatcaatacttttttccaagatatcatggaggccaagagcatctatttgtgatctgtatctggtcagtggtttgcagcaccttctagaaataaggtgccacacccagcaaaacccccttccctctaataataactatggttattgaactcctatgacatgccatgcagagacacccagtctccacattcccaaagaagcatgatcttgtataaagaggatacctggaccgggtgctcatgcctgtaatctcagcactttgggaagccaaggctggtggatcacctgaggtcatgagttcaagactagcctggtgaacatggtgaaacccccgtctctactaaaaatacaaaaattagccaggcatgatggcgggcacctgtagtcccagctactcaggaggctgaggcaggagaatcgcttgaacccgggaggcagaggttgcaatgagccaaaatcaagccactgcattctagtgtgggctacagagggagacttcatctcaactgaaaaaaaaaaaaaaaaaaaaaaaaagacacctggagagggaggcccatagctagtaccagtgagacacagtactgggaccttctgggatacactcctccttcaaaacaggactcttttctgtctctggctcccagatgtgagggctgaggggttcctggcacctccctcccgtccccccgcaacttcctctcccaagaagccttccctgattactgctagtctggcccacatacacagtgaaattgacccagcaagagctctgatcccaactccaaatgtagatttattgaagaaacgcagagaggtaggctgtttgaccatgggagagccacttcacccttctgaatcagttttttcaaccataaaatgaaaataaggtagaatgaagatctcacagtgctgtctgtggcaactgaaaccaaaggtgataacgactggagctcaggacaggctgtttctccaagaggagtgtgaagaagtcccgggaatcaacattttgagagcatcccaggggcctctaagaatatattacgggcaaacacttgtagagcacttcatttcatcctcaatcaccgttacgaggcagacacaatcatctccgagtgaaactgaggctcacaggggcgggctccgttgccgaaactcacagggagaggcagagaagcaccacggttctatatccaggttatttaacagaatttaactcagccatccaagctctgaaaaaccccaagtggggaggggctcaaatatcccctcacgccccgtcccctacaatacagggaaactgaggcacaaaccgggcaacgcccagctccaggttacacgacacacccagaacacaggaggccccaattcctatgcccctgatccggatccagatccagcccgtagcgccgcctgcgtatccattgagcagacggggaaactgaggcctgtgcgcagcaggaatgaccagatgtggccagtggcgcaccccaccccaccgcagcccgggggccgcgcccgacccggaccggttccccgcggccctggagtccccagccccaccccaaactcggccccggcgtcggtagcggcggcacctgcacatctggcggccttgctcgcgcttccgggatggcgcccgcgccggcgaaacgtcaccacgcaccgatcctgcgagcgcgcgtggcggggacgtaccctggagccgcttgcgtgcgttaagtcacgacaggaaagg

SEQ ID NO: 4436 - DNA, 1119 bp, Homo sapiens
tgcaggtcagctcactcagttgttaacagagattttgatcgtcaggagctctgggaatataaagatgaaacttcccccttgccttcaaggatatcatgggccagaaggcaaagttgttttgaatacgtggttcattgagtacccactctgtgccaactgatggctgcaaagagaacagaaggggtgctgctgtaggaaataaatgaatggctcagaagaccacactgaggaagttgtgagttgataatggaagatctccaggtttgaggcatccttagagggatatgatggttttgtgtgtgttgggggtgtggtagcgcagctgctacctagggaattagaaggttttctttattgaacatttaccctgtgacaggtactgcaggcattcagcacacaatgtcgtctccattttacaggtgaggaaactgagactccagttcaagtagatggtcaaggccagtactaccggaaggaccatctgggggttcagacactggcagggtgggatttgctgccccttgcaaattgagagtgtcttggggtcagttttgatttgctcagctgttggcattctttgggctctgagtgggtgaggtgacccttgacctcctgggatcgcatctggagactgcctagtattctgccagcttcggaaagggagggaaagcaagcctggcagaggcacccattccattcccagcttgctccgtagctggtgattggaagacactctgcgacagtgttcagtccctgggcgggaaagcctccttccaggattcttcctcacctggggctacttcttccccaaaaggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaa

SEQ ID NO: 4437 - DNA, 3193 bp, Homo sapiens
agacgacaacaaccgccacaactgcagccacacaaaggcgccttccttctactcccgctcccacccaggcggaggcgccgatgatgccaaggaagcggcgaccacctctcggccgcctagcgctcgctcgccctcttccccctctagctggggaaagggggaggggaccaccgggcgccctcacctggcacagctgctgacagtagtcggtggccgcttccacggccggtacccggctctcccgcagctgtagctccagctcctggagccgctcgcccaggcgctgcagctccgcgacgcagccgccttcgccgcaactcaacctctcctgctcggcctcttcgtccgccatcttcacaccccgctccgtcgcgtacgcacctgggtcacgtgataacacaatgccacgttcggcggggtcacgtgccgggcgcgcttgcacggcgccgagcacgtacaaagggcccgatggggaagatatgggggtggggagagtggcgcgagagagcccgagggaggtgaaggcaaggggaaaggagaagggcggggttggggcggtgcggaaaacggcggtttacttaccccgagcgggaagtgggcagcagcggccgaaaggggcgggctggtgaaggcctgctctcggtcacgtgggcgccgcgacgggaaaaagcctagggaggggcgaccctctccggcgtcccgatcccggcgtggctttccccagtccacgaagtcttctacggacatatcctcctgttccccaagaggatggcacagggagagttctgagtggtctcgggcaatggctgcatttgctgttggcctgtaagcaggccagaagcagaggaagagagagaaggtaaaacccgcccatggaccgcaagcgtgagagccaaggcaggactatgaactgtcaaaattgtctctgacttctcaccaggccggagaggagggatctagtgcgtgaggcactacttggtttgggacaagtcagaggcgaataaaagctcttcctgccttgaagaagcttacagttttgtgggaaaatgatctgcaatgggaatacatacgatatgacaaatgttctattatgaaaatgcatgcctgtattcaacttagaacatcaaagtaatctcagatactaacaagaatgtccaacgaatctctacataagtgcaggcttttttttttttttttttttttaatgagaaggattgaaaatactatcccgtgacaggtcaaccttgtcttggaaatctcagaaatctcaatcttatccatagaaaagtcatgacttctgtgcttatgtccatttgttctttaaataccaaactgtcagctcataggaaccatttacacacacacactgacacacacacaaacacgcacacccctacttactgagatgttcctggggagattcgaagacctgttccattgagaaaacaagaataagcccctggggcaaaagactccgcgtctctggggaactcagtatccgcgccgcgagcacccatgcccattttgaacacaacgcgactgctaaggacgtggtgtaatcatatggaccttcactcccaagagactcgatttcagagaaaatctgggagacaaatttagatccctacccgcacccacgcgatcaataaagctggggagacctttgggggaggggacagatgtgcttgcatccgggccgtgcgtgcctgcttcacgggttttccgggcagcaccggcccgcacacgccggtgcactctttttctggaattcttgaaatagccgggcctgaggacagtaagggagctgagttgtgtctgctacagacaagcggcgcagagcctgggggccaagccagggatgcagggagcgcggcgttagcggatgacggatagctcagggctaaggcctggcaggtccttcctacccccgacccagtacaccccgcagccccgccctcgccccagcacgcgaggtgaaagcgcgaggcccggggatggcggagagcgtgcgccactatcggggcgctgtctcttgccccgctctcgccctgggccggagaacggagaaggtccgcaggcctcgggccacggagggcaccagatcggtccgctctgctccgctaacccagcctgcgcccctccaccccgccaaggccctgctgggcgctgcgccggttgctcgcgtcctctgttgtcgcggagccgccgccgccgccgcccgcgaaccagcaacgccgacacccagcagttgcaggcccggcgtttgccgccgcggtttttccacccagcactgaggatcaagcccgctgtagcctggctgcgactccccgcttgggagcagaggccgccaggggcctccaggccgagagattctggagcctttccagggcgcggcggggagcggggcctccggaaacccaccccggggatgctggagtctgtcctgcagaggccgtggcgcgggcactgctgcctgatttcgaagaggctccatcaacctactctcttccaaagggctgggcagcccagccacagacaggcagcctctggatctcagaagtgagggacggagtctatcctgggtttggtccagtagaaaccccccacccccacccccagagtctgggaaccagtgctgtgcccacagatgcaaagagaaagagcatgggttaaagcgctattgggatcggttagacaccacacttttccaaggaagacattttcttcgagaggaacagcaaaaggagtcaatataatgttaaaaatattaaggcaggtgctgtgccacatgttgaagtgattccaaaagcagagaaaacatgggactcacatttaagaggattaattgtagcctttgagtttttcccagaaaaaaaaaaaaggctagcatatatattttcatatatttatatgaacaggtaattaaataaggagggattttaaaaaattgtctatttggatatcgttttcctttccatttgaggaaaagccaaatgcaaataaggagaataatatttaaagaacatgcttttaatagagcctcaattatccttctaatttaaccaagatgaaaataattgtgaaataaagcaaaataaaatcttggaagcataaatgtgttatacattgttcttttgtttgtttgtttgagacggagtctcactctgtctccctaggctggagtgcagtggcg

SEQ ID NO: 4438 - DNA, 1213 bp, Homo sapiens
tccggcagagcggaagcggcggcgggagcttccgggagggcggctcgcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtgtctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctggccactctgctagagtccatccgccaagctgggggcatcggcaaggccaagctgcgcagcatgaaggagcgaaagctggagaagcagcagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggctc

SEQ ID NO: 4439 - DNA, 391 bp, Homo sapiens
ggccccgccggctcgcgcgtcccgccgtccgcccaccggagctgggccgggccgccgcgcttgcttctgcccgccgcaccggggccggccctgggcctccgcggatgccgagccttgcaccggagggcgggcctcgctggctgttttccctcattgcctggctctgcgcggtagaggtcgcgagtggcgaaggctaggacgcattttgtcgaactgcgaggcgcggctggtgaggcgggaccaaagaagtaaacactgtgtggagagggactgacgtgtttggagggaaatgggaatgtacacgataattaaagagtaaagttgtgctcaacgctgtttacttctaattatttcctgattcacaaattaatttttgcaattcacaacttca

SEQ ID NO: 4440 - DNA, 3435 bp, Homo sapiens
gcgggggtggtggggaggacagagtttcactcttgttgtccaggctggagtgtaatcttggctcaccacaacctctgcctcccgggttcaagcgattctcacgcctcagtttcctgagtagctgggattacaggcgtgcaccaccatgcccgtctacttttgtatttttttagtagacggggtttctccatgttggtcaggctggtcttgaactcccagcctcaggtgatccacccgcctcagcctcccaaagtgatgagattacaggtgtgagccacggcatccagctaattctgtggtgtttttgtttgtttgttctgttttttgagacagagtctcactccgtcacccaggctggaatgcagtggcacaatctcaactcagtgcaacctccgccttcagcgttcaagcaattctcatgcctcagcctcccaagtagctggaattacaggtggacgccaccacacctggctaatttctgtatttttagtagcaacagagttgttggccaggctattctcaaactcctgacctcaagtgatctgcccacctcggcctcccaaagtgctgggattacagacatgagccaccgtgcctggccaattttggtttttaaatccctaaacagcacacaatcaagaactgaaacttttaactggcacatgatgtcgaggaagaacccttgcaaacttcaaggtgtgcaatatgggatcaatctcccatttaagaaccagccaggcaagatgggagtatggattgctgggcattaagttataagaaaaaaaaaatgacctgtttctagaatgatgttggaataggttcttccttgggacaatagaaagggatgaaaaagaccccacctactagactaccacaactttgcactgtacttacagaaaaaccctcataaaggaaacgaagggcaaaagcttacttattagctagagaaaacaagccaaatgtctagaccttttcagcaacatttacggaggcttttatagggcacaggttttgagtgcagatgacctagggttctatttaccactggatcttatgggcacatgaccatggataagttactagactctttgaatttgttttctcatcagtaaagtagggataaaaacctcatattttgcgaggctgctgtaagaagcaaatgagaagataaaaataagcaaggcactcggcaggctctggcacacagagctctgtaaagtaatgttctagaactctgggcttccacttctctgtggctagtttacctgcctttgcttcaagcagtcctataaaaccctgcttctccttagccatgcctgataggaggacactccagggagtgatgggaacctgctttttcattgttagaattagtgtaagagctgcgctttatgatctttggacagtactccagtgggactgtgtcagtaaattagaagaatgtaaaatgctttgcgttccgtatctcccaaaactaatcttatggcaagaggagcttatgaactacattcattaaacatcaaccctcaaaaaacaggcatagccactactttcagtcagcatttttcaaataaaataggagataatattcttttaaatatctaaagccaaagtgtgatacttttcatcatcagaattttatgttgctgttgtgaatttgtcttttaaaacaaaaaaacccgtaaggaaaaagtgtccagtatctaagacaacatgcttagaagctgtgagtcaggacccagtttcataataagaggtagcatcattgtcacgtcactgagcttgttgggtacctctccaactctgactgaggcacacacatgtgcatggcccttctaaaatgttactggcaggcagtaaaagcggatgtctgagaacagactgttttttaggtgcccagtaagcatcaaatcttgaggcatttggtctctcttctggtgaaaggggacaaaagcaaaaaataacactgaagtttgggcttcagttcaaaaaattctttaactcgggtgcataaaagagttccaagaatactgacagttatcagaaaggaaaatcctaattaaaattaactaactgggctgggtgcagtgactcacacctgtaatcccacactttgggaggctgaagcaagtggatcacctgaggtcaggagttcaagtgatccacacgccgcagcctcccaaagtgctgggattacaggcatgagcctggcccagaattttttttaaaaagtgagaatcaacaatgaaacaggaacgtctccaggcatttggcgtgtgtcaggaattagggtttcagaaaggatacccaaatgttagtttccacaggaaaggctcattcaaagatggatggatagaactcagaaacaaatccttatggagaggagtgttttacctaaaaccagaaatatggatctaaaattttaacctttggggtaagttttggcttaggaggtcttccccgcacccgtgcaggggggagccggatattctgaaaagactagatttgacaaggggtgtgcaaagcacaactttaacagacacaatgatggggtctgactgcaaacacaaaatcgacagaatcacatgctcttgtcgtcagttactcttagcccaaaaaccgtttacttcttcctactaagccttctctgatgacacccccgtgaagtgctctgttagtggctagaccgtgacctccttgagccatccagagcttggcactcagtaatgtcagaatgaagggcaccagcctttcccgaacttgcagatcctacaaatcacccgagggagtggttaaaatgagattcctggaccacacccagacccactcaatcaatccttctggacaaaggcctagctgtctgttctagtaacaagcatccttccgatctggatacttaattatatcaactcaacacgctgggggttcggacaagttgcaggttcgaaattacaatcgtgagctcaggtaccccccgactccaaggctttcgtgctttgctgccaggaacccccagggaccaaaacgtcacggggactgaggcccaaggtcacaacgattggctactggtaggaccgggtctcagaaccaggtctccccgatcccaagctcggagccgtttctcctcagcgtggtgtccccggggcctcagagtagggccggctgcgcaagggacgaggcagccggggaacggcagaaattcccagtcaggaccccagggaggttagggccggccctggcccctcacaccgacttctcaggaataaaccagccggggctttcagcggggcggccgtggctgcgttcccatcgaggaacggggtgggaagagaaaatgagaggatgtgggaacgagggtgggccgggaggggacagttgagggagctctggcgctcagctggcccccaccactctcacctgccgcctgggctcgct

SEQ ID NO: 4441 - DNA, 897 bp, Homo sapiens
ggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggccaccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgtgttggttcaggcctggaggccgcctacagcatcgtggccctgggcgaggagccggcccgagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccg

SEQ ID NO: 4442 - DNA, 1495 bp, Homo sapiens
cgcgggcgcactgacctgagatggtctcctggtagcccttggtgaagaactgcatggccgaggccgccctccagggcgtcttgagcagcccttgccgctgggggttctcgcccagcgagctcaggatggacgagtaggcggctgccaggttagggaggttcagctcgttatcctcctcgctgcggggccgctcgcccttccagccgtccgcgggctgcgcgctcttggcctcgggccgcgggggcttctccgccggcctgctgggcccgggccgcggcggatcccgctcggggaacccattgctgcacctggcgccccgcggcttctccgccggtgcccgcacagggcccttctccatggacccgccgcagccgctgccgttcgggaaggaccccggggcgcttcgaggtctgcggctaaactccgccggtggccgcggacaatgggctgtggccggagtcacctgaggaaggtacgcaacctgcttagatcacactccgagccgggagcggccacaggctggaaagcccggccgcgcctcctttttatggcccggcggctcagcctgcgccgcggagcgctcccattggccggccccgcctcgcgtcacggccctcgccgcgcccctcggcctcccgcccccggggtccccagcaggggtcgcggctccggagacgcccggaggggttcgcaagcgcagggagggaaggaaaagggcgccggcccctaggatcaggcgggacccctccacttattgcggaatgagccgaacccgaaaagaggcagtcgtccaggagctgggatctcagtgagaaagacgcggtctgggcgcccagtcgccccctcttcaggccaagagggcgctgcattgaagggctccggtcccctcgccctgtgaaagatcagcaaacaggtggccttgcctggagagagaccgagttaagccaccgattaggaaccaactcttaagctttcaaggcaagagaataatgtgacttcagactcttgggtttagttaaaaacgcacctgccacctaggggccaggtggcaccgctgtcggggcaagtgtcacatcaagtggcccttatgtgggtccctatgtctagaaggataggatttatggttgctagaactttgatcctggaaaaattgatttgcaaacgaagataggactttcacttaaaatccatttccgtcggtggctcacgcctgtactcccggcgcttggggagaccgaggcgggaggatcgcttgaggccaagagttcgagaccagcctggaaaacatagcaagacctcatctctataaaacccatcgcattttctagaaacgcagttgtgcagatttggtgctcaattgttttacagttccatgcaaagcgtctttccccagatgttggtacaaattgtgaaatgctattcaccaactgaactcttaaccagtgacatctgctgtaactgttttctttgagattaataaatggacctttttcct

SEQ ID NO: 4443 - DNA, 864 bp, Homo sapiens
gcgcgacccgcgctgcgtccccgccggcgccacgttcccgcgtccttccccgcccgggccacggggcacgtccctccccgccccccacttacctgtggctgccgcctcgccgctctccggggcgggaacttccactcccccctcccaggtgaagtcactgctcctgctgtttgacatattttccatgtagaagatatggacctggaaatcatgctgacagttggagtaagccatttctaatcccatgccagaaccgaaggctaatggccacactcgtcttttaaagaagaatcccacaggatgagatgaagaatatcatgtagccatctcagcttatttcacatcgtttgaagcctgctcttagccagaggtcttctgtctttgtgattcttcagaatggcccactgcagtccccacaaggctggttacatgttataagccacgtagatggggtctaactggtcagctaggaagctatcacggaggtgcatcctctgcttctctcctctggagttgatcgggatgacacctgggtccaccacaaccacgacgccaacgatgaggtaatgctcttccaggaccacgttggtcactaatgggaccagatctagggcttcctgttcagagccgcacagttccacaaccaccacaagcaagttggtccatgtgaacacggcactgaaatttcaatgacaattcattaacttgtcactacatttttcagttatcttttatagcatctgtcccagacttagcccatttccccgccttctcccctcaatcccaaccagaacgtcagcagtcatgtctaccatatatgacacctttcaattttacctgataagactgagggaaaaattatat

SEQ ID NO: 4444 - DNA, 578 bp, Homo sapiens
atgggtgcatacaagtacatcctggagctatggagaaagaagcagtctgatgtcatgcgctttcttctgagggtccgctgctggcagtaccgccagctatctgctctccacagggctccccgccccacccggcctgataaagtgcaccgactgggctacaaacaaggccatggtggctgaaaacgcccagttcctaagggtgcaacttacagcaagcctgtccatcatggtgttaaccagctaaagtttgctcgaagccttcagtccgttgcagaggagcgagctggacgccaccatggggctctgagcgtcctgaattcttacagggttggtgaagattccacataaaaattttctgaggttgtcctcattgatccattccataaagctatcagaagaaatcctgacacccaatggatcatcaaaccactccacaagcacagggagatgcgtgggctgacatctgaaggctgaaagagccctgggcttggaaagggccataagttccaccacactgttggtggttctcgccgggcagcttagagaaggcgcaatactctccagctccaccgttaccg

SEQ ID NO: 4445 - DNA, 1236 bp, Homo sapiens
tggatcgatgatgacttccatatatacattccttggaaagctgaacaaaatgagtgaaaactctatactgtcatcctcgtcgaactgaggtccagcacattactccaacaggggctagacagagaaggccaacatccgtttgttgacatgggttatatcaaggcgtctgttcaggcttagaatgtggtctcttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgggttctcaggtcccacggaggaaaacagatctgtgtggttgagaggtgggtacaaggccgcatctttgtcatttgttggctaactttgtccttggttgaggacattagagttttggtcaccaggcatagcctatgtgcctttgtgcccgtgttgtatcccacgtgttttgaggacatgtattttgcacgtaaaggtgagctcctgctccaagctggttctgataccaaaggagtccctggcttatcctaaactcatggtaggttaaagccttcctccttaggggttcagggccgcaaggcttttgtgagtggcattgcaggcgttgaagcagtgatgttgagagggatggtcaatgtcagtgctctttagcaggatggtgtactgcaggggcccccagccccgagacgagcatccctgcatccatgcatttctgcctccatgaacaggggaggccagagacaggcagatagtagataaattgcaggggactggatgacatggccctcgtgacctgtgcacctgtctgtctttctgaagcacgcctgtgttaactctgcacctcccaggtagcactggcatggagggcaggcacatgttggtgagggacaattgttaccttgtgtgagctgcggagataccaggaagcccctggacacaaatggcaaaggctccttcggaagttgttggatcccttctgaatgtaagcacttctttcccagagcactctgagtttcctcatttgcagggacaaatactgtgcgtggatcgatgatgacttccacatatacattccttggaaagctgaacaaaatgagtgaaaactctataccgtcatcctcgtcgaactgaggtcca

SEQ ID NO: 4446 - DNA, 3455 bp, Homo sapiens
gatcctcctgtctcagcctcccaagtagctgggaccaccatgcccagctaatttttgtattttttgtagagacagggtttctccatgttgcccaagttggtctcaaactcctgacctcaagtgatccacccaccttggcctcccaaactgctgggattacaggcgtgagccactctgcccggcctgtgcatattttcttcactgacgctgtttccaagtcacagaggccttcacacgtgtctgggagggttttgcccgggcacttgcaggggtggggtgggaggagcatttctacccgtggccccttcttctgcttaaacacacggcagatccagaaatttctctccagcagaatgcagcccctcaaggatgggggccttggttacatcggtttttatgtttaacttccacccagagcttggcgtttcaggggagcctgagttgaaggcacaaatgcgtgacagttcctgctctgccctttacaagctgtgtgaccttgggcaagttactgaacctctctgtgcctcagtcaatagggatgatgacggcaccccttgcagaccttttggaaggcttaactggatgagtcaccctaagcattcggagcagtgtgggtgggggcgctctgggtggaggagaccagctctaggcgagggtgcctggactccctcatggctgcctctctctccaggccccgccacctctgttcagccagctctgggagacttggattgcatttggctattggagagtgtcaccccatcttttaaagctgcagggaagtgaaggaatcatcctctctagtccttttgtttggaaactgagcccagagaccacaagcaaactggctggggtcacacagctgctgggtcagtcacagagctgggggcaaccgtgggcatcctggtctatcgagtgggtcattgtggtggctgccgcctacctaaccaaacctggtcccacgggccagctctcactgtggggcagccagctggagggacggggccagcttgccccaccccgcccctcccctccacagcagagagtgccctggctccatggggcccagcacaagctctggaggccacaggagtgcctcccctccagggcctggcaaggctggctctctgcagggctggtcaggtcagctgccttgatttccctctcccaggggcctgatgtcatcattcaggggcagcctggggacttgagggaggatgcagttcccactgccttctcccgtcctcccctccccttcccttgcttctccttctccttcctgcttccacgtcctgaccccctggccctccccagcccggccccttagcctcccctccctcccggcccctcactccccccctaccagggctgccctgtgctagcgcctgcctgtgtgaatgtctaatctccaattttattcgctgggctccagcccatttgcataatccacacagtcaccctggttttaattgcccacaactctgcagaaagatcatgtggttaagtggtaaatcataattagataaataattggtttggccacagcaagctgcttttgttacacctgccatctgctggacccgttttttcttctggccagaacaatgcggttctgatgacagagcatgctgcttctctcttctgggggggccggagggggctgaatggaggggctcggaagcagtgcctggaaaattgcccggttgctggggtccgcgcctggcctgcgcttctttctctccaagcgggcacaccacacactcgccattcattacccggcttggttaatgcatcagagtggcaaatttgacttctttgcagaaaagggagggaggaaaggggcctggaggaggagggggaccagccagggctgcccaaggcctggcctgcctgccggttgtcggtggccccgatgggccagggcaggaggcctgctgtggagggcctgggcccgatccctggggggttggggggggggggcggaggggacaggcgggcaggggttggaaccgccagacctccctgccccaccgcggtcagcttctccatctgctctccaccgaagcctcctttattttccatgccccaggccccatctgtgagccctgagtctccaggggaattgtggctccctggctggacggtcgcctggccagggccttccttggggctgctggcctgcctttcatgctgtccttccagcaagctcttagctcctagacttcaggaacggtttcaaattgtccttccttcactcgctccctcacgcatacacgcacacattcattcattcagcaaacgcccgtggagcctcttcctacatcagagtgcaggttcgaacttggtctccgtgggtcagatggccgctgtgggatgtgagcaagtttctcagcctctcagagcaggtttcttcctctgtaacacaggagtcattattgtccctgccttctgggcctattaggaggatcaaaggacagaatgtggataaagtctgtcgagtgacacctgcacgaaacacaggcccagtgtctgtggctggtgagtgcgtgactgctggtcatgcccgctcccggggagggcgccagcgccgctcaccttgggcatcattggaggcccacgaggctgtgctgaacatgctgaaggaagaggtaccagtgccatgggaagggcccaggaatgaggagccttggaaagaaaccagggggccaggggaacaggcagaggggcggtaaggaagggcaggttctctggggcctgcacaggccaggacgttcctgtctctgttgagttcggactggcaggttctctggagcccacacaggccaggacgttcctgtctctgttgagtacagaccggcaggttctctggggcccgcacaggctgggacattcctgtctctctcgagtacagaccagcacatggtcctgctctctggcccctgcatcccctccagactgcgttctggaagccctgcccaggcctcacacgctgccccaagggtctttattacctggggtcttctagcattttcctctggagaaactcaggaagcatcctttctctgcatcctttctctttgggggcccagcttctccttttcagtttgacagacacagcctgaatgcccaaggcccctctgcggagacttagagacttaggctggtggagagggttgtgcctcctggctgagaacccctcagggcagatagctggctcagagtcctcatggtcttgttgatcaggaaacactggtatgttccttcctgaaaaccctctgatgcctgttgaggagcctctaggacacgttccatgtggttgggactttgtaatgccagatcttttctgtgttttaacattcctccatccatcatctacccatctacctttcatctatttctctccctccctcccttccttcctcccatccactcacccacccattcattcatgcacc

SEQ ID NO: 4447 - DNA, 4929 bp, Homo sapiens
atggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggattgcttgagcccaggagtctgaggtttgcagtgagctatgattgtgccactgcactccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctgagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggaatagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgagctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaac

SEQ ID NO: 4448 - DNA, 435 bp, Homo sapiens
atggtgggtcggaacagtgccatcgccgccggtgcatgcgggaccctttttattgcgtactgcatctactttgaccacaaaagatgaagtgaccccaacttcaagaacaggcttcgagaatgaagaaagaaacagaagcttgccaaggagagagctgggctttccaagttacctgaccttaaagatgctgaagctgttcagaagttcttctttgaagaaatacagcttggtgaagagttactagctcaaggtgaatatgagaagggtgtagaccatctgacaaatgcaattgctgtgtgtggacagccacagcagttactgcaggtcttacagcaaactcttccaccaccagtgttccagatgcttctgactaagatcccaacaattagtcagagaattgtaagtactcacagcttggctgaagatgatgtggaa

SEQ ID NO: 4449 - DNA, 927 bp, Homo sapiens
agttatactcagagatgagaaagacgacaatgggcaaattccgggagtccggggcagggagaaaggggaccttaaggatctccagccgtcccgccccgcccactcgagcagtccctacccgcctcccaagacgcctgggaagagcagtggaaccagggagagcacgaacagcaaagaggtcagacatggggaatccgggcacccaggctccgggaagacggcgcacggaaacgcaggggagcctgcaccggctgacggcggcggaaaagggcgaacgaagcgcctgagggccctggcagcactcaccagggtcgttccagcccagggcagggcccgcggtcagcagaaacaaatgcaagccgaggagcaagcagtacccggccgctcccggcccgcaggctgcggccatggcgctcgatgaagatggcgccgggctgccagacgcctacgggccgaacctgggtgcggtagcgcgcgcgacgctgcgcagctacaccgctacccctggcggcggcgaaggaacggcccgactgcagagctgcagccgcaacggatccgtgcgccaaccctacgtcactgccgctgcggcccgtggggctcagtgagtggccgccgtgggcccccgcccctggagcacagcgcggcttggggcggggcgaggcggtgtgggcggggccaagggcctggggaggcacggctggaggcgggttggaggcgtggcgccgcggtgtgggcggggccgagggcctgtcgccgccgcgcccgcgggcggggcgagggcagcgcgcagctttgttgtgtctcgtctgagattcgggaagcttctgtgcgtaggcgatgcagtttgagaggctgaaaacgtcacgacgcgaaatctaagaaatgtagtcaaattatgtattattaaaacctcaataattgtaccaa

SEQ ID NO: 4450 - DNA, 5006 bp, Homo sapiens
gcccatcacggaaacccgagtgaaggctgagtgccccatgagggacccgggctctgacacagacagactgtcccggctggagtccagctcctggacgacctgggtctccccgttctgcactggtatcgcgcggtgaggcggcgctgatcagaacctcaaaagacctgaccccgaacaccgtcatcccaaatcctgagctcctgaaagatcaaaacctaacatgttggtgttctgaccagtttctctgtgaatggttcatctgcacataactcatatccacgtgactgaatgagcacacctgtgtgtctgtgctggagaaaatgttatgatcaccgactttattgggatgtcagcattcagaactgtgtcccaggatcgtggcccagacccacagggcaggggcgtgcacttttgagggttctgaagacgactcaacagggtgcctgacctgctggtaaggactcaggagacctcacctgtcctcgtcacactcatggaaggggactccagatccctggcgtagctggtctgggaactggggagggatgggcagtgcccggtatagggtgcaacctccagtgcccacattagcacgtctgttgctgtgagattctatcctgtggacacctgtggctgtaacacacaccttcccactgctgtcacaggagtgatactctttccgattctaacatcagtgtgtgcacattttgggaaaaccagcaagtacagaagaagaatttaggccgggcccagtggctcacgcctggaatcccagcacttcgggaagtcaaggcaggaggatcgctggaggccaggagtttgagatcagcccgggcaacatagtgagacctcatctctatttaagaaagaaaaagaccactggtcctcccagtgtttacaagatttttccattaaaacaggagggatcataatgagcggcctaacaaagacatttaaagacacgccaagaaggggcgcagacaggagtcctgagatgcagtcatgggaacccgcacctgttttcccgccctgggcacccagcgtggacaggctggccggtgccagggtgagcagggcaggctgaggtctccagtgggtggggacaggttagggggcagcaattcagtgaccctgtccaggactgggtcccttgcagaaggtgaggtcagccaggggtgggggtggtggctgtggaatccgttgtctggtctatagggggtccccctaccgaagccctaaccctctccccttcaccaccccagtgatctcctggcccaggctgctgcctccagcagctccccagcccccaggacagtccttcaggactctagggggagtcccgtctacaaggacggctcaccagtctcccgccacagccagtgaggatggggtcctgcagccgaagtggtgtgtgcccagtgtggtgtccctggcaggctgggagggtgcccccagctgccagttagtgaggctgggttagcacgagggcaaggagcttggattctggggctgacagcctgagctcaactccagcgccccatcttgctggggctcctccgcctggaggcggctcctccacctgcctctgcctccgtttctgcagcagttgcctgccggactccagcccgaggcgggggccacggctgacccagctggagaacgccccactggcccagtcagtgctgtcctctgcacctgatggcttctcttggcagggagggctcccccgcccccgggctctgtgccagccagaggttccgcaggagctgctcacttcctcccgccggcagaggcagcctgcggggcggctccaacctggagaaaccaaaatcagggcaagtccctggctgcttccctggaaagccccgacggagtccccgctccttcccgccggttctcagggtgctttatttcagaaggggatttcttcctcctgagaatctgatggccacagggtgcctgtcacatgtccacatcgggccctcctggctgtcaccaacttgtccaactgtcagaggtgtttgaaccagagcgactccgtcttgaataggggctgggtggaatgaggctggggcctgctggactgcgttcccgggagggtaaggcattcttagtcacaagacaggaggttggcacaagatacaagtcacgaagaccttgccgataaagcaggttgcagtaaagaagtggccaaatcccaccaaaaccaagatggtgactagagtgacctctggtcgtgctcgccactcattatacacaaattctaatgcattagctgctaagagacactcccaccagcgccatgtccacaaatgccatggcaacgtccgaaagttaccctgcacggtctaaaaaggagaggaagcctcagttctgggaattgaccaccctttcccagaaaattcatgaataatccactccttgtttaacatataatcaagaaatgaccaaaataagcataagaatattcagctgagcagcccagccctccgcactgcctctggagtagccattctttattcctttactctattaataaacttctcacttgactctctggactcaccctgaactccttcctgtgtgaggtccaagaaccctctcttggtgtctggatcaggactcctttctggccttgcttgggatgaaggtcactgcacaccagatgtctgcacgtaccggagcagagcggggccgcctggagccccttcccaccaaccagagctgcggccaggcagggtggaaatgcaggctgtggggagacgaaggtcaagtcccagaacatggacgtgtcccgggctcctggctggtgggggcctggtccctggcggggaaaagcagcagtgcaggagccagggctgtctgcagggaaccagccaggtaactgggtagaaactctgccctcatgcatcagacacgctcctggttccctgcaatcggacctgtcactacaaacagaccaagctttccagatgccagtggtggtgggaaagctgacaacactccctacagcaggatgacggaggacacagcctgctctataacgtcaaagtggcctctgggtccttgtcccagggcagaaacagactcctaagtgtgaacggaaaacagaggattattaaaattgtcacctaatgcagaagccctgctacgcccttaggtggtcaaggctgatttcttacccatccacgaccgcaaaggaaaccgttctttgttggggtcgaagagcatgaaccctctttagaatggatagtgttggccaggcacggtggctcacgcctataatcccagcactttgggaggccgaggcgggccgatcacctgaggtcaggagttcaagaccagcctggccaatatgatgaaaccccgtctccactaaaaatacaaaaattagccgggcatggtggcatgtgactgtagtcccagctactcaggaggctgagacaggagaattgcttgaacctgggaggaggagcttgcagtgagccgagatcgagccactgcactccagcctgtgtgtcagagtgagacatcatctcaaaaacaaaacaaaacaaaaaaaccaagatggatcgtgtccatgtctgcaccaccacacatcaaacaatccaacaggtggaactgtgcagacttccccacactcaatgtcctctttccaatgtcgctgttcgctatctgtggatgtccctaaatggcctcagaagtttccattagaagaaattagagatattgtaggttttaagtcattgagcaatcacttactaattacaagtcacttatttattagacaaaaatgaacattttatgtgcacaaagatagtatcataagaggtgtggcgttttgccattggaacctgggcatacggtcatttgtcctgcagtttctcgtgtactgaaaggtggcgtggatcctacagtttctcgtgtactgaaaagcggtgtggatcctacagcttctctactgaaaggtggcgtggatcctacagcttctcgtgtacggaaaggcggtgtggatcctacagcttctctactgaaaggtggcgtggatcctacagtttctcatgtacggaaaggcggcgtggatcctcagcttctcgtgtaccgaaaggcggcgtggagcagcacaaggagcttgagcgttgcaatgagaagtcatggctgtgaatcccaccccatcacgttttgaatgttgggcaaattaattaatcgttttatccacttactaggcgatgtatagtttgtatacttcatgccagtcattgttttagactcttaagatgcaaagataaataagaaagttgctttgggcaaagagtgagacctttttcttaaaaaaacaaaacaaaagaattaccatgtgatgagcacttctccttctgggtgcatacccagtgctctgagctacagcgtctaacgttcaagccagcttctcaatcggaccccaggatcctttctagagagaaatcctgtccacgtcgccctcctagctggcacggctgcaggcaccagtgtcgtggcagcgggaaggggaggacgggcttggtgaaaggggactggggcctcctcactcctggggctgccagctccctcaccctgaaatcagacccacgcccgccctgcacttcctgagtgtttcctgagaccaagggatcagagcttcggctgtgaggggcggtgctgtgccctgggacacacggagccacagcctccgcttccagggtgccctggggcctctctccacgtctccctaggggcaaccgccacaactactctgtgtcgtgtgtcctgcgccgtccatccgacccctcgcaactcatcccaagcctggggggctctgggggacagggcaggtggggccatgtgaccaggagaacctgctggtgtctccggcctccactgggtgccccaggactgtggtcagcagggtggagcccctgatgcagcttcactgcctgctgcagccagagggggatggggtcccacccacagcccctcctccggagccc

SEQ ID NO: 4451 - DNA, 6392 bp, Homo sapiens
ggcagctctgagacctgaagcctcagaaccagctctcctcctcctcttcctcctcaagatggacctcaactcactgaactctggttcactcttttggtcccagagctaattctttggttgtttaaggtttagcataggagaccccaaagcagcaaggttctggccctggttctgccacttgccagctccacgccctcagatcagtggcttcagagcctcaacgtgctcagctgtgaaacagggacagggtgaggccttcccaggtatgatccactgtgcccatcctggatgcagactttaagcagagtcacatcaacaagaagagctgtgaaggtcagggcatgacccacagatgcccaaacactgcactggaggtccaggaagattctgctgacaacgcaaccctgagccaagatctgaaggataagagggagcttataacatggaagaaggaacagtattcctggcaagtggaacagcatgtgcaaaggtcaggtggtaagaggggcttcaaggacagtcctatggctggagcagagtgattgagggcatgtgaaatgagaggtggccagggtggcaggcagggactagcccaatggccgtgaaagggatgggactttggtcactgtttcgcatttccagatgtttactatgtgccaggcttggtactaaatgcttttctggaatatctcactagattctcacatagatgaagggcttgatcttagagaggttagatccctcagccgagagcccacagtgaggaagccatggggcctgtgtccctgactgcaagacctgtgctcagaacggccaggccacacagacctcaactctcactacaacctcctgaagtcggtgtggttactcttcccactttacagatgaggacatgggcccagagaggttatgtgagtgacacagcttgaaggtggagttaagcctgggcagtctggcttcagagtgtccacagtctcaaccactgcctcacatggcttcttagaaaatattataaaaagaagctcgggctgccatgtggaaaagaatggagaggggacaatgacacagctgggagcatgctgtgatggtgtacagcggacacattcaggatgaggtgaaacaggctggccctggtgagaggctagatggggctgggatgagggtggagacaagtagtcttggggttggcttggtgcagctggggggtgcggggagtgtctctgaggtgaggccgggggtatgggaacgccatgtttggtctgggacacggtgggcttgggatggctacaggacagtgcagtggagagtcaaaaaggctgctcggacccaggtctggcgagatggaagctggaggtcaggtgagctgtctaggagagggacagagtgggaaggagagggtctcgactcggctttcttgccaaaggagggttccgaaatgagaaactgtggaatctaagctggagaggaagaaagacggagaatgagtgaacgcacacgtgtgggacagatagatgaatattcatgtctttggctcctatgtacctgagtcttctaaagctgcaggccatactacccccgggaggctgcagggatgccagctgggagatgaatgcaactctgctgcctgggcatgggcctgagtgagggtgcagacccctgcctgtgatcatcagggagggtgatgagaacaaggtggctgacagggtgaggcccaagcctggagcttacccaggtgcggggatgggagggtcagagacctttggggggtcttagggagcttccccagccctaaaggcaccgcaagctgccacttcacactgacctgggcatacgcagctgcaggatcccttgctcgctctctcacaagcaaatgtagactgcgcaaccatcctgaccacagatccagaaagcccaggacataacagagccgcagtgcctgccctgatccacgcgcacacagatctagcccaggaacaagcccatccacggtgaggaacttgtggcccagtggctggagcctctcacctgagccctcactgcctgaggacccccagcctctggcctcatttcccaccctttgccagccagccttggggacaaaacaggtctggatctaatccaaggtctggactcaccctgacaccctgtgaactcaaggccttccctacctcaccctgggcccagagcccctacctgtaaagtggaagtgggaatggccaccagccaggcagaaaccctcacttagggcctcatggccaggcatcaggacagtcaggagaggggccgaggtaagccacagaggccctgcctgtcttggtatcccaccatcgccaggaggggactgcatgggcatcacacccctcacagatgaacaaagtgaggcagagaagggcctcaagatgagttaggggcgaggccccagctctgctgctgccccttcccttatcacccctgcagcctgggatgcgagggtggccagtgacagaccccaaggactctaggctaaggtctccttacctgcgttctgtggcctgctccccgcctgcatgccgcctcatgggggtcctctggctggcccaggagcacggttggcccagcagagcagctcagtgttatggggaagggaggcccagcccaccacgccgaccgcctggggccctatgtatatttaatgatgtctattattcctgttttgtctctggaaaggagtgagcagctgacaggggagccacgaacagcctggagagctgagcatgggcctgctccacactccagcggggcccgaggcccccgggaactctacccctcctggcagcctcacagaacctgctgcatccatctcaaaaggcatacctcctccaggaagccttccccgctgctcagaggtcttaaatccggggtctgcactcacaaactgtgcagcctacaccagcttctgggggacagcagaacactgtggggggcctggcacagtccctggcacacggtaggcactcatcgagcccctgccagcccctctactcctgacttctgaggcaacaggaaatgacccgccaccttgttctcacagagcctccctgccagcccagatggtcacaagggcctcctgggatgctgcccaccttggcagccaggcccctccggaggggccagtctgggcctgacacccccgaacaccaaccccctgggcagagcctgcctgtgcctgggtgaggaaccctgcagtctccttgccacacaaggcctgggtctgccttggggcccaggctgcaccctctccgacccccaggcccaatgtctgacctgtgcccacctgactcaacctggctactgttcagcaagtttacaaagtgttctcagtctgaacaggaaccgttttcaatcctttatttcagaaaggagagccaggagaactggggacttagaaaatacagatcctaaactcaaaagtccctgccccaggcgtgcagagccagggtcctggggttttgtgctgggcaggggctgccctgggagggggaatacagggggaggcactttaggacaccccttaggctgtggagggtgtcagctgggcctttgaagccactaaccactggttcccatcatggagagccctgtgtggggcacccaagggggtttcctcctggaagggcccccaacccaagtgtcagagaagctggcaagagctgagggagtgaggtgccatgacagcagccacagcctccagggacccaaacaggcccagctaccagcctggcactgagcatgccatctgctttaggccctggctggcgggcatgtgggcaacttgctccctcagtgcagggggctgggaggcacagatgcaggctcagcactacaaactcaaaacccccatgagagggctcagtcttatgggaaatgcctccaaccgagcccctttgccccaacacactcttcgtctgcctactgaagaaacttctgtaaatagcagagacttgagggaccccttcctggggtacgtgtatttgtatttttctgtttgggtgtttgtgtgtcccagtgggaccacctccccagggagacgaggcaggtgggcgggaggcccggcaggcgccgttacttcttcacgatctggatgacgtcctcatgctccatggtgtgggtcaggcccacccgctgcggactgtacttggtgctggtgccctgggtgaggaatgggggcagaggggtcacctcagcctggactggccaaggtcaaggaagatatccctgggcgtgtgtgtcctgaagggtaaatgccatggcataaggtgggggcctcaggcagcaggatgtccgcagttgtctgaccatccctgatctcaaaggttggggagggccaggcacagtggctaatgcctgtaatcccagcacttctggaggtcaaggtgggaggatcacttgagctcaggtgtttgagacagcctgggccagatagcgaaaccttgtctccatgaaaaattagccaggcatggtggtgtgtgcctgtagtcccagctacttgtgatgctgaggtgggaggatcgcttttgcacagatgtcgaggctgcactgggccatgatcgtgccactgcactccagcgtgggagacagagccagaccctgtctcaaaaaaaaaaaaaaaaaaaaaccagaaaaaaaaaagggtggggaaggcccatgtctaccctgggttggcatgtacattctatggaggacagacacacagacatgccaatccccacaggaaggacaggaacaccacgcagagagtgtgaatgccttgcttcatgcctaacccaggggctgtcctgggtctacccccctggttgctttccacccagagactcacccacaccagggcgtacttgaactggctggcgagtgaccggtggatgcggtggcactggaggacaggagagagtcaggtagagaggtcttccaggccctggtgggagacccaacacctcagcccagcgtccctggggcggaggccggcgccaggcctgcaggaacacttccttgacacagatgggaaggtggctgactctggtctgcagatgggttttgttttactcagcttgcccagcattgccacttgtgagtgactgaagggattcaggagggtaatcgtgagtctccttggctcctcctgctgtgatctcaagcctaggccctgagggagatgggactttgcctggcctcctttgtttaacacctctagggtggcactcagagacctggggctgggcttgcggaatgaatgaatgcatgagaccagattacaggccctgccaccactgtcctaaggggctgcagggacagctgggtctacagcatcccttgcctccaggatacagatcccaagaagaaatgagctagaggaaaacaacaccaggaaagcatcagcccaggaggacggccatgtgacctgaaggttggccaccatctgtgcctgcagggtcatgttcaggtgacagaatcctggacagggaaaggcagcctcttgctccctgagcccagaccacctcccctggggcctgtgcatgcctgctcccctacctgggatgctccccaccccaactcttcactgccagacccactagtcctataagccggctcaggttgcctccttgaagccgctgtcctgacctctgtgttaagctggtgccactccctactctccttgactgatgcctgaatggcatggaagcagggttactggcatctctgcaaagccaggcagcatgctgagtgccctacacactggacctcattcaacgtgtcctcctgactatccagggggcaggcagcacacccccctcacagtagaggtcagagcctcggcacatggctaagaaggggtgctgcagacgcagccccaggctgtccaactccagagcctgcgttgacatctgagagtgagaccagcagagcccacccccagcccagggcacctcaggcagaacagagccccaaagggcatgcagagctcccaccccttgtcacggcaggtcttgtcaactcaccacgtgctccactgaggcccctttccggagaatgatggcgtctgtgaagtctggcctctctgcagggcaggatggggagaacgtcagccacacatcagggcccacactgccatcttgtgattctgcgcgagggaagagctggccacagaggccctttcggtctccttgccttggcctaacctccccctgacatccagcacaccctccacatagatccctgtaccatcttctacgaccttgatcttaacacagtgactcaaaataaatcacgtctaggattcacagtgcctgccacccatctgctgtgacagcactgacagagaccaggacctggactgaacgggcagggcgcaaagggat

SEQ ID NO: 4452 - DNA, 2555 bp, Homo sapiens
gagcgggaccagccgcggtgtcggcgaagggcgtcgaggtcctcgccgcccccaagaagccgtacctcgagggccgcgcccgtcgggcctccgcttctcccggcccgggggtcgcgtcccggccgcccctctcactcgtccctccggccctggtggcggtgagggagcccggcccgggcggctgtctgccgggaactgagggacgaggtggcggcggctctcagaggcaccgcgagagaagggctaccctggctactgtggggattagcacccgccgcggccgcgaactggcccccatcaccgccgacctgccccggccgccatgttgggaggaaacgacgcgtcacgcagcggccgaacggctgcagacgaggaagcggcggcggcggcggcggcggcggcgctccctgcccagagctgccgcggcgccgggaggctgggggcggagggcggcgcgggaggagcggcccgagccgcagcgctacggcggcccggcggggcctccagcgttcgcctgcagggcggcgtggggcgtggcgggcctctggtggcaccgcgcccagcacttcgggctcttggtggcggccgagctgcgggaccagagatccccccactcggcacccctgctcctgccgagtgaacaggactcctggctactctgcactggctttctaactttctgatgggggtgcagtcctttgcattccaggggtcacagcaacacccgcatcgcccgttctcagccgcagggtctccgcctgcatcactcgactctaaaatttccttccctagtgcacggaactgctgtccaggactctgctctccgactacctcagggaggattctgttttgggaaaatgacattatccaccccatcttgaaatcctagagccatttctacaaggttcattactccacttcattaagcaacaggtcctgccagctaaagtcttaaaaaaaaaaaatagcagtagcaagtgacagttttagcaacacttcctaactccagtctgtgacacgcccatgaactttccacattaagaggaagtggtagggtggaaaattctaaccttttcgaaactttgggactctataaaaattcctgtgtgggagaagaagctggagaagaaatccttgatctgtaacttaatatatgtgtatattttatgtgtacatattggcctgcctacctgcatgttataaagcacgacatcctacatgccacagagatgcatctcacagaggctaagacaaggtaccagtcctcaaaaagctgacagcagaggcagaaggaagaagcaaacacaaaaaacagtaactaattgtgaagcaggatgaaataagtgataacaaagaggcaagagtgacgtgtggtgggttctgactgatgggaggttttatatagcagcaccaagtaccatacagattccaggttcaaacgcacacacaacaggaagatgagaaagcttaagactcaaaatggaatggattagataatataatatatacgaaagtcctggcagatggcttcacttattgttgtaagaaggagttagcatttgatttgagctctgaaggataaaagaattttaagtgaggagaagggtgttccaggctgaggaaacaaggtagagacagagttgacagtttgagtctcgggagtaaggtggggaatgaagagttgatggggtgctagcaaacagtgcctggagagagaaaacaggagtctgaaagctatgctagacaaagcaccaagagctttgtgtaacaggctgcggagctgggaggaaatgaagaaaagaaaaaggtggttattcaatctccgcattcagacacatcaccaccaccttctctctggtccacctgaactggtcagagataaccaaaggaggataaggaaatcaacgtgttgcaacaacaaggacatctttgtagcactgcagtgtcctaattgtgactaattgtgaaacagttcatcacctctgctcacccagacccctctcctatcagcaccaccacctcttccaccaatccccacagtattaactccacttccactctgtccgacatcacccccctcaacccttctgctccgcctcttcaatctggaccagcagcagcccctactgccagaacgacaccacagccacccagcatggcagagcaagcttgcacagggaaggtatgctaggaaatggctgcacactgtcccactagggaattccatcctctgccaactaaggaattccatggaaaagattcacgtcagtggacagatccagatggtgcctggtactctgcaggtcctcaataactttctgttaaattgggtcttaattgtttgtgagttattgattataataagtccaatttctcaataaatggagttagacatcaaggagcaactgtggtattgtcaaatgtgagcctaaaagctcaatactttctaccgcggccctcactaccattttagtattatgttcaaaaataagcatgagatttccccagttataaagataacgcatatacattatgtaaaatttggaacatatcca

SEQ ID NO: 4453 - DNA, 2800 bp, Homo sapiens
ccctccccctgcaaatgatgcaccaaagggagggctgtccaagtaaggctccatcctaataaaactgtccatgatacaaaaagcacaccaaagtacccaagggagcggactcagtaaaagggattatcaggtatattcacgttactggttgggggacttctactaaaataccaattagaataattgctctatatcccttatttatagcgatacttgactagcagaatcagttctatgttcaagacactcccaatttgtgaaaataaatccattttgtttgcatccaaaataatgcttttttttttgttctctctgtgtcgagaggctacagagttcattcaaaaaaggtattaagccaggtgtggtggcttgcacctataatcacagcattttgggaggccaaagcaaggggactgcttgagcccaggagctcaagaccagcctggggaacataggcagaccccgtctctacaaaaaataaaaaaattaactgggcttggtggtgtgtacctgtggtcccagctactcaggaggctgaggtgggaggatcacttgagcccaggtggttgaggctgcagtgagccatgatcatgccaccgcactccagcctgggcaacagagtgagatcccatctctaaaggaaaaaaaaaaaaaagagagagagcggaattaaagccaggtgcagtggctcctgcctgtaatcccagctattcgggaggctgaggtgggaggattacttgaggccagaagtttcaggttgcagtgagctacaatcatgtgctgtactactccagcctgggtgacagagtgagatgtgagactccatctctttaaaaaaaaaaaaaaaaaccaggctgggcgcagtggctcacacctgtaatcccagcactttgggaggcggaggcaggtggatcacaacatcagaagttcgagaccagcctgaccaacatagtgaaactaaaattagtttctactaaaaaacacgtctctactaaaaatacaaaaaattagctaggcatggtggcgggtgcctgtaatcccagctactcgggaggctgaggcaggagaatcgcttgaacctgggaggtggaggttgcagtgagctgagatcacgtcactgcactccagcctgggcaacagtgcgagactccgtctcaaaaaaaaaaaaaaaaaaaacccagcctgtgtgacgtggtgagaccctgtccctactaaaaatacaaaaattatccaggcgtggtgttgcccacccatagtgccagctactcaggaggctgaggtaggaggatcacctgagctatgggaggtcgaggctgcagtgagccatgattgtgtcactgcactccagtctgggccacagagtgagataccatctcaaaaaaaaaaaaagtattatgtatttaaacaaatatgaaaaaggaggtagcccaggacacatccctgatttacccactagaaattaattactgacggggcacggtagcccatgcctgtaatcccagcactttaaggggctgaggcagtggattgcttaagctcaggagtttgagactagcctgagcaacatggcaaaaccctgtctctacaaaaattaaaaaaatacaaaaattacccgggccctctcattcacagcttctcaggtaaaaaaaaaaaaagaaaaagaaaaagaaaaaaaaaatagctggaggctgggtgcggtggctcatgccacacctgtaatcccacactttgggaggccaatgcaggcagatcacttgaggccaagagttctagactaccctggccaacatggtgaaaccccatctctactaaaaatacaaacattagccaggtgtggtggcacacgcctgtagtcccagctcctcgggaggctgaggtaggataattgcttgaacctgggaggcagaggttgcagtgagccgagattgcaccactgcactccagcctgggcgatagagtgagacttcatctaaaaaaataaaaataataataataataataatgataataataatagccaggcgtggtggcacatgcctgttgtcccagttactcaggaggctgaggtgggaggattgcttgagcccgggaggtcgaggcttcagtgagctgtgattttgccactgcactccagtggcacaagagagcaagagagcaagagggcaagaccctgtctcaaaataaaataaaataaagaaagaaattatttgccatgcctgctagccctgattcttgatattgcttgatattgtcatgagggttctatgtgggcatgaatagctaaggctctttattgaacatgggcagctttgtcattaatcaagtctgggtcggggcaaaggcgaagaaaatgttttaaatgattcatttttttttaattttatttttatttttattttattttattttatttttgagacagagtcttgctctgtcgccacgctggagtgcagtcccgggtttaagcaattctcctgcctcagccttccgagtagctgggactacaggtgtgcaccaccacgttcagctaattttttgtatttttagtagagatgaggtttcgccatgttggccagaatggtctcgatctcttgacctcatgatccacccacctcagcctcccaaagtgttggggttacaggtgtgaaccactgcgcctggccttttatttttatttttacagagacaaagtctcactatgttgcccaggctggtcttgaacttctgagctcaagtgattttcccatctcggccctaggattacaggcgtgagcctccagccctggctattctaaatgat

SEQ ID NO: 4454 - DNA, 6707 bp, Homo sapiens
agactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagaggtaccggcgaccgctgtcggaggcgcggactcggggcagggccaggagtcgcccggaagcccggcggtgggaatgggtcaggccccaccgtggacatgccggttccctccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctggactggatggaggacctgaagacgtgaggtggaggcacaggtagaagagaagattctcaccatcgctgattcacacaaaagcatttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattgtggttttctgtctgaagagtatcccagtatgtacctgtggagcagcttctttatcccttcatctgtggataagcagtgcaggccaaggccccctgcccatggaggtgtgctgcagacagcagcagcagcagcagcagcagcagcagcagcagcagaggcctggcttcctgaggaattgctggccggtttgaggaaggaaggaagtcccacctaccatgatcaccctccagcctggaggaagctccatgccagcagcatggaccagcatgggagccagagccctgctaatgctgcagctcatcacccctgctcagcagcccagcagcccagcagccattgccacatcccatttccagggcctcctgcccccatgcccccacgtgcccatggaccgacacaccactcttcctgttggcccaaggtaggcatggagggaatttttcaagtccacttttagtaggtaagtcaaaaccaaacaaaataaccactcgacacctggtccaatgcccttccaaactcactcttttctctgacccttaaacacttgtcctgcatctcccagactccactgtaccttgatcagtaggtccctcttcactgcagtgtcttttttgcagagttcttttagctctttcatgcttttgctatgggcagaggaaagaaagaagggtaaatttgggaatcaggggagatttgtgagttccagtcccttttgtttgaaaacccagtgaatcccagcttactgggtgagagttttcagtggagtcctctgatcacaggggctccagaggaccagggtgggacctctcatgctcctcccctgggccccatctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaaggtgagtgaagctctggcaagaagagcctaggggatgtgcagggtccaggccagagatacagatgccgatcctgaaagccgatggaggagaagaggaagttccccatttttaaagagggaatccccaggcccaaccatagcttaccctggccaccttgatccagtgctccaccaccctggccctgtcccgggccctcatgctgtggtccccgaggcaggaggtggtgatgcagttggtgagcctgttgaagtgtgcgatggtggcacgaactgtgggtgccatgtgctcattccccttcagatgtccttggccccagatgcagcccaagcattcgtggagcaccaccttcttgaacagctcctttgggggaggaggagagtgtcacggacacagcacactgcagctcagagtcacccacagtcccaggcagggactgagctcacagtcatccacggtctctggcaggaaccaagctggagctcagaaagctttaaaatgggctccagacttgtgggagtccctgggtttggttttctgcccccgagggacctgaatgcatcatggcctagaacccaacaagggtgggaagagagagtgacattttctcccaggccatccacactctaagaactagaaggtggctcaggcctgcccatcctgaggcctcgtcttcctcccatcccaatcagccctctactactcctctccgtaccggtgcactttccttgtggcagctgcaactatgggctctgtttgggtgtctaccatagaatccagtatgcatcaggtacctaataagtgctgagggtagtgaggctcctgagcagctgggtgagtgacccatggccctgcctgccccacagtgagcacctgccctgccctgctttctgtccatctcctgtcactcagtctgcacagtcactctgtgcagctggcgctggtgatgtcccatctctgccgtccacatgcagacagggaaggcttgtgggtgaggaaactcatccagatcccacggttggtaagaagtggggctgaaattggaccgagggcattggctgctcctcagggagaggctggtctgagacagctggtgccagagacacagcctgcaaagctcagctgctcaccgcatccatgagggtcagctgctctgccagcagcctgggagggaaggtcgtcatgtcaggcagctcctcactgggttggttctttacagacccacgacagggacaggaggactctggggctgactgtggctccagcactgtccctggagggggcccttcccctggtgctggtgctggccctggtgctgaatgtagatatcctggtggacccagggctgcaggtgactctggctccagagcaggccccaggtccgccagcagtggtggtgctggctccagggccggcattgttaatgcgtgttgcccaggacgtggagcaggatctggaaaaggagaaaaggtcaccacaccagtcatttttcactgggttttccaagcacagaaatgaccgggtggaatttaagggaattgtagccccaaaacaccacccccggaaagtcttgcagactgcaagccccctcaccatctggcttggcctcgttgggctccggaagcaccaactggcctaggacaatttcctgatggtcctccaagcccagtccaggccaggagaggttcctgaaggccagctttatccggaaagatgaccgttgcgggggctgatagtaaactgaagtgttttcggggggccagttgaacaaaatggaggtgatggtgctggtgatggagtagacagctgagtcagaggcctggccttctcccacacaaccctccagggcacccctgcgtggttctgggtccctggcctgttgctgccagtgtggaggacagccccaccctaccgtaagccatcagtgctgtcctggaaggggcagacctggccatacagcagggctgtacagaccctcgtgcgccctggcgtcccacagacattctcttcccaaaggccctggagcacagcactgtacacctgggcactcaagactgcagctgcaggcagatttgtgagcagcttcctcatcaaagctccagatctgggtcccctggtcctggggttaggagggaaggggcagatgtcggggggaggaggacagggagagctgggaagccacggtgctgagggggatgggtctctcagtggccagctgtgaccccagcctcccctctgctttgcaggggacctaagtctccatttacagaactcactatttgcctcttgtgggggaagtccccagatgtcagccttctcgtgggaattataagaagtatgagccccagagctcctttagtctctccccagccagagtccacatattttcccccatgttttgtgggtgaaaaggcccttcagaaccctaaatccacccagtttatatttgttgctgggctgcgtcattctagtcagaatctgggaggatgccaccatacgtagaggaggccatgagggtctcacctgtaacattctgtagatatgacttgtttattctgtctactgtgagtgcctgactctgagtagaatcaaggccgggggattgtcatctgctttgtttatgaaattatgccaagccccaagaagagcgatgcacaaatgaggtgttttgaatgtatgtgttgaatgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagaagaccacgccctccaaacagagcaacaacaaatggag

SEQ ID NO: 4455 - DNA, 1811 bp, Homo sapiens
tctgagacctgggtagcagcacgtcgatgggttggttttgtttcctcttcattgaaggtggtgagtttcaaagatatcagctttatataaagctctccgttccaaccctaccccaaacttcctctcctgtcttcatgtggatgctaacttaaaactcttatttctgggtcagataactccctgctctcagccctgatgactacacctttgacacacactatattggtatggcttttaattttctctttgtttctagcatttgagaatctctgtctttgttaattcaactatgtatttttaaataaacttcatattttagctaacacttgtagatatttgtagctggggaaaactaactttagttgattctactgagtagacaggactggaaatccattctctggggtttgttaaaaccaaagtaactggctctcctggatgctagctcactgtccaagttgaatttagtgtcaatcatccagaaaatgtcccgtttttcatgtgcgaagtctgcttatagttaatagaccagcttaggttcttcatttagttcagtgaactcttcaaaatgtggtttcaatattgaaataaatgcatatcattctaattttactcttttctctctctgctaggaaactggagggagtaaatcctacagacaatagacaaatgtttgaaatacttagaacatggtttgtttttctttttgtttttgttctgaaatggagtattgctctgttgcccaggctggagtgcagtggtacgatcttgggtcgccacaacctccacctcccaggtttcagcaattctcctgcctcagcctcccgagtagctgggactacagacacgtgccaccatgcctggctaattttttgtatttttagtagagacagagtttcactgtgttggccaagacagtcttgatcttttgacctcatgatcttcccatcttggcctcccaaagtgctgggattacaggcatgagccactgtgcccggccagttgttttaattctaggttctggatacatgggaagtggaggaaatgctggacaagaaggcacagttagatggtagacccacctctgtcaataaccaggcccagttttaactcattgtttttcaattgtaaaataagagtgttggacaaaataccttataggctccttctagctcttaggtgatttataaaggtttggggtgagggtaaactgggcggttaaagtctgtgtaatctgaaagccatgcaggggctctgacgggcttacccctgtccctgcagccaagtcctgacgtgctactttcccagggcttggttcttgcctgtttctcttgaggctgccttggcattcacccacgctcttggttgttattttttactctctgcccctgtgaaaatacacctgctctcgtggcttcactggccactttctcaatcctggctgtcttctttatgttcttgttccctgtatcctatgggtctgtttctttctgactactcaccatgagggcaagagattccaaatatctacaaaattcctcacattcctgaagaaaccctcccagtctttccctagtgtcctgtctctgaggataccaccttgcttggtgagaactttcatagatctagcctcttcatttaccaactcctaccaagccacttttcttgtgaaatgtcccatatgcacattttgtgcattcaataaatagcttttgagttaggccaggcactgtattggacatggattaaacataaaataaagaaagcagatctcggccagacacaatggcacatgcctgtaatcctagcag

SEQ ID NO: 4456 - DNA, 21738 bp, Homo sapiens
agtactgcagtgtgcggcgcatggctgcgagggcctgccgaggggcgggcgcgagtcggaaagacaccgaccagggaatgggcgacgaggcttgccttaattcggaggaaacccaggacttgagagagccatacaatttgaaagacgaagcaccgtgaaatgcagaaagttgtggttcggatagctcagctgattaatttcatgttgccacagtttgtcaacggagtttcgctcttgttgcctaggctggagtgcaatggcgtgatctcggctcaccgcaacctctacctcccgggttgaagcgattctcctgcttcagcctcccgagtagctgggattacaggcatgtgccaccacacctggctaattttgtatttttagtagagacagggtttctccatgttggtcgggctggtctcgacctcccgacatcacgtgatctgcccgcctcagcatccgaaagtgctgggattacagatgtgacctatcgtgcccagccgctaaacctcatctttaaaaaagaagaacaaaatagaacatggacaagatggctggggtcctgtggagttctagtaatcttcttacgataataaagcaaccttatgccatatgatatgctaaggatggaggaagatagagtctaggtgcctgatgacaacatggagctgtcaagccctgcattgcctccccctggacgtctcattatgggagaaaatgaagcaatttgtttaagccacactgatcttttttcctatttttctttttcttttgttgagtgtgtgtttgtgtctgttatttacagctgattgtaagtcataactgatgtggtagtgggactgtgtaagttttgtcttctgatgtttttctttttttttttcttcttcagtgaaacagggatggggagatcattagctaaatgtaaggattggggaaggagtgtgggaggtttgtggagagagaatgtgtgaaatgtgggaagtttgtggagagagaatttgtgaaatagttatctctgaatggtagagtaaattaagtagggagaggtagtaggtcattcagacatctgtggttgtaaatataaaatgagatcagtcatctgggttgtatttttccctagtcaggtttacctgctcaggagaaggtataaacctgatagtgaattgggtttaaccaggatttatattttgctaaagccattgtgtcaccatttgtgaaatagaagaagatactgtagagtcactaagaagacagttgactgaatggatttataaaaacatgtagccgggcacagtggctcatgcctgtaatcccagcactttgggaggccgaggcgggcagatcacgaggtgaggagatcgagaccatcttggctaacacggtgaaaccccctctctactaaagaaaaaaaaaaaaattagccgggcgtggtggcaggcgcctgtagtcccagctactcagaaggctgaggcaggagaatgatgtgaacccaggaggtggagcttgcagtgagccaagatcacgccactgcactacagcctgggtgacagagcgagactctgtctcaaaaataaataaataaataaataaaataaataaaaatatatacaaacatgtaattgctggccaggcatggtggctcacgcctgtaatcctagcactttgggagactgaggcggtggattgcctgagctcaggagtttgagaccagcctgggcaacacggtgaaaccccatctctactgaaatacaaaaaattagccaggcgtagtggcatgtgcctttagtcccagctacttgggaggctgaggcaggagaattgcttgaacctgggaggtggaggttgcagtgagccaagatcgtgccactgcattccagcctgggcaacagagtaagactctgtctcaaaaaaagaaacaaacaaacaaaaaacatgtaattaataaaagcagtagacttgaaagcaaaactttacacatattttttgaataggtaaagttcccatggttcaaacattgaagaggtaaaaagatacacagacataccttactttattgcacttcactttactgaacttgttttgttttgttttgtttttcttttgagacagtttcgctcttgttgcccaggctggagtacagtcgtgtgatctcggctcactgcaacctctgcctcctgggttcaatctcttctcctgcctcagcctcccaagtagctgggactacaggcacttgccaccacgcccggctaatttttgtatttttggtagagacagtgtttcaccacgttggccaggctggtctcgaacttctgacctcaagtgatcggcctgcctcggcctcccaaagtgctgggattacaggcttaagccaccgtgcccggccctttttattttttttgagacagagtttcgctcttgttgcccaggctggagtgcaatgacgcaatcttggctcaccgcaacctccgcctccctggttcaaggattatcctgcctcagcctcccaagtagctgggattacaggtgtgagccactgtgtctggcccactttactgaacttcacagatgatgagagttttctctttcttttttttttttaaaacgtattgaaggtttatggcaaccctgcatcaagcaagtctgttagcaccatttttccaacagcatttgctcacttcatgtctctgtgtcacattttggtaattttcataatatataaaaatttttcattacaggctgggtgtagtggctcacacctgtaatcctagcactttgggaggccaaggcaggcggatctcctgaagtcaggagctcaagaccagcctagccaacatggcgaaaccccatctctaccaaaaatacaaaattagctgggtgtggtgacacacgcctgtaatcccagctacttgggagtctgaggcaggagaatcgcttgaacccagaaggcggaggttgtggtgagccgagatcgtgccattgcactccagcctgggagacaaagcgacatctcaaaaaaaaaaaaaaaaaaaagcttttttattattattgtatttgttatggtgatctgtgattagtaatctttgatgttactattgtaatggttttggagtgccacaaacataagatcacgtgacagtgaccttaatatataaatgtgtgtgttgtgattgttctactgaccagccatttcctgtctccctcttcttatgcctccctgttaaattagacacaacaacattgaaatcagaccaattaataaccctacagtggtctctgagagaggctaacagctaatcctcttgtgctaaacagccaaattgtgaatgcaaaggaaaagttctcaaaggaaattaaaagtgctactccagtgaacacatgaatgataagaaagtgaaacagtccgggcgtggtgggtcacgcctgtaatcccagcactttgggaggctgaggtgggtggatcacctgaggtcaggagctcaagaccagcctagccaacatagtgaaaccctgtctctactaaaaatacaaaaattagctgagtgtggtggtgcacacttgtaatcccagacactcgggaagctaaggcaagagaatcacttgaaccccagaggtgaacattgcagtgagctgagattgtgccactgcactccagcctgggtaacagagagagactctgtctcaaaaaaaaaaaaaaaaaaaaagtgaaacagccttattgatgctgatagggagaaagttttagtagtctggatagaagatcaaaccagccacaacattctcttaagccaaagcctaatccagagcaggacctcagttatcttcaattctgagaaggctgagagaggtgaggaaactacagaagaaaagtttgaagctagcagaggttggctcgtgaagtttaaggaaagaagctgtctccataacataaaagtgcaaagcgaagcaataagtgctgatgtagaagctgcagcaagtgatccagaagatctagctaagatcattgatgaagatggctatactaaacaacacatttttggccaggcactgtgcctcatgtctaatcccagcactttgggaggctgaggtgagagcattgcttgaggccagcctgagcaacatagcaaggcaattttttaatctctacaaaaataaaaaaattagccaggtgtgatggcatgctcctgtagtcctagctacctggcaggctgaggtgagtggcttcctgagcccagggttttgaggctgcagtgagctatgatcatgctactgcattccagcctgggcaacagaacaagaccctgtctccaaaagaaagcaaatcaacaaaaaatgagcaataaaaaaagattttcgatgtagacaaaacaacctcacattgaaagaagatgtcatctgtgactttcatagctggaagggacaagtcagtgcctaccttcaaagaacagcctgaatctgtcaggggctaatgcagcaggtgattttaagttgaagccaatgctcgtttaccattccaaaaatcccagggccctaaagtatcatggtaagtctactctgcccatgctctataaatggaataacgacacctggatgacagcatacctatttacaacattgtttactgagtattttcagcctgttgttgagatgtacttttcagaaataaagattctttcaaaatgttactgctcattgacaatgcacctggtcacccaggagttctgatgacatgtacggggagggagattaatgttactttcgtgactgctaacagcatccattctgtagcccgtggatctaagagtcatttttactttttttttttttttttttttttttgagacagagtcttgctctgccttccaggctggagtgcaatggtgcgatctcggctcattgcaacctccgtctcccgggttcaagcaattcttctgcctcagcctcccaagtagctgggattacaggcactggctaattttttgtatttttagcagagatggggtttcgctatgttggccagcctggtctcaaactcctgaccttaggtgatccacccgcctcggcctcccaaagtgctgggattacaggcgtgagccaccacactcacatggtggtttcttgagatggaatgtactcggtgaagatgcttgaacattattgaaatgacaacaaaggattttaaatatttcataaacttagttgataaagcaacaacagggtttgagaggattgactccaattttgaaagaagttctactgtgggtaaaatgctatcaaacagcatcacatgctacagagaaatctttcatgaaaggaagtcaatcactgcagcagacatcactgttgtctttaagaaactgcaggccaggtgcagtggctcacgcctgtaatcctagcactttgggaggccaaggcgggtggatcatctgaggtcaggagttcgagaccagcctggccaacatggtgaaaccctgtgtctactaaatacaaaaaattagccaggtgtggtagcacatgcctgtaatcccagctacttgggaggctgaggcagaagaatcgcttgaacctgggaggcagaggctgcagtgagctgagattgcaccattgcactctagcctgggcaacaagagtgaaattccatctcaaaaaaaaaaaaaagaaagaaagaaaagaaaagaagttgtggccgggtacagtggcttacacctgtaatcccagcactttcagctacttgggaggctgaggcaggagaatcgcttgaacctgggaggcggagattgcagtgagcggagatcacaccattacactccagcctgggcgacaagagcgagactctattgcaaaaaaaaaagaaaaagaaaaaagaaattgctccagccaccttaaccttcagcaatcactaccctgatcagtcagcagccattaacatcaaggcaatatcctccaccagcaaaaagattataactagttgaaggctcagatgatcattagcatttttcagcaatgaagttttttttgttgtttgtttgttttgttgtttgtcttgctttgtcatccaggctggagtgtagtgggcaacagggcaagactccatcccaaaaaaaaagatgtgtctagtgtgaataagaatttgaatattttactttattagattgtaattaatttacaattaaataatacaaatatatacaaaattagccgggtatggtggtacatgcctgtagtcccagctacttgggaggctgaggtgggggaaccacttgaacccaggaggtggaggttgcagtgagccgagatcatgtcgctgcactccagcctggcaacagagtgagactccatctcaaaaaaaaaaaaaaaaaattagccacatgtatatagtaactaccatgttgcacagatactcaggtcttctatacaaagaagaaaggaaggctcagttgtccttggataaaatgagaactggtgaaaaggcactttgaaagtaatgaaaacagctggacacagtggctcatgcctgtaatcccagcactttgggaagctgaggcaggaggatcacttgagcccatgaggtcaagtctgcagtgagccaagatcgggtcactgtaccccaacctgggtgtcagagcgagaccttgtctcaaaaaaaaaaaaaaagtaatgaagacaaagtgtcaataataactaaagatgattaaggagaagggttttttgtttgttttttgagccagagtctcgctctgtcacccaggctgtagtgcaatggtgagatcttggctcactgcaacctccacctcccgggttcaagcgattttcctgcctcagccttccatgttgccaggactacaggcatgcaccaccatgcctggctaatttttgtattttttagtagagatggggtttcgccacgttggccaggctggtctcaaactcctgatctcaggtgatccagctgcctcagcctcccaaagtgctgggattataggcatgagccactgcacctggccctctctacttttttatatttaatacttttcttccccctctatccctcccttcctgccatcctttctttctttttgtttctttcctttctctccccaccacccaccccactctctctctctctttcttctcttttaatacagggtctccctctgtcccccaggctagagtgcagtggtgtgaccatagctcactgtagcctcgatctcctgcactcaagcgatcctcctgagcagctggggctacaaatgtgcatcaccatgccctaattactattattattgttatttttgtagagctaggggtcttgctgtgttgtccaggctggtcacaaattcctggcctcaggctactgccttggtctcccacggtgctggaattacaggcataaggcattgtgcctggccaagagttttttaaaatctatttgcattacttttataattagaattaatgtttaaaaagtcaatctaaagtaaaatggtgaattaagactcatataagatataggagtattcatttttgccctttgctcactggtttttatttttaaacacctttatggagatttaattcagattccgtaaaatttacccttttaggctggacgcgatggctcacacctgtaatcccagcactttgggaagccgaggtgggcagatcacaaggtcaggagtttgaaaccagcctggccaacatggtgaaaccccatctctactaaaaatacaaaaattagctgggtttggtggcacatacctgtaatcccagctactcaggaggttgaggcaggagaattgcttgaacccaggagacagaggttgcagtgagccgcgattgcaccactgtactccagcctgagtgacagagcaagacttcacctcgggaaagaaaaagaaaatttacacctttaaagtgtacagttcagtggtttttttttttttttttttaatttttttctgtaacccaggacagtgccaaagttcagtggtttttttgttttttctttgtttgtttatttgagacagaaactcgctcttgttgcccaggctggagtgcaatggcgcagtcttggctcacagcaacctccacctcccggattcaagagaatctcctgcctcagcctccaagtagctgggattacaggcatgtgccaccatgcccagctaatttttgtatttttagtagagatggggtttcaccatgttggccaggctggtctcaaactcttgacctcacgtaatcctcccacctcggcctcccaaagtgctgggtttacaagcgtgagccaccgtgcccagccaagttcgtgatttttaacacatttatagagttgtgctaccatcatcacactctaattccagaacattttttatcatccctaaagaaactcattgcccaggctggagtgcaatggagtgatcttggcttattgcaacctctgcttcccagttcaagcgattatcatacctcagcctcctgagtagttgggactatagatgcgtgccaccatgcccagctaatttttgtatttttagtagagatggcgtttccgcatgttggccaggctggtctcgaactcctggcctcaagttatctgcccgcctcagcctcccaaagtgctgggattacaggtgtgagccatcatgcccaaccctgagatggcttctgaggggcttgatatggagggagagggcctaagtagcttcagaatgaaaagaacaagccaggattagagggttagaactttcagccccatcccccaagacctcagggaagggagtggtgactggagattgagtttgatcaccaaaaggtcaagccttaattatgcttatgtggtgaaaactccggccaggcacggtggctcacgcctgtagtcccagcactttgggaggccaagacaacggatcacctgaggtcaggagttcgagaccagcctggccaacgtggtgaaaccccatctctactaaaaatacaaaaattagccgggtgtggtggcaggcgcctgtaatcccagctagttgggaggctgaggcaggagaatcgcttgaacccgggaagcagaggttgcagtgagctgagatcttgtcccccagactgggggacaagagtgagacttcgctcaaaaaaaaagagaaaagaaaactccatgaaaccccctaaataatagggtatggaaagcttcatagttggtgaaaaaattggtgttaggagggtgccaaccaggagaaggcatggaaactctatatcttcctccaccttctacccccacccagggcatacttttctcggtgcatctcttccacttagctgttcctgagttgtatcctttacgatgcattgctaaatgtaagtaaagtgttttcctatattctgtgaattattctaacgaattattaaacctgagggagattggcgggtattctcgaatttacaactgttcggtggcaaacctggcacttaaaatgggagcaattttagggaactgagccaagagaattgaatttaattgtttgacacccaattcctgttagagaattggagaattggtgtttggtgtcagaaaaaaaccttacagaatagttatgtatggtatagtacaaccttgacataattaacttcatcttagaaaaagactccattttatatttatttatttatttttatttttatttatttatattttttgagacagagtctcgctctgtcgcccaggctgaagtgcaatggcgtgatctcagctcactgcaacctccacctctcaggttcaagcagttctcctgccttagcctcttgagtagctgggattacagcatgccaccatgcctggctaatttttgtatttttagtagagatggggtttcaccatgttgatcaggcggtttcaaactcctgaccttgtgatctgcccgcctggacctcccaaggtcctgggattacaggcatgagccactgtacctggccatttatttttatttatttttttgagatggagtttcactcttgtcacccaggctggagtgcaatagtgtgatcttggctcactgcaatctccacctcctgggttcaagcaattctcctgtcttagcctgttgagtagctgggattacagcgcaccaccatgcctggctaatttttgtatttttagtagagatggggtttcaccatgttggtcaggctggtctcaaactgctgacctcgtgatctgcctacctcggcctcccaaaggcctgggattacaggcgtgagccactgcacctggccatttttttttttttttttttttttttgagacagagtttcactcttgtcacccaggctggagtgcaatggcgcgatctcggctctctgcaacctccgcctcccgggttcaagcaattctcctgcctcagcctcctgagtagctgggattataggtgcccgccacgacggctggctaattttttttttttttttttgtatttttagtagagatggggtttcaccatgttggcctggctggtctcaaactcctgacctcaggtgatccacctgcctcagcctcccaaaatgctgggattataggcatgagccaccgcgcccagtctccattttatatttcatagggaactttgtcaacaagtataagatgctttgcttaataaacaaagttttttaaaagatgcatccaaccagttaaggacacaagcatgctcttccactatcagttctcactagaggattctgtgactataaaagatgaggccagccgggcgcggtggctcacgcctgtaatcccagcactttgggaggccaaggcgggcggatcacctgaggtcagtagtttgagaccagcctggccaacatggtgaaaccctgtctctactaaaaatacaaaaaattaggcgggcgtggtggcaagtgcctgtaatcccagctactcgggaagctgaggcaggagaatcgcttgaaccagggaggcagaggttgcagtgagctgagattgcaccactgcactccagcctggcaacagagcgagactccgtctcaaaaaaaaaaaaaaaaaatgaggccagctgggtgcggtggctcacgcctgtaatcccagcactttgggaggccaaggcgggcggaccacctgaggttaggagttcaagaccagcctggccaacatggtgaaaccctgtctctactcaaaatccaaaaaattagccaggcgtggtggcgggcgccagtaatcccagcaacttgggaggctgaggcagaagaatcgcttgaacccgggaggcagaggttgcagtgagccgagattgcgccattgcactccaacctgggcaacaagagcaaaactccgtctcaaaaaaaaaagatgaggccttcagcagctcaaaatggtcatcttaactgacaccgtcttgcagtcagtcactcgtgataagaacttgccatctgcctccgaaggctctgccacatcaaagactcttcctcgcaagactggcagaccaactggcccaaaacagaactccttttcttctttgttctgcctggactggttctttaaccctttctcctatctctttctcctcttgatgttaaatgttactttgtcatggaatgtttaacttgtaacatttatatattgattaattatactattatgtatggtttacaatattgactggcttgcgtgcccacagctctgactactgagtgaacaggaagtactgttagctgtggaaggtatacagatcatcagcagtaaatccatacaggcctgaagcaacctcaattcttgcctcctcagaagaaagaattccactgaggggcataaggcagaaggagaaaccgaggcaagttttaaagcaggagtaaaagtttattaaaaagctttacaccaggaacaaaaggaaggaaagaacacttggaagagacccaagtgggcaacttgaaggagaagtgccccatttcaccttggacctaggattatttatttatttatttaatgagacagggtctcactctgtcgctcagactggactgcagtggagtgatctcagctcactgcaacctctgcctcccaggctccagcgattctcctgcctcagcgtcgcgagtagctgggattacagggcgcacactactaccacccagctaatttttgtatttttattttatttatttatttatttttgagacagagtctcgctctgttgcccaggctggagtgcaatggcacgatcttggctcactgcaagctctgcctctggggttcatgccattctcctgcctcagcctcccaagtagctgggagtacaggcacccgccaccacccttggctaatttttttttgtatttttagtagagatgaggtttcaccgtgttagccaggatggtcttgatctcctgacctcatgatccgcctgcctcggccttgcaaagtgctgggattacaggtgtgagccactgtgctctggctcatttttgtatttttttttttttgagatggagtctcgctctgttgcccaggctggagtgcagtggcgcgatcttggctcactgcaagctccgtctcccgggttcacaccattctcctgcctcagcctcctgagtagctgggactacaggcacctgccaccacgcctggctaattttttgtatttttagtagagaccgggtttcaccatgttaaccaggatggtctccatctcctgacctcgtgatccgcccacctcagcctcccaaagtgttaggattacaggcgtgagccaccgtgcccagccctaatttttgtatttttaatagagacagggcttcaccatattggccgggctggtcttgaactcctgacctcaaatgatccaccctccttggcctcccaaagtgctgggattataggcatgagccactgggcccggtccagaccttggatttcatatgctggtctacttctagtattttgtgcccctttcccttcattcttgccttagggtgagctgcccacatgcacagtggcctactaacgcctggcaggtgagcatgcgcagtgtgtttactggagttgtaaacatattcacctgaggttttcttcccttttctggtggaatgccctggaaggtcatatgcctccattttgcctcttaatgtgcatgctcgagcccactcgcccagttccttagatcttacggaagctgctgattaccaatttcaggtgtttatctgttgggaaactgcctctccctggtactggctgtgaccaattattttagataggtagtgtgacaactgcctgaccattggtcacctgacattcctggtgggtgcagggagccctctcctgccctgctcttgcctgtctaactacctactgtaacagtactaaggagattgcccccttgggaactccgtgtagctcctggcttttgtgattgcaatagcatcagtaaaagcctgacactgtggaaagacacaaacatgcaaggacctgcttatctctaaccttgcaccactcactgaggcaggagaatagggactagaggcagggaacctaaggacttcctagaactaaatcaaatgaaaatgaaaacacttcagctatgacaaaaaatatcctcctcatttacatagggcgtacaccaagtaaccagtgggaacctctagaggggatgtaaaccccagaaaattcttttttcttcctttctttctttttttttttttttttttgagacagagtctcactctgacacccaggctggagtgcaatggtgcgatctcagttcactgcaccctccgcctcctgggttcaagagattctcctgcctcagcctcctgagtagccggggttacaggcacccaccacgggccatgcctggctaatttttgtattttttagtagagacagggtttctctgtgttggtgaggctggccttgaattcccaacctcaggtgatctgcccaccttggcctcccaaagtgctgggattacaggcatgagccaccacaccctaaacccaggaaaattctgtaactgagcccttgagcccctatgtttggcctgctcccaccctgtggagtgtactttcattttcaacaaatctctgcttttgttgcttcattctttccttactttgtacattttgtccaaatctttgtttaagacaccagggacctggacaccctccactggtaacatcatgacatgtatgcaaaaattgtccgcaaaatttacatataaacgattagaatttaagaattcccaaaaccccctttagacagggtttcaccacgttggcaaggctggtcttgaactcctgacctcaggtgatccgtccaccttggcttcccaaagtgctgggattacaggtgtgagccaccatacctggcagggaacttcattatttaaaggagaaagagcaagcaggagggggaaaacgggaggtagggtaggtagtgaggcgaattgttacattcttgtgaggctctgattagcctcagtaaattgacattttacatgtgaaaaggggaagtagaggaaatgaggctatggtacaggattgtgaaattacagctatctggtaacaaaaggaatgcagtaattcagctctcaagcttaatgtccctttggcatagtgagtttggggtcccaagattctattttctttcacactaacaccaacaacaataacaacaaaagaacaagacatctgcaagaaaatagtatctttattgagagatattatgaagatattatgattaatgtactgagagatatatcacgtattatttggaggtatcagattacaaagatgctaattctacttaaattgccctataaattaagtgcactgggaaggtggagtagacatacttcctaaattcctcccactaaatacaactaaaaaccctggacattatatataaaacaaacataagaagactgaaagaaaagccgggcgtgatggttcatgcctgtaatcccagcactttgaaaggctgaggcaggtggatctcttgaggtcagtagttaaagactagcctggccaatatggtgaaaccccatctctactaaaaatacaaaattagccatacatggtggcgtgtgcctgtaattccagctactcaggaggctgaggcagaattgcttgaacccaggaggtggaggttgcagtgagccaagatcgcaccactacactccagcctgggcaaaagagtgagactctgtctcaaaaagaaaaaaaaaaaaagactgaaagatggagagaaggcagcagacaagctagggatcttgggggtccaaggaacaacatagtgatgagtttcctgggttttcttcctaccttacatctcgaagccttggaactgaagaagctgacaatccaaaaatgccgaagggtgagacaaaaaacgaaaaccttctctcactagccaaagaaccaggaaagggaaaatctagcaagacagcaaactttatataacaactcctgtactccagccaagtgctacagaaagaactgtgaccctacccctacctgtatcaccaagactgagtggggagcctagacttccacccttgctaggctgtaacaaggtgctccaaaggatagtcttttctacaaatggtgctgggacaactggatattcacatgcaaaggaatgtagttggactctgctgtgtgaatagtgtcaccctatccaacattcagtgtccacttacaacctcagaatgtggccctctttagaaatagaatctttgcaaatgtagttagttaagatggggaattactggattagagtgggccctaaatctaatgactgtccttataagaaggccatgtgaagacacagaaacatagtgagaatgcccggtagcaacacaggcagaaattgtagtggtgtctacaaggtaagtaaggaatgccaaggattgtcagcaccagcagaagctagaagagaggcatgggacagattctccctcagagcctctggtaggaaccaaacttgccaacgccttgatttcaaacttctagcctacagaactatgaggcaatacatttcttttgttttaagccactcagtttgtggtttaaaagcagctctgagaaattaatacagactcctacctcacaccatacacaaaaattaaaatggatcaaagacctaaatataagagctaaaactataaaactcagaagaagaaaacagagataaatctttattacttttgattaggtaatgctttcttagatatgacaccaaaagcacaagcaacaaaagaaaaaaaatggtaagtcagacttttttttttgagacggcgtttagctcttgttgcccaggctggagtgcagtgttgcgatcttggctcactgcaaccttcacctcctgcgttcaagcagttctcctgcctcagcctccccagtagctgagattacaggtgtgccaccgtgcccagctaatttttttttttttttcttgaaacgcagtctcgctttttcgcccaggctggagtgcaatgatgtgatcgcggctcactgcaacctctgcctcccgggttcaagtaattctcctgcctcagcctcctgagtagctgggattacaggtggccaccaccatgccacaaggcccagcctaactttttatttattttactgttctttttcttacctcttaaatgagtattagttcttttttatgtatattttttcctattcattgtcaatattcaatataaacttaattctttaatgtctagcctttccatattcctttttttttttttttttttgagttggagtttcgctctgttgcccaggctggagcgcagtggcgtgatctcagttcactgcaagctccgcctcccgggttcacgccattctcctgcctcagcctcccaagtagctgggactacaggtgcccgccaccacgccttgctaattttgtttttgtattttcagtacagatggagtttcaccttgttagccaagatggtctcgatctcctgaccttatgatccccctgccacagcctcccaaagtgctgggattacaggcgtgagccaccacgcccagccagcctttccgtattctacttttttatttgtttgttttttagagacactgtctcaatctgtggcccaggctggattgcaatggggcaaacaaagctcactacagcctcaaattcctgggttcaagtgatcctctcacctgagcctcctcagtacctgggactacaagtgtgtgccaccacaccaagcgaattagtttttgtagagttagagtctccctatgttgcccaggctggtctctaactcctgcactcaactgatcatcctccctctgcctccctaagtgctgggattatagatgtgagccaccttgcccagtctgtgaggtttagttggagcctcaactttttgatgaggcaggcctcttattatatttataacttggggtgggccctggactttacctagcacctaggctgggcgtggtggctcacatctgtcatcccagcaccttaggaggccgaggcaggaggatcgcttaaacccaagagttcgagaccagcctgggcatcaaaacgagaacctgtctttacaaaaaaaaatttttaaattagccagtcatgatggtgctcagctacttgggaggttgaggcagaagggtcactttaacacaggaggtcaagtctgtagtaagctgtgatcgtgccactgcactccagcctgggtgaaagagtgagaccctgtctcaaaataaataaacaaacaaacaaataaaatactccagcacctataaggttgtagagaaaatggcattagtgttccactcccttctggtttaaaggttccttactatcttgtcacctttttaatgcttttaagaaaattattttatctagcaattttaatttttattggaaggcatatcaagatatctggcccaccatattattcaaaacccagaattctgtcattttttaaaaacagatgatggtaagcatcaagttactgtgtgtttagattacattagatgtaacagaatggtgtaagttttactgtaaaacatcaatatttacaacatgcttcttttgggggacgggggagatagggtcttgctctgttgcccaggcttaagtgcagtaattcaatcatggctcacttcagtcttgaccttctgggcttaagcaatcctcctacctcagtctcctgagtaactgggactacagatgcatgccaccatgcccagctaattttaaatttttttgtagatacggggtcttgctgtgttgcccaggctggtctcaaactcctgggctcaagtaatcctaccaccttgacctcacaaagtgctgggattacaggtgggagccaccatgcctggccacaatatgcttaaaattacattattttacactacgtatgtatatatctccacacatatacatatatgtgtgtgtatatatatatatacacacatatatatcctgggctcaagaggtcctcccacctcagcctcctgagtagctgggaagacaggcaaagctacttgttttcttacattttgtagagatgtagtctcagctggtcttcaactcctggcctcaagtgatcctcctgcctcagcttttaccgtatttaaacttaacttgaagaattttagatatcaacttaaaaatgactggagttacatagtttaatttcttttttttaggtgataagcaaaaatgtaaagaacactgatacagagaaatggtcacatagcccggacatggtggctcatgcctgtaatcccagcactttgggaggccaaggcaagtgaatcacttgtggtcaggagtttgagaccagcttggccaacatggtgaaaacctgtttctactaaaagtacaaaaattagccaggcatggtggcaggcacctacaggtgccagctactcaggaggctgaggcaggagaattgctttaacccgggaggcagaggctgcagtgagccgaggttgagccactgtactccagcttgggccacagagtgagactccatctaaaaaaaaaaaaaaaaaaagagatatggtcacataatccaatttcataagaaaatatgtacactcagctgggcgcagtggctcacacctgtaatcccagcactatgggaggccgaggtgggtggatcacgaggtcaggagatcgagaccatcctggctaacacagcgaaaccccgtctctattaaaaatacaaaaaaaatagccaggcgtgttggcggacgcctgtagtcccaactactcgggaggctgaggcaggagaatggcatgaacccggaaggcagagcttgcagtgagccgagatggcgccactgcactccagcctgggcgacagagcaaaactcaatctcaaaaaaaaaaaaaagaaaagatgtacaatcatctagtctcatgactttaaatatctatatactggtagctcccaaatttgtatcttctacccaggcctattttctgaaacacatatccacatgcctactctacatctctgattggatgcctaataggcatcctaaatttatcatgtccaaaacagaactcttgaattctactccactccagtccacacactcacatacagaccactcctttcttctcccaggattctccatctgagtaaatgttacctttattcacccagttgcttagcccaaagacctctgagttatccttgacttctctctctcactctcctgctctaatatttatcatctaacgcatcagcaaatcttgtcagctctacttaacaaaacataacctgaatgtctgccatctttctctcagacactaaaataatctacttcttactgctttccttgttctattcttgctgtctctttttaaaagtgatcctttttttttttttttgagaccggagtttcactcttgatgcccaggttggagtacaatggcgtgatctccagctcactgcaacctctgcctcccgggttcaagcgattctcctgcctcagcctcctgagtaactgggattacaggcgcatgccaccacgcctggcttatttttgtatatatttttagttttatttttttttttttgagatgaagtctcactctgttgcccaagctggagtgcagtggcacagtctcggctcactgcaacctatacctcccgggttcaagtgattcttctgcctcagcctcccgagtagctgggactacaggtgcgcaccaccatgcccagctaatttttgtatttttagtagagacagggtttcactatgttgaccaggcttgtcttgaactcctgaccttgtgatctgcccacctcggcctcccaaagtgctgggaatacaggtgtgagccactgcacccagcctatttttgtatttttaatagagatgaggtttcaccatattgtccagactggtctcgagctcctgacctcaggtgatctgcccgccttggcctcccaaagtgctgggattacaggcgtgagccaccacgcccagcctagaagtaaatcttaatgacgctaagttaggcaaaggcttcttaggtatgacaccaaaagcataagtaacaaaagaaaaaatagatacatttgacctcatcacaattaaaaacttctttgcttcaaaagacacactatcaagaaagtaaaaagacaacccacaaaatgaagaaaatatttgcaaatcatatatctgtagtgttatatattggttttcatctatggttcttggctcataacttccatatccctctttacagtcttttgttagaatgttgggtgtgttgagcctcagggcaggcatctgatgttctcctgccctctgttcatgctaatcttccccgacctttttttctttctttcttttttattttaagataggttctcactctgtcatccaggctggagtgcagtgttgtgatctcggctcactgcaacctctggctcctggattcaagcaattctcctgccttagcctcccgagtagctgggattacaggcacgcgccaccacgcctggctaattttgtatgtgtttttttaattagagatgggggtttcactgtgttggccaggctggtctcgaactcctggcctcaggtgatctgcccacctcagtctcccaaagtgttgggattacaggcgtgagccaccaggtccagcctaatctttcccgacctttctgattgtaggtcttaataccctcccatgagagtgtcccaccctataacctgggagaaggaatgctgatgtctttaagcttctgtaaaaacccaagatgacagggctcagtgagcttccagacagctgaacacatggaggttactggagggtggtgcgcccagggaggggatggaagctccacaccccttcccccatacctcaccctacctattctttttatcggtatcctttgcaatatcttttataataaactggtgaatgtgtctccctgagtgttgtgagctgctccagcaaactaatcgaacccaaagaaggggtcatgggagcgtcaacttgaaaccagtcggtcagaagtcccgggggctgaacttgtgactggtgtgtgtggggttagagtcgggggctggggcagtcttggggactgaaccctcaacctgtgggatctgacactatctctgagtgataatataggaactgaattagaggacacccagctggtatctgctacttggtgtgtggagaaatcctccacacatttggtcacagaagttgtcttctgtttgatgattgtt

SEQ ID NO: 4457 - DNA, 15161 bp, Homo sapiens
acacgcccgggaagcggccgccgcggagccggcgtccgcagcggctgcgcatctcgggcctgcagcggggcgcttggcgggcgggggccgggggagagcctgtttgcgcagtacccccggagggcggaaggccgccgagagaaacagcaagtgacagagcagaggaacggctggcccagccaatcctggagctgctgttgcagcacttgttccccaaacaagtgctcctacattctgatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatca

SEQ ID NO: 4458 - DNA, 2306 bp, Homo sapiens
actccatcttgatgagagttggtgtttgtgggttatttgtgaagccggaaagaagccgtgtcctggagaatgtagctgaaggcctggccactttcgacaagaacgggaaagagacgactaacttgtactaatatcttagtgcttggcagggcattttttcattccaggaaagaagagaatccagctgagatcaagggagggacgtccgacggaggcgccatctttaacaagggctatttgggaggccatcttggcgcagggcgtctttttgaaaggttacctgctagagattacgacctatcggggcatgcatagaattggatatgttccttgttattcgcgtcagcagtcactcatccaaagaccccaaagcttctagtgttctaaaggctcacaccttctgtgacaggaatcttgattcccattcttctcaatcaagacctaccctgaatggatttggagtagtgtggtataatgggaaaaattcaagcttgggggccaggcagatccaggtttcaaacccatctctgccacttcttacctctgagacctttggcaaacattttgacttaattgagccttagtttcctcatctataaactggagatactagcaccaaccttccagaattgtgtggattaaataaaatcaaggacatagattttgtgagcacaggatacttagtccagttcctggcacataatgaacgcattatgtaaatataagtttctcttccttatttcctgaccaccatgaacctagctctagtttctggccactagtctccatgacaacaactgaggaagagcacccaaacaagaagaagaaaaagaatgttttgccaaatatgtgaagatataatacctatcaccaaagactttaataagaataatgagactccacactatgtgtaaaaatacagcttttattctgagacattgaccttcactagagtgggacctgtggccccagcctggctggagaagcagtcccagggcctgagtgacaccatttccctttcctgaaataggaacaagttattccaaaggagaaaggagagcccagagagatctgtacaggacctctcttgcacatggtgactggaggcagagggtggggagctggagaggagtccagtccctccaacaaatattgagggcttcaaagagctcttcctggacgtttctcttaatctggatttaaaagggacaggaggtatcttagggtccaagaacataacaggaatgggcaactctagaagtgtttgtgtgtggaaggccctaacctggccctgtcctccctgtctctacctttggctttcatgaagagagattcacagctcagaggaagggaggaatttctccagtcttcactttaacaaactcttttaagttttctgcctaccttatgttccctttggccaatgacccactccctgggaacaagatcttgttgactttcttgggaatctcctaagagataagtgctttgtgtcggagacaagttcaggtaaaccaaccaaggcagtgcctcccacagtcaaagagagaagctggagggccaaagcctatagagttgggcactacagctgctcatgctgcagaggagacagctagtcaggaaccctggagattcaagacaacttgctggtcccctttgcccagggctgtggtcctaatcacagtccttcacctttcccagggttagcctgtgtttcaaatgcatatgacctgcgctgagaggacaacagggggtcaggaacctggggttctctggggggcagactaagacgactccgggatccagacccttctgcaccttcagatgggagctccaggcagctaaggggccgaggagaatgggcagagatcatgctacaaggggaggttctggggatgaggcagtaatccccaccctcagtacaggtctgggttcgccgaactccttgagcctcagtcctttggcggtcccgggctagggccacagcagcatcaaaggaaagactacccccattcctccaagaggatcgagaagctcgggacccccaagccctttctccaggagtcccatcaagccggccaggcctcgggcatggatttgcaggtgccacatgaatcttgctacacattgcactgggcatcttggcaaactgtggcttggggggcaccacaggcacagagcggacctgttggacctgaaccagagtggaagctagacgcatgcccacgccacccaggccaagagaacaggggcatagacagccgtctggactgggctgcccctcaggctccatctcctctggctga

SEQ ID NO: 4459 - DNA, 582 bp, Homo sapiens
gcggacgcggcggacgtgggtgagggcgcggccgtaagagagcgggacgcggggtgcccggcgcgtggtgggggtccccggcgcctgcccccacggcacccaagaaggcctggccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcagcctggctcctgtctg

SEQ ID NO: 4460 - DNA, 2340 bp, Homo sapiens
atgcatttgagtatgattcatatagaattcagtagtaaagtcattagatcctggacttttctttggaaaagaaatgggaaaagatgcaaggtttttgtttctttttttttttttttttttggctctgtcacccaggctggtgtgcggtggctcagtcttggctcactgcagtcttcgcctctctggcccaagcaattctcctgcctcaacctccaagtagctgggactacaggcatgcacaaccatacattttgtatgttttgtagaggcagggtttcaccatgttggccaggctggtcttgaactcctgggctcaagtgatccaccttctttgtcctttcaaagtgttgggattacaggtttgagccaccatgcctggctgggagatttttaattaaggctttgattccattatttgttactggtttgttgaggttttcttttctttcctggttcaattttggtaggttgtgtgtccatgaatttatccatttttctgggtttttcaatttgttagcttgtatagttgttgatagtagtctctaatgagtctttgtatttctgaggtctcagctatatcttttttttccatttctaatttatttgggtcttctcctttttttcctcagtctagctaaatatttattgattttatctatcttttcaaaatccagcttttcatttttttaaaattttcttctgttttttgtttttttgtttttgtttttgttttttttgtctcagtttatttccgttctcacttttattatgtccctcttactactaattttggatttagtttgttcttttgtagttccttggagtgcattgttgcgttgtatatttgaagtctactttttaaatatagatgtttattgctgtaaactttcctcttagtatcgcttttgccaaatcccgtagattttgtgtttggttttcatttttttcaagaaattaaaaaaaatttaattaagtttctttattgacctattcgttgttcaggagcatgttgtttaatttccatgtatttgtgtgttttcagaggtttcccttgctactgatttctaggtttattctgttgtggtcagaaaagacagtttgccgtatgattttcgcttttttgaatttgttgaggcttgtttcatggcattgtattgtctgtgtatttgattttaccagtagcttttatatttttaaatattttcttttttgtacattatttgtttttctttctgattgaagaacttatatcttacattcctgtaagatgagtctggtggtgataaattctctcaggttttgtttcttaggaaaaaaaaattctctctccattttatttgaagtatagctttgctagagacagtattcttgcatgtcagtgtttttgttttgttttgttttttatttttattttcatcactttgaaaatgttgtcgccctcccttcttacctgtatgatttccattgagaagtctgttgggagccaaattgaatctctatgtttttacttttctcatgcttcttttaggatcctctcttcgtttttgaccttttgagagtctgattattatatatgccttggggtagtcttatttgggtcacatctgtttggtatgtctgaccttcctttacctggattttatctccttctcaagttttgaaaagttttctgttattattgctttccactttctgctgtttctccacttcctcttaaataccaataattcttagatttggtctttttaggtaattttgtatatgtcttttaggttatcttcatttcttttcattgttgtttttttcttctctgacaggattcttaaatagcctatctttgagctcactgattctttcctctcttcattctgttgttgaaagtctctgatatgtttgcatgtgtccccacccaaatctcatcttgaattgtaactcccacagttcccacatgtcctgggagggtcccagtgggaggtgattgaatcactggagtgtgtctgttcttgtgatagtgaataagtctcacgagatctgatggctttaaagagaggagttcccggccgggctggtggctcacgcctgtaatcccagcactttgggaggccaaggcaggaggatcacctgaggtcaagagttcgagaccagcctggccaacatggtgaaacctcctctctactaaaaatacaaaaattagccaggcgtggtggcaggtgcctgtaatcccagctacttgggaggctgaggcaggagaattgcttgaacctgggaggcagagattgcagtgagctgagatcccgccactgcagtccagcctgggggacaagagcaagacttcatctc

SEQ ID NO: 4461 - DNA, 892 bp, Homo sapiens
ctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctctagtgcctccttcgcctgcctgtccctctgctccggccccccgccgcctcctgcccccacctgtaggggccccaccctcctccagcacgtcttccctgcctccccaggggcccccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggctgcctacagcatcgtggccctgggcgaggagccggcccgagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccgggtcaccaggtgcctgcccccaccccccgaggggccatagg

SEQ ID NO: 4462 - DNA, 326 bp, Homo sapiens
aattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctacagctaatgtgtcagcagcatttttctcagttattatcaccttcctttt

SEQ ID NO: 4463 - DNA, 752 bp, Homo sapiens
gttatttatttatcatcagttgtagcagttctttatgtattctggaaccaagtctattggattccaaatacggtattttctttgtatatatggtaaatagaatactttctcttttaagtcataagatatattttaagatattaaatgactaaaattatttaggtcataagttaaatatttttttcctgtggtggtattttttaatcccttctttccacctagtcactttttggaatatctgtagcaataatagtaggaacagtagatgtgcctttggagtgaaaataaatagccatttaaaacataggcctttatcaacatttagttctttcaattaggaaatggagaatgaatgtttgagtttttaaggggaattaattgaatgatattttatcatttaagatgaaatcataacactagacacatagttgtatgttttaggaggaaatttagtttttctatctgtgcttctcatgaataggagcacttcttgagtactctggggtgatttaagccctttcccaccaactgtagtccgtttgctttattaatatttatttatttatttttgagacagagtctcactttttcacccagtgcactctgacctgggtgacagagtgaaaccctgtcttaaaaaacaaaacaaaatccaaatatttacacctgtgtcatcaccacccagatcattgtttagaatatttccgccaccttagaaagttttgtcatgccttttttttcagtcagtccct

SEQ ID NO: 4464 - DNA, 6650 bp, Homo sapiens
ctatgcattaatgtgattgaactacaaaaacagagtgcaatatgttcaaaaaatactcaactaaactttccccctgtcatatcactgcaaaagtgtccttttaaacagagccataaagaaatttttttcaaatttctttattgcacaggcttttttcagttttacctttctgggattgaacaatgttcctttcataatgccaaagcattcccttccccagaaaaatctccttggacaactggtttaaaaacgttattaagtcataggggaggaataagcggccaaaaagtcacatttttgcattggtttacgttgcttgattagactatcttcagagagcacattatgtgtttatagctttaatttgtattatgtcaatgaaccagtgaagtgcctaaagagatgcttacaactatccagtaggacacaactgcactgctttttaaacactttttggttagttaagggtgacttgaattgtacacatacatgctaatttttgaaaacttatccatttttcatagtaaataatatagataaaattttctgttagagttcccgcaaatatttcattttagacttacttgtgatataagatttaacttttcttttgtgaaagaatcgtgaactagtgtttcatgaaatcattttcctcttccatttatcatcctcctctggtacaatatattgggttgctttcttttagattttgttccagataggaaaacaaatatgactgtatacttattaacataaggtagttctgcatttttggattccaggatcctgtttgaaatcttccatgtgaggaaaaaattactaatatttttaaagacagggtggtttatttaaagagattattcagagaacttgtgccatatctcgtctgttttattgcatatgccatatgttaacttttattcaatattacattatgtagatatgtaatacaaagaaaatatttaggagaatggcaaaacacaaatggcaacataaatgtccatttgacttacctaacttcacaactttcaagttgaggatgtcatttattcttgaatttgtttttttactagatgctttcaattaatagccctatatttttgtgcaggcgaactgtataacaggataaaaaatgatttgtatgtattgaaaaggaggagaaattctcacagaacaccatatgagctttagaccaaaaggggaaacaaggtttaagtaactaaaatggccacttagtttgtgtttatttttttccctggaaatgtaagtagttggagtttaggctatggaaatattagtgcctttaatagatctctttccttgcaaagtttctttttagctcagcattgatctatcttatcaataggaaaataagttgacttggaactataaacaaaaacaacaccatatatttatgaacctcagtgaaccagcctagaaaaattgacttctgcaggtgctaaagcacctactaatacgcagcatgcacagcatttcaggttgtgaataccattttacaacgagtttgctgttaactctctttatccaatgcaaacttgaaattctgatgcggttttccagggtggtattttttcagagtattgaatttactatttagtaatttatagtatagctttttatattaaaatgtgatatttttaaaagagatatctggttcaattggtataatgacgtgattatgcaatatgctgatctacaccttgcgctcacattgtgccaaacttaaatgtgcaagtgtacgtgagaaaagcacatgtgaatgtgaattctttaattctttgcttattatgttaaaattagtcttcatagtccactgatgtgtatgcttgaataatgtctatttactttggaatttcaagatttccagcttcaatggtaatttataatttctcagatcaccttaagaaatattgagatactctcccacctgaaaataatctgttctttaacccacctgactatgggagtagccaggcaggtgcctcactggcttcttcagacgaggcttcctcaggtggatatatgactattaggggaaaagaggcttttgagacagcttattacctccttcccctttttgaactaagtacattgtctcagtcccagtatgaatttgtcccatttggggtatttttaaaataaaagatggctaacatggaatctggggcatagccttggcctttaattatggttgtaagcccaaataatggcagagaaacacagggctgtttttacaacagaaaactcaatataagttttatataagaatcctataaaatttgaaccagagctcctatttagttgttataatgtctcctaaagatcttaaatgcttctaaaagctaattattattccagagcaactttttccttttcccccttataaagtttttttttaaatccaaaatcttagatttctgtgccacagcaaaataaaatgatcaacaattaaagatctgtacttaaaatagtacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggctgaaagtcgtggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttactttcctgagttactttttctccattcattgagactatggattcatcccaactccttctaaatccctcaaccatccagctatattttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaatgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaattttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaa

SEQ ID NO: 4465 - DNA, 3203 bp, Homo sapiens
aattccctttggacggcagctcccctccccgccacgccccgtgctgcagctggagcagaggagctcacgcctgcgggtcgggaggcgcatccgtggaccatgggggcagctgggccacactgtccttcgccctgtggcctgctagcctggtcgagagaggtggtggggttctctggaatggtttcctcctgacacccagagctgtgcggggaggcagggatctctcatctcacagagattgtgcctgggggagcgtggaggcagggcctccaggtgctggaacagtcgggaggggcagcatcatggtgctcggtcagccgaggagagagggcagggctgccctgcagcccaggcatgggactgaccacggacagcgaggggacagccagtggtgctgaggctgggagggagggccattgggcgtggggcacgcacggtgaattttctagggaaattgctgcagtcaacacctggagccctggtctgggagtggcctgtggggtccagtggcctcatgccctgtgcccatatgatgaccccatgtgtgcctgtgtccacaccatgaccctgtgtgtgcccaggcctggaagacaaaggcgtgacggagagctggggctctgagagtgggcgctacagcagctgtgttctcgtcccctggactcccttgatttctggtggccagtgttggggtctgcaccgtgtggcactgaggctggatgggctggcagaggacaggtgggggcgtgggggggcgtgttccattccagctgaggctttagaggagggacagcccccttttaagtggatttccttctctgaggcacctagagccctcctcccagcctcccgtcacgcacttgccggcccagccacctgctcacagagggaaccagtggtctttcaggccccttccctgctctggatgaagaaggccattctcctgagctctgtggggctggactgtccgcctcaggcctgggtctgcttctgcccgaaccccttttgtggaaggtacatgggagcccagtggacccctgcacttctccggagcctgacgcccctccctggccggggaggggtgctggaagaggcccgccgggctccagggtttccgaggtccctccgctccgcagatgctcactggcctctggggcgttcactcctctcacggagggtgcttcccttccgcctgtacctacgggcagctcacggccgtgggatggagaggggactcctgtgtgtgccccgcaggcaggtgatccatcgtccactgcgagccggccagagggaacggccgtgccttctggccccgtgggctgtgctgactcggtggctgtggggctcgggcccagcctgccctgccctgtgggttctgctgctgccttcctgctgtgaggtgggctgcttccttctggccagatgagcagagggcagcgttccctttggagcccgatgggtgggctgtcccgtgagtccctagtccacccgagtcttgggctgcgctgccttctgacgcccctctgcagagacaggttctcagttgccatgaatggcaccatgacacccgagccatgaagcgtgaccccgtgtgggcagaaggctgcaaggcctctccgtccaccccgcaccttcctggggcctgtccagctgcaggaccatagaggctgtggggagtcgtggagggcatcaggtgctggggcctctgtgtctccagagtaggcaaggcacgcgctcctgacagcccccaaggattgagcaagacttcagaatgagcttttctgaaggagctttcctggcagggactccggggtcagtgagtgtatgagaggccacatacctggcggcatctccctgtgttggaaacttcaagagcagggtctcagggtcctcatgtccagaggctgaggatggaggtggaaggctggagggcaggggtgaggagggagcaggagggcaggagttgggggagcaggagggcaggggtcaggagaacaggagaacaggggtaagggagggcaggggtgagggggagcagaagagggatgagggggagcaggagggcaggcgttgggacaggagggcaggggtgagagagcaagggggcaggggtgagagagcaggagagcaggggtgaggagagcaggagagtaggggtgatggggaataggagggcaggggtgaggagggagcaggagaacgggtaagggagggcaggggtgagggggagcaggagggcaggggtgaggagagagcaagagggcaggggtgaggagagcaagagggcaggggtgggaaggcaggagggaggtgggggggcaggaaggcaggggtgggagggtcaggagggcagggtgaagggggggctggagggcagcggtgacgagggcagcctgtctcccacgtgtggtggctgcttcctgtgtgccctggggttggctctgtggaggggtgggcactggctttggaacacctccctccccttcctcctctgccacccagtgccttctaaagggcagcagaaagaggcctgctaggcaggggtggcggaggccaccttccttctcacaaatacttcttggccctggccctgtgctgcccgggcaggtccccaggctcaggggctgagaggctgcttactgctgcaggtggaggccccatgccggagggagagcggggttccccccatgcctctccagccctcctgctgcccacggcccaagcccaagcttgtgccggtcattacggccttgcctagctggcagggacagctgcgtgtgatgctggtggagatgccagatgccgcctgccctgtgaggacggctggcggggttgtgggctggcggggctgtgggaagggggctgccgatcatggtgaaaggggacattttcattgggtcctcgtggtccgtgtcctgggtactcggggtcaccgtgcagacagctgccctttgtctgccggacacagtgcaggcaggggagacaggtttagggctctgacatggggcacagggactccgagccaagggatgtcagggcagctctgtgcatctgaggcctttgcccttgctttgcgggtcagttcatgtccaaagcactttaggaggctgcagggatcaatacccaatatacccaacaactggaattgtttacacatgacctacattttggacggtttatcaataaacatgtgtgaacaactgtta

SEQ ID NO: 4466 - DNA, 1630 bp, Homo sapiens
gccaaagcggcctcgaagcgggtcccgtgtctgcggcgggcggcccccggcgcggagggcagggcgcggggagcccgggctcccggtgtcggcggatggcgggagcccgggggccgcgggctcgcggggcagcgggcgagagacgagacgccgagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaa

SEQ ID NO: 4467 - DNA, 5007 bp, Homo sapiens
gagctagttaattttaaattccccgaggtccttttactgagatggaaaagcacaaacagtcaaggaaaaccaaagagggaggggtgagggaaggggaaagtgcataaagcacttaaagattttttaaaagtaggtatgatagataagccacaagaagtttttaagactactaataaccataattctattttaatcagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgtcctccagttctgcatccttggattcaaccaactgtgggttgaaaatactggaggtaaaaagacaaaaaataacaatgaagaacaacaacaaaaatacacagtataataattacatttacatagcatttattttgtattagacattataagtaatctagagatgatttaaagtatatgggagaatgtatgtagattatatggaaatatgagggtattttatttaaagggacttgggcctgtggataccaaggaataactaaggtaaaactgagcataagtggcctgtccatattttgttaaatatcagattattgattagtgatcatcaacattttcccgcattcatgcagtgcggcctctgaaaacatggttgaacatcctatggaatttttttttttttttgagatggagtctcactctgtcacctaggctagagtgcaatggcgcgatcttggcttactgcaacctccgcctgccccacctcgggttcaagtgattctcctgcctcagcctcctgagtacctgggactacaggcatgcaccaccacgcccggctaatttttgtatttttagacgagacagggtttcaccctgttggccaggctggtctcaaactcctaacctcaggtgatccaactgcctcggcctcccaaagtgctgggattacaggtatgagccaccgtgcccagcagaattttttaactatttggttacgactaatttggataatgtagtgcatgcagctttgatttgtgccactaagagtgggcaaactgtcttcctttttgtgaatcagtaaaaattttccctcaacatgtgtttgacagttgtcattcactgctaagttaaggcatttggtaaaccacacagcctctgcatccttcctagcgacagccacaagaaaaggtgggcatgggagggaaaatgctcttgtgaattgaactggaggcaagctccacttttctttagaaaaagatgtagatcaaaataactaatattttcttccttgctcgatttctgtgccttccatggtacatcaaaataataggaccagtaatggccacaatcctgttgactgctgttaccttcgccccaatatttctttaagcatttcttaagcatctagcttgtgttttgttatatttaacagattttcttaaagtattgtatgaattaaaaccagaaataacttcattttcctagaaagggataatttctcccggagaataaatcctgaggatttagttagatgctgtgggtattgtattttaaataatattttaatgggagcagctgattgactttcaaatggattgtttacattaatagtaattctgcagttgttttactattgcatcagtctgccagacaagttccatgtgcatattttaattcagaactaattatacttaaaaatttaaaccctgcatacttccccaaaaatgtttagggcagttaaaaacaactcttttggaagatgactcgcattttaagaaatgagagaacactgtcaaatgatgaatgcatttaaaaaataatttgcaaagtgataaaagcccttagttttaaatcttacaatgacattagctcttacaagaactcagtaagtatttgctgttttttaatgggatagtaataaggttgaggtttttgttaagggacgtttacttatcatcaaactctatacttactactacaaggaaactccaagtacattaaacactatgttttataattctttgccacactgccaataaattctgttcacattttaaggatgacaagtccactatatgtaacacgtaagaatgctatcctggcagtagacacagggccagaataaactggcaagttttcattccacacaagtgtgggaaaaaaatgactacaacttaaactttatttacttgattgagagcttattgcacatgaaatgttttatgtggttgatcttaacttcgtttacattgacttctatgctcaagattgttcaattgctgctgctgccgttgtgttttctttcaggatcgaggtgggtaccttcatataatatcttctttttaatttcttctctggcaattctttcctggattctttgctttgcataattatacctacaatgaaaccttagaagaaaagaatatgaataaattgttaatataaagtcctacagaaattaatttatgaaatttctctaaatcacacaaaacttaaatacagatgactactaccctgagactgaaaaatatgttctaatttatagtgctatttttgggcagttttggtgtcagaatacctatcaacacattctttttttattaggaaaaaaaggatgtctacataacaatttgtaaagtgataaaatccattagtttttaagtcttctgatagcattggctattataagaaacaagtatttgctctcgtttttaacgggataataatgctatgtctacataaaatgatttctaccaccttaaatagctcactgtagaaattcatgtataaatggaaccatatagtacatacatatcatactcttaggtctggcaaatatttgaggttcatccatattttatattcactcatcagtagttgtaaacacattcttaaagtagcattttcagatatgaataagcagggatgaaataagtattagggtaagggaaatggttgaggctttcctaagtgaagtgtaaaaaccacagctttctttttaatgggatgtctaatatgcatttatctgttcaagcattttaagatttccatgaaaatgtcctgaaaaatcaagattcttcattgagggtgaggatctcccaatgggagactgctctgaaaagagcatgtgctttttgaattagataacctactataatcatggatgttcttgaatacttagcaaacataccagcatcccaaagtcaccaagataaaccctcctactccaacatcacatgatcttctaattctacctgtaaaaataagcataacaattaattagaatataattacgttatatacattactccacctagaaaaaaaaatagttcattatgtagagaaatgctttttttagtacatagagaaataaaaaatacagatactcactagtgaacaaaaaatgtccaaagccagccacaacagatcctaatgaaccatacaatattgaatgccgggcgcagggagtattttcaacatctaaaaatcctaggagcttaagggactagaatgaaaaaaaagaacctagattgagtaagaaagtatttcattttggggtgctttggcaaaaatgacaatacaccatttcttttcttgtagttgagggtttaaactagagtatgtgccacgtgacaacctaaatcagcttgcgttgtctttgtccacctttggtatgcagtctgaatctttaaatccgaaaaccttacaaattggaccggaaaacccttaagcagtagggtaacttggagctgtatcttaatttgctaatcaactgacttggaaataggataattcattttatgagctctttaaatgagtttatttgggaatatgcctatcattggaattgaaagcagcatagcttgcttcagtaactccaataatttgggaagcagaaatggaaaaagtaatttgagtcatgtttgcttatgtagtgccgtttaaaattcccctagtaattacctttcatattttattaactaggttaacatcaactgtggttgtaagagtaaatgtttcaccttaagataaacatgggcaatatattaaactctagtctgttttcttgcctgtgaagtgaggctgcacttgattatatttgattctttgttcgtaatacatgggaacgacagctaagtgtggtgaaaaacgcggggatccaaagagctggatttttatctcagatctgccgctaacttttgtatcctataggctacttttatttctatggtctcaatctataacatgaatgggttgggttaaatgactgaagttccttcaagtgctaaaattctttttctacagtcttcattggatttatgtatttcttattcctaatatgtttaactgggatgtctgtcactctagggcggcaagacagacatttaaaagtaacagtcacactgctgaactggcatttctgttaacacaaaagtttagaaaactcacggtaactgttacttgatttaagtgtatataaaattttcagtaaggctgcttttaaaaggaaccactgtccatttaaaggtttcatagttatcttcaatgggttagtattgtttggggcaggacattaaactagaagggattctataggatgaggtgatacctagaaggtaatatattgtaaggcaaaagagattagaagaaatggggaaaggatagtaaaaggcaagtcagattaaaggttgaaacatgaagatattctcaattgtatttctgcctatgtttgcttttttggctcaagcatctgttggaagagacaaaatgtgacttggttcataataaagcaagaattatttactctcgga

SEQ ID NO: 4468 - DNA, 5883 bp, Homo sapiens
agtcacgcgaggctggcttgctggaaccggctagaaaatgcagccctgcctgccgcagggatctcctccggtatggccacacatatgagttctggcaatgcccattagtgatatggccgatagtttcttctgtcttgcttccaggaaccttttcttggtttgaagccaccgaaccagaagagagaatttttaccactttgaggacttcttgtgacgaatccaatgggaattccataatattcagaaacaaaacattttgagggccaacaaattattaagccctttgctaggtcttagagatacaaagataaagaagactggagttttctttttattatctaccagactgaaggccactgcctggggacttgatctaagagaagaaatatcaggagacctgggtttggctcctggctctgccaggtgatcatggagcagtcacgtattatccctgagcttccgtttcctcatctacttaattagtgatgggtctacagggccttgctggggtccacttctgacattctgtgttgcatggaccatgtcagagaagatggagacaccttcacggcctgttagtcacatctcaccaaagcttctcaatgggctgtcagacaagaaaggagcctcctgtagccatcttaatcagcatcccccatctgtgaggtcatcgggatatttcaaacaatcttcagctctcattagttgagtgcgtttcacaggcaattgtccggaaaaggaagaggatgacactgatgaccagccgtcttgggtggttcacaggctcactaaggaggcagtgttgagcctgacggatctgtgaaggcccctccgacttgtaactgtaaaatgatgactcttgatggaactctacagttgttgacacctggtgggccacctacagctgaaggttcaaagtgataaaacaaacctggtacggaaataactgattgtggaacgcgaaggacctgtgatcatgcaaaggtgacagagcagacactgatagtagaactgtggagaagtatccctggagatgacccacaatctcaagaaggctgaagaggagaggaagagaatggataaatcgaaacaagtgtttagatgatcaaggccttataagccataccgccatgtaagacgtgccattcaccttccaccatgattgtgaggcttcccctgccatgtggaactctaaggtccaagacattgtggaacagagacaagccatttctactgtgtccttattgaatacctggcccacagtatccctgaccataacaaaatgctacccatcaaataagagaacccattgcagaaccagaagggacatcatccaagctgtctgaaatcccggttggtactccaggcttcaacaactgcagcacaatgagagacagcaaagaacatcctggcctttgacaaccccctgtcttctaacatactgaggttaatcagaccgaggacaatttggaaggggctctctgccacaacttggggagtggagacaggacgggggaggagccaagatgaccgaataggaacagcttcggtccacagctcccagcgtgagcgatgcagaagacgggtgatttctgcatttccaactgaggtaccgggttcatctcactggggagtgccggacagtgggtgcagcacaccatgcacgagccaaagcagggcaaggcatcgcctcacctgggaagcgcaaggggtcagggaattccctttcctagtcaaagaaagcagtgacagacagcacctggaaaatcgggtcactcccaccctaagactgcacttttccaatgggcttaacaaacggcacacaaggagattatatcccgcgcatggctcagagggtcctacgcccacagagtcttgctcattgctagcacagcagtccaagatcaaactgcaaggcggcagcgaggctgggggaggggcgccagccgtggcccagttagttgtttgattaagcaaacaaagcagccgggaagctcgatctgggtggagcccaccacagctcaaggaggcctgcctgcctccctctgtaggctccaactctgggggcagggcacagacaaatgaaaagatagcactaacctccgcagacttaaatgttcctctctgacagctttgaagagagtagtggttctcccagcacgcagcttgagatctgagaatgggcagactgcctcctcaagtgggtccctgacccctgagtagcctaactgggaggcaccccccagtaggggcggactgacacctcacatggctgggtactcctctaagacaaaacttccagaggaaggatcaggcagcagcatctgcagttcaccaatatccactgttctgcagccactgctgctgatacccaggcaaacagggtctggagtggacctctagcaacctccaacagacctgcagctgagggtcctgcctgttagaaggaaaactaacaaacaaaggacatccacaccaaaaacccatctgtacgtcaccatcatcgaagaccaaaggtagataaaaccacaaagatggggaaaaaacagagcagaaaaactggaaactctaaaactcagagtgcctctcctcctccaaaggaacgcagctcctcaccagcaatggcacaaagctggacagagaatgactttgacgagttgagagaagaaggcttcagatgatcaaactactccgagctacaggaggaaattcgaaccaatggcaaagaagttaaaagctttgaaaaaaaaattagacgaatggataactagaataaccaatgcagagaagtccttaaaggacctgatggagctgaaaaccaaggcacgagaactatgtgatgaatgcacaagcctcagtagctgatgcgatcaactggaagaaagggtatcagtgatggaagacaaaatgaatgaaatgaagcgagaagagaagtttagagaaaaaaaataaaaagaaatggaccaagcctccaagaaacatgggactatgtgaaaagaccaaatctacatctgattggtgtacctgaaagtgacgtgacggggagaatggaaccaagttggaaaacactctgcaggatattatccaggagaacttccccaatctagcaaggcaggccaacattcaaattcaggaaatacagagaatgccacaaagaaaatcctccagaagagcaactccaagacacataattgtcagattcaccaaagttgaaatgaaggaaaaaatgttaagggcagccagagagaaaggacgggttacccacaagggaagcccatcagactaacagctgatctctcgggaagcccatcagactaacagctgatctctcagcagaaactctacaggccagaagagagtggggaccaatattcaacattcttaaagaaaagaatgttcaacccagaatctcatatccagccaaactaagcttcataagtgaaggagaaataaaatactttacagacaggcaaatgctgagagattttgtcaccaccagacctgccctaaaagagctcctgaaggaagcactaaacatggaaaggaacaaccggtaccagccactgcaaaaacatgccaaattgtaaagaccatcaaggctaggaaaaaactgtacgagcaaaataaccagctaacatcataatgacaggatcaaattcacacataacaatattaactttaaatgtaaatgggctaaatgctccaattaaaagacacagactggccaattggataaagagtcaagacccatcagtctgctgtattcaggaaatccatctcacgtgcagagacacacataggctcaaaataaagggatggaggaagatctaccaagcaaatggaaaacaaaaaaaggcaggggttgcaatcctagcctctgagaaaacagactttaaaccaacaaagatcaaaagagacaaagaaggccattacataatggtaaagggatcaattcaacaaggagagcaaactatcctaaatatatatgcacccaatacaggagcacccagattcataaagcaagtccttagtgacttacaaaaagacttagactcccaaacaataataatgggagactttaacaccccactgtcaacattagacagatcaacgagacagaaagttaacaaggatactcaggaattgaactcagctctgcaccaaacagaccgaatagacatctacagaactctccaccccaaatcaacagaatatacattcttttcagtaccacaccacacctactccaaaattgaccacatagttggaagtaaagcactcctcagcaaatgtaaaagaacagaaattataactaactgtctctcagaccacagtgcaatcaaattagaactcaggattaagaaactcactcaaaacccctcaactacatggaaactgaacaacttgctcctgaatgactactgggcaaataatgaaatgaaggcagaaataaagatgtgctttgaaaccaaagagaacaaagacacaacataccagagtctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggaaatagagacacaaaaaatccttcaaaaaattaatgaatccaggagctggctttttgaaaagatcaacaaaattgatagaccgctagcaagactaataaagaagaaaagagagaagaactgcatagatgcaataaaaaatgataaaggagatatcaccaccgatcccacagaaatacaaactaccatcagagaatactataaacacctctacgcaaataaactagaaaatctagaagaaatggataaattcctcaaacacatccatcctcccaagactaaaccaggaagaagttgaatctctgaatagaccaataacaggctctgaaattgaggcaataatcaatagcttaccaaccaaaaaaagtccaggaccagatggattcacagtcgaattctaccagagttacaaagaggagctggtaccattccttctaaaactattccaatcaatagaaaaagaaggaatcctccctaactcattttatgaggccagcatcatcctcataccaaagcctggcagagatacaacaaaaaaagagaactttagaccaatatccttgatgaacactgaagcaaaaatcctcaataaaatactggcaaacctaatccagcagcacatcaaaaagcttatctaccatgatcaagtgggcttcatccctgggatgcaaggctggttcaacatatgcaaatcaataaatgtaattcaacatataaacagaaccaaagacaaaaaccacatgattatctcaatagatgcagaaaagacctttgacaaaattcaacaacccttcatgctaaaaactcccaataaattaggtattgatgggatgtatctcaaaataataagagctatctatgacaaacccacagccaatatcatactgaatgggcaaaaactggaagcattccctttgaaaaggggcacaagacagggatgccctctctcaccactcctattcaacatagtgttggaagttctggccagggaaattaggcaggagaaggaaataaagggtattcaattaggaaaagaggaagtcaaattgtccctgtttgcagatgacatgattgtatatctagaaaaccccattgtctcagcccaaaatctcctcaagctgataagcaacttcagcaaagtctcaggatacaaaatcaatgtacaaaaatcacaagcattcttatacacgaataacag

SEQ ID NO: 4469 - DNA, 20864 bp, Homo sapiens
agtgagcagcactgcccgcccaggcaacctggaaccagggtcgtgccccacgacagaatctcgggggccttgggtctggcgctgcgggctcacccgctctcagagtgggagtcctggctcctgactgccctgaccttcttcctgccactgggcccatgatgggggtccccaactttcaagaacacaggggatgcgcattctcaggaaacacgtcccctcgccaggcccctgggaagagtcaaaaccacgatgcctgcccctgaagcgcccgcgcggctccacggggctccatgttgtcacccactagctcctggacgctatcagcccgcagcagggtttcctggccagagaaaccgcctgttggggtgcggagcgttccacgtcccctcgcagcaccccgctggccttctgggccgccccgcccccaacccgcgcccgggcgctgacgtcatcggccgagcccgactcggaaccaccgcccgaaagtcacgcgcgcctcccggcgggacgtgccctctgcagagatccctccgccgccgcctggaattttccagatgtcctgccggcccttctttcgggcctcggctgggcgtggtgacctcaagcgaccccggcggctcccgtcgcccactcaagagggcgcccccgcccgccacgcccccagcccctctcggggaagcgcgtcccccgcccgacctcaacaacatccgggaagaaaaggggtcttcttcctcatggcattcgcctcccaaatgtcaccttgagcgctgtccgcgatcccaaaaagcactgttaaagagaagcggggatacactggggtccttgcgtgggggccgcctgggagaccatgcaccgcccgggagtctctccgggcagggtcggggagggacttttttgccggtggccgtggaggaatcgtcccgttgagcaatgaccccggtgacgcggctgagggctataaaagcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtg

SEQ ID NO: 4470 - DNA, 466 bp, Homo sapiens
atggtgccgaaagtgaagaaggaagctcctgcccctcctaaagccgaagccaaagcgaaggctttaaaggccaagaaggcagtgttgaaaggtgtccacagccacaaaaagaagatccacacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagatcaaacaggctgtgaagaagctctatgacattgatgtggccaaggtcaacaccctgattcggcctgatggagagaagaaggtatatgttcgactgactcctgattacgatgctttggatgttgccaacaaaattgggattatct

SEQ ID NO: 4471 - DNA, 468 bp, Homo sapiens
atggtgccgaaagtgaagaaggaagctcctgcccctcctaaagccgaagccaaagcgaaggctttaaaggccaagaaggcagtgttgaaaggtgtccacagccacaaaaagaagatccacacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagatcaaacaggctgtgaagaagctctatgacattgatgtggccaaggtcaacaccctgattcggcctgatggagagaagaaggtatatgttcgactgactcctgattacgatgctttggatgttgccaacaaaattgggattatctaa

SEQ ID NO: 4472 - DNA, 1050 bp, Homo sapiens
tgtttttagtaagacttttattttaaaaattttcaaaatataaaaataataaacaatatggatttaacaaaacataattcaactataaataataaaaatgttgacaaccccacataaacatttaacactataaacattctaagcatacaagagtagtattctagttcaagttttatcttttttcagttcaagttttattattactttaaaaaaataaacaaaaaagctgctacagcttaaccaattgctttcgctccactcaaagagcagggaaattttttccccatgccaacacacattcatgaaatgggatacttatgggcacaggtatttaaaactggaacaatccagtctccagacaagaagactcctttggtgtttttcaattcaacagtccaccgaaattgagtttaaataaaccacttattagaagaaatcttgtgccagacaatatgttctgaagtagcatcatacccaaaacaggtttagccttctgagaatgaaaagcaggcatccatgaatgctttgctgatacttaaaacattctatcatatgaacattcattaaggtgctggaaggaaatcttgggacaaaacaaaaaaatcgacacatcaatgcaaaacatgtttaactttttaattcattttcattttaaattgctcatgctaatgaacacagtagtatggctttacagatttcctagacacaatcctcaatttggctcagacttgaatatacgtcatccaagagaactttttcgttccttcttaaggtgtttaaaaaataaatggctataaagtatggggagaaaacatttaagaataaggtcagagcacacattcagatacactttggactcagatgtactcttagagaactgtagagataaaatgctaattatagtacatgtaaacatctgttcaaattgataaagagtgaacataaaataataggatgatattattgtaacagtcgtctccagacaggaactggtcttgctcttgcagtcacaaagctaaattcaggcaatgatgatctctctctgctgga

SEQ ID NO: 4473 - DNA, 1438 bp, Homo sapiens
aagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggtagctcctaggagggatatatgggtcgttctttcctttttccttatttaaatgggtttttattgacaccatgtcgcgccaaaatggattccatctcctcagagctttcctaggaacagcctaacctcttgggcctaactttattttttttttgttctgcctttcatgtccagacttattagttttaattaatttgtttgtaacgtattcattatgcactagattaaacaatttttttctgtgcccactataccccaaatgtggagttttgggcaaaaacttaacatttgttcttgaagcatctcagaggtgtgtgtgtgtgtgtgtaatctttgggggacttacattgccaggttgattactcactaagaaaagagctagatttcctgttttcaaatctgttggcgaaattaagtttatgttaagcatagcatgtttactatatatatggggaagacagttaagagtgacatctaatatgttgttaaatgcttatgtgattaaagtaaatttcatgcattaccgcggagtatgaattgctgcaaccttttagaaaagaatctggcaatatttagggaaataaaaaatacagatatcacttgaacaaaaactggaattcaaaagtctgacttttaagaatctatcctacagaaataaaagtaccagtatataatgacgcatgaacaaggatacttttgtactattttgttcttgtgacaactggaaacaacctgtgtatccatcaataggagaatgtttgagtaaattttggtacataaatattatgaaatattttgacttttgacctagagaatcttatgatggatggttatgtgagaaaagtaagttgcagaatagtctagtatgagtccttttttttttttgatggggtgatgaaggaatgcaagattaacttctttatcttttggaggagacgttaaatatattatgaaatacttaagacatatacagatatacaaggaataatacaatgaacctctcttctcaccacccaacgtaaaaaaaaaatcaaacattaacgtgacagttgaagttctctgtgtacccatccctgattgcatctctctcttctctcatccccagaggtaaccattattttaaacttagtgatttttaccatgcatttcttaaacttctgtgacatagcaacttctagcatggattattttttgtaaatattgaagatgaatttttaaaaaaagtcaatgaaagaaga

SEQ ID NO: 4474 - DNA, 468 bp, Homo sapiens
tctccgagcggcgggccgagggagggcgcagcagctgctccctgaacactttctgacccaacagtcccccagcgccggacgcgccgcgccctggcggctctagggaccccccccgcgcctgcacttagccccgcgcccgagtccacagacaaacgaatttaaaggagcaaccgaggaggcacctgcgaaagaaagcccacacacaggtgaatttaaaggagcagccctggtgtcacctatcagtaaaaggtgagttataaatacatgaagacacacgtatgcataagagtgcatagagctatacacacaccaagcacatacacaaatatatccatccatcttcatccatacacacttttgtcaacacatttacacaaacccatgcacaaaatggaaacacaaaacacggagacagatggacatttgtggaatttactctcaggagcctgcatggccatacagagtgtt

SEQ ID NO: 4475 - DNA, 671 bp, Homo sapiens
gcttgcggggcgctcccagctgccagcccgctgcacctatcgcggactctgtttcgccgacccggagtttgtcgggcccggcggctcgaaccttgtggttttttatttgacggggcagatggagtcagtacacaataaataacatgaatataggaactgcgccgtatcgcggctggcggggtggggcaagacattggccagacctttagtctgcagcaggacagaaggacagccggacccctgatcttgggcaactggcgacccgcggctgggaaccggggctaactcttccctcagagttccacgcgcgcatcgcggtaggcccggtccagagcccactcgggctgtgagtcggtgcccccttctcgggcaaggcgggccatctcctgttggaacagcgcttgccgcgctcggctggggtccacattaatccagttgttggcaatccacttggtgccgcgcgtgaccaggcagcccccgtgcagcgagtagtcgtctacgtcacccacccaacctagaagaggagggtgacgtgagatcctaggctgggctggccagagcttggcctcataggcaccaagagcatgaccaaggtgggtccagctatgcattccttgtgtagcaaacacccagacctaaagcttccttggaggctcctcatctcagcccac

SEQ ID NO: 4476 - DNA, 1982 bp, Homo sapiens
aaggtacatcaagatgcaaacaatttttttatcttcataacttcctgctcttattaacttgtattatgaatcaaattaagttttatgtataaggcatttactattccagtgacttagctaatgaaaacatttaaaaatatgtattaatttacttggcctgctactaaagtgcttaacataactaaatggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaatttttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaagccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttacagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtat

SEQ ID NO: 4477 - DNA, 3627 bp, Homo sapiens
cgagactgcagagggagtagtgcgatcctgcgcgcgggggaactagctggagggcaaggcgggaacacgccactgtgagcatgcatttcaggttgttggcgcagctctgctccatgatgtcgatctgaaacccagattttccttctcttgccactgtcatctcctgcatggccaaagctaggtcaccatcatagtcatgtttcagcctatgggaagggggaaagacaatattcaagcatctattgttggggtgatcggacctaacaccaggttgtggggacaacgaagtccagaagagtgaaaggaatgagaaaagacagtttgagagagaaagtgggcccagggggccaatgcgagtatggaggctgtgaaggccccgagccctggaagcccagactatttattggtgatcaaacaaagaaacaggtggtgagaatgtggggttgaaagggagcattgcattaagcacatgatttacagctgtgatggtttagcatatgctctgctacttgagataatggagagcaggttcttttaactcaagatacaatagatcctgggagagcagggagcaaggagccagccagcctagacacattccagaggccatgagccctggattctttccaagccacaaggggttttatgccctgggcttagattatggtgcatcagggtagccttccaccctttggcgcagagcttggtgttccaaaggccacgaggggttttagacccaggatcccagacatatttcaagacttttttgtattatgtcagacatgcaagccctgcctcagcttctctcccaacactcagcttttctcccaacatttattaaatagctcctatgtgcaaagcagtgtgccgggtaccttagtcacagtgggcaccaacatttaaccagtctctggctacatgaaccttagaaatgcttagataaaaaaggtacatatcagcagttatgttatatatataaattatgtaaataagttattttataccaaaaaagtacgtattttccagtgcaacttaattaattggtattctgatttatacatcaatctaagatgactttgttaatatgagtccacaagaggctatctagatacgtgggttaaattgagtttctacacctgctaagctgagagccaaactgtggtgcttggagacgcattaaaggcacaatcactcttggcagtgcttctgggtgctcagcaggcatctcaccctaagaactctaggccattctgattcatttcagtagtagggagcaagttttttttttttttttttgagatggagtctcactctgttgccaggctgtcaggctggggtgcaatgacaccatctctgcttactgcaacctctgcctcccaggttcaagcaattctcctgcctcagcctccccagagtagctgggactacaggtgcacgccaccacacccagctaatttttgtatttttagtagagacggggtttcaccatgttggccaggatggtctcaatctcgtgaccttgtgatccacccacctcggcctcccaaagtgctggaattacaggcatgagccatcgtgcccggccgggagcaagttcttatacccgttcacatataccactacacagatgccctcactgaaaaatatgaaaaataaacatagagttttgtttttgttttaaataataagaggtgggtatgagggggatttttcaaattagaaatattggcattagaaggtagatataattcaacagttaaagaaagtgtaattaaaaaccatgatttaccccgggccgagggtgaggcaggtcgggcgtccccacaccgggcccgggcaccgggagtgggcgtctgggcagcaccgggtgatggccctgctgctggtgctcctcgcctcctggggccttgggcaatgagggggccggtgggcgtgggctgagtggccgtgggcgccatggagtgggtgctgtacaagtggaccaactatctgagcagttggcagccttgatggttctttctctgtaggggaatattgtcctattatgattctcctgaagatgcctggaaaggttgcaaagggagcatacaaatggcagtctgtgaaattgaagttcattctgtagataatacatgcatggacctgataatccccggggaacagtatttctacctgaaggccagaagtgtgcctgaaagatagcggcggctggtggccctgggatcagccaaggcttgcctgactgacagtaggacccagaaggataaagagtttgctgaaaacactgaaaacttgaaaaccaaaatgtcagaactaagactctgctgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagattgcaaatgcagccttcacctctgagctgctctaccacactccaccaggatcaccacagctggccatgctcaagtccagcaagatgaaacatcctattataccaattcataattcattggaaaggcaaacggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataaccgtccaaggtgaaataatgaaggaagatagaatggaaaacctgaaaaatcatgacaataacttgtctcagtctggatcagactcaagttgctctccagaatgcctctgggaggaaggcaaagaagttatcccaactttctttagtaccatgaacacaagctttagtgacattgaacttctggaagacagtggcattcccacagaagcattcttggcatcatgttgtgctgtggttccagtattagacaaacttggccctacagtgtttgctcctgttaagatggatcttgttgaaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggaaaaggatatccagacagccctgaataacgcatatggtaaaacattgcggcaacaccatggctgggtagttcgaggggtttttgcgttagctttaagggcaactccatcctatgaagattttgtggccgcgttaaccgtaaaggaaggtgaccaccggaaagaagctttcagtattgggatgcagagggacctcagcctttacctccctgccatgaagaagcagatggccatactggacgctttataagaggtccatgggctggaatctgatgaggttgtatgatggctgctgggcagcacctcctaacttcagggaataaagtgctaaagtgtaaaaaaaaataaaaataaaaataaataaataaataaaattaaaaaaaataaaaaccatgat

SEQ ID NO: 4478 - DNA, 2882 bp, Homo sapiens
caaaggagaaaggagagcccagagagatctgtacaggacctctcttgcacatggtgactggaggcagagggtggggagctggagaggagtccagtccctccaacaaatattgagggcttcaaagagctcttcctggacgtttctcttaatctggatttaaaagggacaggaggtatcttagggtccaagaacataacaggaatgggcaactctagaagtgtttgtgtgtggaaggccctaacctggccctgtcctccctgtctctacctttggctttcatgaagagagattcacagctcagaggaagggaggaatttctccagtcttcactttaacaaactcttttaagttttctgcctaccttatgttccctttggccaatgacccactccctgggaacaagatcttgttgactttcttgggaatctcctaagagataagtgctttgtgtcggagacaagttcaggtaaaccaaccaaggcagtgcctcccacagtcaaagagagaagctggagggccaaagcctatagagttgggcactacagctgctcatgctgcagaggagacagctagtcaggaaccctggagattcaagacaacttgctggtcccctttgcccagggctgtggtcctaatcacagtccttcacctttcccagggttagcctgtgtttcaaatgcatatgacctgcgctgagaggacaacagggggtcaggaacctggggttctctggggggcagactaagacgactccgggatccagacccttctgcaccttcagatgggagctccaggcagctaaggggccgaggagaatgggcagagatcatgctacaaggggaggttctggggatgaggcagtaatccccaccctcagtacaggtctgggttcgccgaactccttgagcctcagtcctttggcggtcccgggctagggccacagcagcatcaaaggaaagactacccccattcctccaagaggatcgagaagctcgggacccccaagccctttctccaggagtcccatcaagccggccaggcctcgggcatggatttgcaggtgccacatgaatcttgctacacattgcactgggcatcttggcaaactgtggcttggggggcaccacaggcacagagcggacctgttggacctgaaccagagtggaagctagacgcatgcccacgccacccaggccaagagaacaggggcatagacagccgtctggactgggctgcccctcaggctccatctcctctggctgaggtggctgtggggctacctcttccatctcagaagagtgaggattgccctctttggcacagtcaacctccagggacgctacacctgaaccttcagagagggtgtcctcttctaaatagtaccctccagccctctggtctccctcagcctctccatccccactctcccgttccttgctgacctcccctgctcctccttcagttgctgcttctgggcttctgctgtcttcaccatctccttggtcttttcttgcttcatggtaccccttctccctctgtcctttgtcctcatcctctctgactccctcagcctcttgtttctgtacaacttcccatttctcctcagcaacttgatcttcctgggccccttgctctaggtcccttccagcttctacctgggcttcctctctttgttcatcctcttctctctcaatttctttttccttctcatctgtatactcatctcctcctggttcctccacacctttagcctccatactgtcagccttcttctgacctttggacttctcttccttggcctctgtctcttccctactcccttctctcaatctgacttttgtctcttggcttcccccagcctcccctctatcctcactggcctttccagcctccaccttggtctctggacttccctctgcctcttccctgatgtctagcctgcctccaggctcagcctgcttgtcctccccaacttcccagcatgcctgctcttccccaccctgtcccagagcctgccttccacatcctgctgcctctccctccagactccctgaacccttccagattgggggtttaggtcccagaaggggacttaggtcatcataggcactcaggaaaacttcctccccattttcctcctcaacttcaggcctggggccagcggagtccagggaacagcagctgggggccaagacaaactgtgcctcatccagagacaggtcatccaggggtggctccacagagaactcctccacctgtaggcacagcattgtgactcaggaccaggaggccctgtccacccttgactccatgccacccccaaacccagcacggctctccttacctgaggcccaactcccaggagctcctccagggttctctccatgtggccactaccaacatccctgtatgagactcagctgaagtaggtgatcttcaaggctctctgtaactaacttgactccccaacagtgggatatgtggagggcaggaaggacactgaccagagagggcagcacccccaaagagctggtccacgtgtgtgaggatgaactccacgacgatggattgtacccgcacctccatgaaggccgctgtcccattgaagcctgaggcctctatgtccttagacctgtggagatgtggaattattctccccctcagccccaccaaacttcccaatccagattctccctgaaaataccttattctctctctctctctctctctctctctctctctctctctctctcgaatgaccttaaccccttctctacctcttaaattgtatgcataattcttccaattctcaaatgccacttgaagacttctaggaaggaagccttcttggacacccgcctcaggattaatctctatttcct

SEQ ID NO: 4479 - DNA, 1524 bp, Homo sapiens
ccggaggaaagggcgttgctgcacgccccgcgggttgccaaggtgattcaattcgcttcccacaaagaggtccggctcctccacttccgttaggctgagcaccggctgaatcgcggaaacccgactctggcaatgtaggttccccacgccgggagttcccaagctgggttggagaactcgagcttcgggcattcagtggccagctcggctttataaaggaccgtgcccttaacagcagggctcgagttcctatatccagaccaaaacctccaactgcatgagcctttttcttaataaattttattttggtaattgtaaaaagaaaaatcaggaccaaaactaaaggcaacttaaaaagttcaaatatataatccttatgtgatagagatttataatttccaggccctctctggggaaggaatgcccaaagggcaaaagggaaggcaacaatgccatcacacaattcagtcaatcagaagagaagctggtaggagagttcaacagggcatgaagaaagggagagaacagcaatagttctgccatacagaactcagtccatcttgaggttaacatagatataccggatgaactttagggaagaaaaaaaggagatggtgcccagcatgaggaagaagacataaccagtgagtaaggagtagccgaagaactctactgtctgtactgccccagacatgttggagcgccgggcataatagaaaactgagtagaggaagatgaagaggccggtggagccaacactcagcacagatcgccaccaccagcggtaatcctccccagacaactggaagtagtgccaagggccaggaactgggcacccacgccaagcacagcacagagcagaccacggtatggggggaagcggaagacatctgtatggataattttccagccattgtcaccctggtcaaagtcatcaccagaacctgcagaggtggtctcctcatctaagttgtaccgagccaggtcattccgaagcacacgcattagaatgacagccacaaaacccaccagtaaaaacacaagcaccatggagttgatgatggacaaccaatggatttccagtgttcgaggaaagaaaccaccatcgtcaccacggcgcctgtcactccgacgctccactgaagtctcagaccagcgcacgctataagtgtgggtaaggcctaggaactcgtcaggtcgtaacccatccaagctgtggggcttgacgtcccgcactgaaacattggcaaatataattcggtctccatggaattctaggtggaagtccaaatgggtccagagtcctatcttgtggctgtgtggcaggaaaccactctcctccatgtagcccacaaagccccggattggcaagtcatctaccacaaattcaaagtagtacagttcttcaatggcctggcgcagctgctccacctataaagagcaagtcaggagttggtcacacaagatctccccaggcgcagagttacagcaaagtttctcaccttcagcactactgatattttg

SEQ ID NO: 4480 - DNA, 3046 bp, Homo sapiens
agtagagacagggtttcaccatgctggccaggatggtcttgatatcttgaccttgtgatctgcccgccttggcctcccaaagtgctgggattacaggcgtgagccaccgcgacaggcccccctcatctttatccttaactaatgaggggtgtatttgtttgttttgtttttttagatggagtctcactctgtcgcccaggctggagtgcagtggcgcaatctcggctcactgcaacctccacctcctgggttcaagcgattctcctgcctcagcctcctgagtagctgggattgcaggcgtgcgccaccacgcccggctgatttttgtatgtttagtagagatggggtttcaccatgttggtcaggctggtctcgaactcctaacctcgtgatgcacccgcctcggcctcccaaagtcccgggagccactgcacccggcctgaagggtgtatttctaagaaagtatctacctgcccttggtaggggctggatcttacactttgctgcagctcccatgtctgcaccagcctccttagaggcaaccaagggctgggggatgagcacaagcagcttcccacttcccaggccactcacctcttcagggcacccacggtatcctctggcctagccacagccagctcctcggtatcattgaggaatttgagccgcacagtgatgaggccagggctgggagggaggcaggtgctatcctcagatctcaggggggcctctggactgctgctgcctgcacctgcttgtcttttgggcaggccttggatgtcaaggagatgctcaaggctgggctcaacaccacccccagctccagcctccccagtggagtctccccgaccttcacccgcctcttcagccttctcatcattaccctctgatggatgggggagttcagttggctcggggttgccttggcctgccaccaggtggtccacatgccccaggtggaggacggatgtgtcgcctgctgacacaatagcgcccaggagctggttgctaccgctgtctgctacgtaggtagagagccaagctaggaccaaggctagaatcagcaccaccacacctgccaccaccatcacctcattacccacaccctcaatgagggtgacatcagagagctccatggcctggctgctggcagggtccacgctgcaggaacaaagggggacagcatcagcagagcctgaggggttgcaaccaggtctctagtttgtttaggttctaactgacccagccctgaaaaaaaaaaaaaaggagttcagtgttgtgtagaagggggcacaaaccttcctaattccggcaccccaacctaaacctaaagacctaccctaccctttgcctctattgtgaaactcttgctttcacgttctgtgaccttcctctctcaaactccaacttcccaatgagtgtggatcagcaggaaaagcccacagccttgctgctgctgctactgttgttgcttttttggtgaatgaggaaaaatctttgctgaggcctgagtttctctaggatttctatcgcttggtcaagcaaatatgcctcctaagcagcctccaaagtggcttcagagagacccaaaagcctggaatattttactgtggggcccccctggaagcactgtttagccatccctgccagattgtctcatttgagcctatttcattcctggtcacagatccaggctgccagatgtcaagagccaaagaaaactgacctaccatcaaaagcagagtcagacaaatctaaaacgataactctgtagggaccgcgggcagatactatgcagcagacattatgtgccgcctctgaaacttctggcaagccctggggagcaacttgggacagacaccagaagcaccaccttcctgggtcaccatgggcccactcctgcaatgaccactccccaagtggagtgatttgaaaaagattccataacagctctcacaatccatatctcagtctctcttctttcactgtgaaggttctgctgctgcagtttcttagaaaggcaggaagggtccctgcttgctccttggagtacctactatttcccttggagaatctgctgctttcacagctgtccctgggcaaatccagtctggtgattaccattatcagactattctcacagcacctataaaacttcattatacttatgtacctgtccatctttctattagactcctggtagacaaggatcgtatgtatttctcttggtactgaagtgtccaatataatgccccagtagttgctcaaagaattatctgtggaacacatcaacatccttatttaatataccggccctggagttagaaaaacaactaattataaccccagtcttgcgtcttactagctataacacctcagacaactttctcagagcctcagctttctcatcagtaaaatggggttaaaaacagtacctacctcatgaggttgttttgaagatgacgtgaaatcatcgaagcaaaatacttggcacagtgcctggcacactgcaaattgcaattgcttaataacggtagtaattatttatcacaaccacaactaacccctgatggtaagaaggttaatgttattaaccatgatttacaggaaaagaaactgcggcaaagaaagacgaaaacgattggcacagacacagggaactctcgtggggaggggcccggcaggaccccaggtgtccggcctcaggggtctttgctctgtccctcagcctgtgatctaccctgtccgtaccgtgaccgcacggtgaggaggggtcccgcaccctttttctgaggcgaaggttccgcttttggatggtcctattccctcggcggggcttcaggacgcgaggagtcatgggaaattaaagggggattggaccggcactgtgcctggatggggaagtcctcacctgaaaagaccagactaaatgttttgacctcgccaggacggcccctggactcgtctttccgtaggggtcgggaaaagggctggcaatctgcgattctgttcagggtccggtctcttccggcttctcccggaagct

SEQ ID NO: 4481 - DNA, 4243 bp, Homo sapiens
cgtgatcatgaggggttgtgaagtgcttgccccatcagtagccatgtgtgcatgtgtaaataccatcctctgtgtgccctggaggctgtccttcagatagcatgtacaggtggcagcatagggcctgtccctagtgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtagtccccatgcccctgtgtcctgaggctactgggcagtccctctatttccccgtgcctctgaggctgcccagtctctgccctgctgcccacctgtaccttgggctttcttctcgcccaggcttccaactccaccctctcctgccaagcaatcctagccctctgagcctcttggggccccctcagacttgtccctgtgtccacaggtgttctccagtgccaagtaccctgctccagagcgcctgcaggaatatggctccatcttcaccgacgcccaggaccctggcctgcagagacgcccccgccacaggatccagagcaagcagcgccccctggacgagcgggccctgcaagtctgctggctgcgcacataacttagcctgtcacacaccaggaggactggatactggggaggagccggggccaccaagggttctgtcccccagaggaggctgactgggatggggtggcagctgattaggcccagcaccaaatattcaccatcccttggccatcctggccctcccaggagaagctgaaggactttcctgtgtgcgtgagcaccaagccagagcccgaggacgatgcagaagagggacttgggggtcttcccagcaacatcagctctgtcagctccttgctgctcttcaacaccaccgagaacctgtatggccagaaggcagggccgaggggtgtgggcggtaggcccggcctggcttagtggggacccagggcatcagacacaggtacagcacatagcccaggagccagggggtgactggggtggctcggctcgggaggcctgggaccccacagtgcacactgtgcccctgatgatgtgggagaggaacatgggctcaggacagcgggtgtcagcttgcctgacccccatgtcgcctctgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggcgggacagaggtggagataggtgcagtggcccagggccttgccagagctcctctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagagaagtggtcgacccctccggtggctgggccactctgctagagtccatccgccaagctgggggcatcggcaaggccaagctgcgcagcatgaaggagcgaaagctggagaagcagcagcagaaggagcaggagcaaggtgagcgggccctggagcctgcggtcggagggcctttgggcaagatcgcctcctcccctccagccctgagtccaccgggtgctttctgcccaccccctgctcctgccagctggcccctgcttcccctagggcacatgctggaagccctgggccgccaccagaggtcctcagccctcctgcctgggctatggctccttcctggtttgggagccatagtggagctttcctctctaagctcacccagctcaaactgtgacaggagaatcttcttcgactgccaagagcggtccaaggcaatggtcagccactgcagcctcctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctgtccccgaggtggctgggaggtggctcctcaaacagccactttctcatcagtgcccggtgctgggtcaggcatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccaccctgggccggcacattgtaattctgtcctgcctttttcttcctgtatttaagtctccgggggctgggggaaccagggtttcccaccaaccaccctcactcagccttttccctccaggcatctctgggaaaggacctggggctggtgacgggcccggaggagcctttgcccgcgtgtcagactccatccctcctctgccgccaccgcagcagccacaggcagaggacgaggacgactgggaatcgtagggggctccatgacaccttcccccccagacccagacttggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcag

SEQ ID NO: 4482 - DNA, 1646 bp, Homo sapiens
gcggccgccgcggcagtcttgccggtggagcccgggctcgtttctccgccccctccccgcccaggctcagtaaacagggcttgagcgccggggcctgccgggcagggctgagtgtctgaggacaaggcgctggctttgctaatcacatcacaagaccttgagccagggccaaaggcgcggagtggcgcgggacgtcccgggcgggggagctgactctgaggacaggaggaaaggccgggagagccgtgcgggcttgaaggcgacttagcgccacctttccgtctgctggtcgggccggccttccccagccctctggggctgggggtgcagctgcctgccgaggctccccgcccggcacagcctgggcctgttgcgtcctcccagcctcttccctccccggcagtgggggcgccgcgcccagcctttgctcgatgagggctgcaggatccggctgagaccaacccgcggcgcaggtggggctgcacagacgctgatggtgggcgcgccaccctctgttttccctcactcgccagccccgcaccccaacagcttgcgctggaaaatgcgctttgccagcgggcgccccgccttcgtccgggtacggaggggacactcccatctagcgcccagtgaggctaaagccgctgacagccccactaggaacgatctggagtctggtctagggcacttctccctccgcgttcatacaggttgccacaaaaagcttgggcctgaagctcgaaggccccggacccgctggggaaagaactaggcctgccactcagggattcgagtccctggagtgtatcctgcatttcccactactgtactcccctcatggcccagggagccagagtccagggtaaggatcaggaatgctgggctggagttcaggtcctgccccagagaaatcatgtggtcttaggcaaatcacatcatctctttggtacttgggtttccttgttaaacgaagataatattcttgctttattcatctctcacctttggcaaggtgcaaatgatatctgtgaaggtgtttaaaagacaagcaagaactaaaccatctttatgtattaaaccaaattgacaaaagcgtaagggtggagaaagcctggcttctgaactgtggccagatggacagagagccacagaatcatgagtgcagagctgtgggggcacccaagtcctggaccctaggactcacagccaagagcaggtgacctcagagggaccagtttcacttttagcacctaccctacactgaccccttgacatacctgggcaactgtggtctggtttgttctttggtgagatgaccccaaacatctcaccaaactgtgaaacagccacttccctaggcactcctattaggttagtaacaagatttcagatacagaaccagtggaaacatctgtttgaaacaacgtccaaatctggggtgagtcccagtcaacagctgtgagaacacccactttgcagattaggattctggagataacatgtggacatgttacgggacatgcttgtgtacagagtacctgctagtataaaatgtctaatgtagctgcttttatttcattttaaatggagaaaaaaagaagtgctggccatttccaatgagctgggctttgttgggccagtttcat

SEQ ID NO: 4483 - DNA, 1645 bp, Homo sapiens
cggccgccgcggcagtcttgccggtggagcccgggctcgtttctccgccccctccccgcccaggctcagtaaacagggcttgagcgccggggcctgccgggcagggctgagtgtctgaggacaaggcgctggctttgctaatcacatcacaagaccttgagccagggccaaaggcgcggagtggcgcgggacgtcccgggcgggggagctgactctgaggacaggaggaaaggccgggagagccgtgcgggcttgaaggcgacttagcgccacctttccgtctgctggtcgggccggccttccccagccctctggggctgggggtgcagctgcctgccgaggctccccgcccggcacagcctgggcctgttgcgtcctcccagcctcttccctccccggcagtgggggcgccgcgcccagcctttgctcgatgagggctgcaggatccggctgagaccaacccgcggcgcaggtggggctgcacagacgctgatggtgggcgcgccaccctctgttttccctcactcgccagccccgcaccccaacagcttgcgctggaaaatgcgctttgccagcgggcgccccgccttcgtccgggtacggaggggacactcccatctagcgcccagtgaggctaaagccgctgacagccccactaggaacgatctggagtctggtctagggcacttctccctccgcgttcatacaggttgccacaaaaagcttgggcctgaagctcgaaggccccggacccgctggggaaagaactaggcctgccactcagggattcgagtccctggagtgtatcctgcatttcccactactgtactcccctcatggcccagggagccagagtccagggtaaggatcaggaatgctgggctggagttcaggtcctgccccagagaaatcatgtggtcttaggcaaatcacatcatctctttggtacttgggtttccttgttaaacgaagataatattcttgctttattcatctctcacctttggcaaggtgcaaatgatatctgtgaaggtgtttaaaagacaagcaagaactaaaccatctttatgtattaaaccaaattgacaaaagcgtaagggtggagaaagcctggcttctgaactgtggccagatggacagagagccacagaatcatgagtgcagagctgtgggggcacccaagtcctggaccctaggactcacagccaagagcaggtgacctcagagggaccagtttcacttttagcacctaccctacactgaccccttgacatacctgggcaactgtggtctggtttgttctttggtgagatgaccccaaacatctcaccaaactgtgaaacagccacttccctaggcactcctattaggttagtaacaagatttcagatacagaaccagtggaaacatctgtttgaaacaacgtccaaatctggggtgagtcccagtcaacagctgtgagaacacccactttgcagattaggattctggagataacatgtggacatgttacgggacatgcttgtgtacagagtacctgctagtataaaatgtctaatgtagctgcttttatttcattttaaatggagaaaaaaagaagtgctggccatttccaatgagctgggctttgttgggccagtttcat

SEQ ID NO: 4484 - DNA, 3156 bp, Homo sapiens
caagtgatcctcccaccctagcctcctgagtaactaggcccacagatgtgtcccaccacaccctgcagtgaggcctcgctatgtttcccaggctggtcttgaactcctggactgaaccaatcctcccgcctcagcctcccaaagtgttgggattacaggcgtgagccactgcacccagccagtatttgtctttttatgtctcgcttatttcactcagaacattgtcttcagggctgatgtatgttgtagcatatgtcagcatttccttcttgtttaaggctgcataatattccactgtgtggatgggccatattttgcttatctgttcatccctccatggaacttgggttgctcccacctctttgttactgtgaataatgctgatataaacatgggcgtgggctgcgtgcagaggctcatgactataatcccagctactgaggctgagactagaggatcactccaggccaggagtttgagaccagcagagccaacacagcaagactttatctctacaaaacatttttttggaaatactagtcaggtgtgatggcacacacctacagtactggctgcttgggaggctgaggtggggcgatagcttgagcccaggagtttgaggttacagtgtactatgactgcaccactgcactccagcctgagcgacagagccagactctgtctctaaaataattacagctacttgggaggctgaggcaagataattgcttgaaccagggggaggttgcagtgaccagtgcactccagcctgggtgacagagcgagactctggctcaaaaagagaaagcataaggagtggggacttttagataacttttcggggggcagacgggagaggcattcaacgaaggaccactttaggaggttgtctgggcagatggattccgtgaagtgctttgaatgtaagtcagaccactggggctgcctcgctcctgtcgcgcacattcacccacatccatccccaggcctgaatgtaagggctcaaacagacctgcaaatacactcggcacctgcgagtgggcagctgctgtgcagaccaccccatcccattttctggtccgttaaactcatgcataatggtcgtagcaatggccaagttgtcattgctgggcagaaagttcctttaagacaggaataataaggcccacttaggaagcactctggattgtaatagggtttccagtggccaccagcagggtggcatcctgattttctaccaggccatgtagaagccttttgtgcttagctgctcgtgttaatcctcacaactgcataaggctgacacatcagggaactgaagcacagagatgtttgggaaattctccaaggtcacacagctactcagtggtggaggtggcatcagaacccaggaaggctgactgaagccaccgttctgcctcgctcactggcatcctcagcctccagcctgaggcaggacattctaggacagctgatgaatacaagcatggtcagtgtgggtggccagggccctcgctcagcaagtgggagcaaagtggaggattccaggactcactacctcatgatcttccaccagcctcccactacctctagtcacccctacctaagctgcccctctgtatgaaaatgctggggttggagagtggggcaggctagggaaagaagacaatgtgatttaacctgtccctaaatggttagatagcatctctggagttaaagatctcagctatcagttaaaatgcaaactgagctactatctgtcatttagagatgacgcagatgaagaagctgaggatgtgacctagaaaaaagcaggaacgacctagggacttagcaagggacaaaggaccagaaacaggcaaagagaaacaaaatttaaccttctctacagtgtcgcttagggctgggctggctatctccatagatatccaattccttaacacctaagggcgtaggagaggaatgagaccaaggtttaggatgaataatctaggaaatcccttgaaaggaagaaaagaggatcatcagagacatcttctggagctccacaaactgctcagagcagagaggccaccagatacgaatgctgcctcagataatccaatggaggaagagggtttggctggtattttctggctgagttcttgataagaaactgtaatcacatctgctagctagggatccaagaaaaacaagatattgtctctttatacacattccacagcccctaccttctctcaagagatgttaaaatggcttaaaatgtgttaaaatgtgacaatttaataaatgtggcagaaacaaaaaagagactcctaaagtattcctctcttcagagagtatgaagctattaattcagcaaatgaatccagtaatcccagcactctgggagaccgaggcgggcggatcacctgagctcaggtgttcgaggccagcctggccaacatggagaaagcctatctctactaaaaatcacaaaaattagctgggcgtggtggcggggcacctgtaatcccagctactggggaggctgaagcaggagaatcgcttgaacccaggaggcggaagttgcagtgagccgggatcgtgccactgcactccagcctggatgacagagtgagacttcgtctcaaaaaaaaaaaaaaaaaaagttgagcctggtgatccgtttcagtcttgcaggatgaaaaagttctagagatggttggtggtgatggttgtacaacactgaatatatttaacaccactgagctgtatacttaaaaatgttgaagatggtaaattataagtgtatttaccacaattaaaaatgtttacattagaaattaaaggccaccctgggcaacatagtgaaaccctgtttctacaaaattaaaaattaaaaaattagccaggcatggtggcaccctcctgtaatcccacccactcgggaggctgaggtgggaggatcgcttgagcccaggaattctagacaacagcaagtcctgatggcaccactgcactccagcctgggtgacaaagtgagattctctctctctctctctctctatatatatatatgtgtgtgtgtgtatatatatgtgtgtgtgtatatatatatgtgtgtgtgtatatatatacatatgtgtgtatatatatacatatgtgtgtatatat

SEQ ID NO: 4485 - DNA, 2481 bp, Homo sapiens
tgccatttctgaagccacctcatttaatttatacataggatataaatggctatacatttttacacacttttatacaagtttaggttgtactactgagtttgttaaaatgtacccattatttactcaaaatatttattgttacaagaaaaccgtaagaagcttgtgtaacatgaacagcaagtattgaaaacgaatatgtaaagtaaatggttttgccctgactaaatcagcctcagtattttatgcttttagtagaaaagcccattaaacaaaatagaatcctgggggatcaaatcatatgaatgattcatgaaataacacttctgaagcaaccccagaatcatataaatgtaagggttaaaggtcatatgtactaagcatgggtcagaggaatagaatggatttgttaattttaccctaaataaaaggcgcttgtgggcaacagctctgccatcaatacacatgggcagatgtttccgaatccagccattcccagatttcactgacatgcccttttccacaggctccctgctgatgagatttccccagcagcagaagtttgacatcactgctcccggatgggagaatcagagctctcctcatttgggtcaggggtggctggctcacgaggtttggtccaaccagcagaaccagctccttggatcctggaataaaccaaacatcaatggtaccatgcgctctgtgcccagggagtgaaaggcaggtccagggtgggaagaagaggggctgctaccttttggagtgaaaaaaatgaggtttacactgtagtataacaaaatgcctttttgtaaaggccagaagaaatggctgtgctgtgctgcctgaagcagaaaaaccttcatgtaccaggtgaatgtaaagcctttctcctcccacacacaatggactcacccagtattaccctccactaccacttttgaccctcataacagcaccctggcgggggggcagattgatgttatcaccatttaccagatgaggaaactgaggcctgatgggcagtgatttgtgcactgcgacataggactcagtgaagagcctagccagctgacggtcagctgactggtgcactctttccctcaccttctctctcaagggcacagctacactctttctccaccattattaacactcacagggcacaggtagagcgtccccagacctgtgcaatattctacacgaaaacatttggaatgtgagcaatgtctgaacaggggcttgccaggcacatctgatcaccataaatgctcccacccctgcctgtcctcacttgtgctgcactatgcaagcaagcagcaggttctcagaaggccactgtcctgcatgtcacaatgagtggccaactccttcacagaacagcaaatagcagccctggctacaaggtgcagtgtgcaacccccatatgccaaggggcagctgctatcttccagcagagagagaacccccagctctgctccctacctatgccctgcttcctgtgcctcacacagccagccttgctggcctgctggctattgtctctgactctgagctgtgctgaccaccaagtgttactcctctccaagacttgactcccaggcatgggtgggagagttgaacctcaatgcaatctgctcccactctgaagctcgtctacccaccccatttgttacaattaaagatggttttctcatccctccagagactccagtttcagactctgtctccagagctggaatgtatagggcagaggtagaaagaggcaggagagttggagaacaagagcacctagaaaagaacagaggagctcaagctcatttaatcaaaatgcttaaatgttttaattccagcattctccagagttcacagaaaagagggatgcaagcccaaaaagcaaaagcaggagcttatggtcacatgcctccagctgcaggcagtggggcctctggtactgagagggaatgccacccgaatatgccccagctgtctccacccaggaaaaggaaagccagctctttctggatgagcccccagatccagctgtcctaggtaaacgtgctgaactggctggagatcctgcagtaatgcttggcacagaaccaaggctgggtatcaagcaacctcatgacttccactgcaactgtttaacatccccaattcctggtttttcagtccagttggctgaaaaggatggaaactggagtgtaaagtagagaagcagaaagagaaacatagattgatcctcaaaagaaaatcaaagaatccattcatcacagtgtcatcctcatactccacagtcagactgcttctcctgaagctgccttgttagtatctgatatgaagacagaaaagccactcctatgtggaaaaggatttgccagaggttcctcagcccgtgcaggtacatgttgcccaggcaaataaagagcagcataagcaccaccttcatagtcctggctggactgtagaacaggtacaaat

SEQ ID NO: 4486 - DNA, 12493 bp, Homo sapiens
acttttgaattctgttttatatcaagctataaaaacctggatcctgttcaacatacatacaaaagcagtactctaaaaaataattattattatattaacaatatcaaacacgctaactcctacacacgtacaaagaccttgggcatcctttataccggccacttcctggccacagctttgtaaggcagtacctgggaaaaggggacggacccaagagagccggccccaaatcctgactcagcactgcagaggcatcagccgggctgagtcatgcctgagtccgaagggccccctctcaggctgagaaggaactttcaggcccagggaggagcagagccttagggggagcacatgccgagcaggaaaacgagctcacattttcctggggtagagcgaggtgcccggcagggcaggggatgaacggagggtgcggtgggcagaataacggcctcccaaagatgtccacgtgacagtccccagagcctgtgactatgttaggttacacagccagtgggaactaaagttgcagatggaactaaggtggctaatcagctgacctgaaaatagaaagacgacctgggttctctgggtaggcgcaatgtgatcataagcgtccttaaaagcggtagagcaggccgggtacagtgactcatgcctataatcccagcactttaggaggctaaggctacaagatcccttgagcccaggagttccagacaagcctaggcaacagaatgagaccctgtatccacaaaaaatatgtagctgggcgtgggggattgtctcaggggactgagacaagaggatcacttgaaccaggaggtccaggctgcagtgagccttgatgccatgaccaggccactgcactccagcctgggcaacacagcaagaccctgtctcaaaaaaaaaaaaaaaaaagtggtggagggaggcaggagaggggaggcctcaatgaggtgacgggaaaaagattcaactacccacagctggctctgaagatggaggagcctgaagtcaagaattacggtcagcctctaaaaatgaaaaggccagaaatgaattctcccctagagcctccagaaggagtgcaggactgccgacacccagatttgagccccgggtcagccttctgacccgcagaactggaagacctcgttttgatccacgaagtttgtggaaacctgtcacggcaataggaaacaaatacagaggccaaagggtcaacagtgagaggtcaagcttgccctgcccctgcccagacctcagccagacttctgggtggcagggcccacggtggcacccccagggcctgtccctgccttggggaagggggagcctgagaggacccaggaggtcttgggcccttcggtagtagacaccaagccctcgggggaccaccctctagttgaggccttgggggatgaagagggagggctcagggccccattgcagggccagcctgtaggggccgtggggccacctggatgtgacgtctaatgctggcggtgctcacagctcgccacaggaccctaaaagcccctgccagacgagagctcatcttttccttctttctcttccagttctgtcttccattccaccattgctgaatcccgctcacggcggccctgggctgcagagggcagatgggtgaggctcggcccctgtctccagagagctgaagagggccctcggccccacccacgaggaggacagtcatgaggccgactgtggaggggctctggacagaggtgtccggggatccctgagcctggctgcactctccctcctggttctttccttgcgtgcacacgatcagctatcgtttacaaagagtccttggtgttgcctggttggctgcccaggatgggagctcctgcccccatcggacatgtaaacaaaccaaggtctgtccagttccagctgacagggcctgcacctccgccagggctaggcagaagtagcatcagagcacaggagacccgggaggaaccgagaaccagcgctgctcttaacagctcccagcggggtgtgcccaaggcttgctgggcactcacaggcaggtcaggccacaggaaaagctaaccaacctttataagggaaaataggggccgggagggctcctgcgcccccatgctgacgtccaagatgctccggatgcgcttgacctcactgttggataggttccccttgatggccaggatagcgctcaggtggcctttgctggcaaagagagcatcctgtcagcccagcctgtcacccacacccctactcaccagctccctgcactcccggccagtgccacagggcccgacagccaacgcccggcccacgagggggctgcacttcactctccctcacccatgccctccacctgatggtcccaagagcagccatgccccagcctgcttcaggcctccgcaccggctgttcccctgcaatgttcttcccaggccctgagatgaccgcctcttcccaccccttaggtctccgctaagatgtccacccccaaaaggctttcttgtctctaaagtcggcacctcctatcattcacaaccttggttaaaccctatttacaacttgtaattgtctgtttctttgcctgattatgtcattagtattgctggccctcaacagaatgagctacttaagggaggactgagacctggcttcccttgtacttcattgcatcctggtaactagaacagaggctgacacctagcagacttctccataattgttggtggcataggtagatggatggtgggtgggtgagcagatggatgagagctagatgggtggagggatgggagcatggatgagtgagtagatgcatgggtggatgggtgggtgggtgagtggttgagtggatggatagctaaatgggtggaggggtggatggatgagtagatgggtggatgggtgcttacatgggtaggtggatgaatagatggatggatagacgggtgggtgggtgggtgggtggatgggtagacaggtgatgagtgggtgagaagatagacggatagccagatgggtgaaggaatgggtggatgagcagatgggtgcttgtatggtgggtgaatgaatgaatgggtggaatggatcagacagggactggacttggcgaagctggggtcaaccctgtcaagacccattcaaacttaccctaacatgtcagaggacccagcccaggaagaaacaatgtccctggcccaccagaacttcaggcagccaagggctaagcctccactcccgaatatgagccctggtcccagagcataggcctaggccgcagaggccccccaggctgggtgaagctggcctctctggtctcagtctcccctgtgagaggcagtgtcaggtaaagctaagagtgtgggccatgcagccagacactaactagccgtgtcaccttggacacatcctgtgagctctccaggcctcctctgtgaaacgggaatgggaagtattgtcctcgtagtgctgtggtgaagtcagggtagcaggtggcataagtggccacctcaatcttgatggcactggggtcctgcaggcgaatgatctcggccagcgtagggagagcaggctgcagccaggtcgccggggagccctgcaggagtgggtgtggttggagggacccaggggtccagaggctcgggtcagcgactcgttgggcttagagaggcaccagcggcctatctccgaccctgaaagggctaggggagaagaggcagccatttcagaggggcttgggagaggtgggcagcggcttacgtgctgggtgcagaagtgctggatggtgtcagcattggccaggatgtacccagccagctgctgctgctgctcggccgtcttgaggaccaggcgccccttgctgagttggatgatgtactccttcaccaggtgcaggtgcaaggcctccatgagctcctgggagggcaagcagccaggggcgtgtgagctgtctgctgatggggagctcgccacctcccttgaagccttgtagccaggcctccagagagaggcagatgccagagcaaaagactgcacacgtgctcgtgcgtccacatgtgtgcgttcacatgctcatgcgttcacatgcgtgtgtgttcacatgtgcatgcgttcacgtgttcacatgtgtgtgtttacatgctcgtgccttcacgtgtgttcatatgtgtgcatgtgttcacatgctcgtgcattcacatgtgtgtgttcacatgctcgtgcgttcacatgttcgtgccttcacgtgtgttcacatgtgcacgtgttcacatgctcgtgcattcacgtgtgttcacatgtgcgcgtgtgagcacatgtgcgtgagtgtacacagacgtgctagtgtgcgtgtccgggctgcccccaactccccaagacccagccaccagcccagagcctcctcacctcccggaaacagccctgcagctctgagaactcaggcagcctcgtgtctacagtggcgatgatgttttccagggtctccacaggggccgcccagcgggtgtgcgtgaacctcttgaacagtggctgagacaggagaggcaggatgtctagtcacgccctggagaggaagggctgccagccgcagacacgcagacacgcagacacagacacacaccgacacatgtgcctggtggaggggcggggggcactcaaggactcccagggaacccgggccaacctcaggtccctgctcacagacaggaagtgggagccggctctgtgcacccttatccaaggtcacccagtgcggctcaggagccaggagagcctgtctgccggcccggaggccaagtccactgccacttaaataaataaattccttcataaacaagaccttgtgcttggctgggccagggagatcagtaccaggggatgtggggtcaccgctcgggcttccaccacactcaggccacccatggccgctagtccctgacaccgggaagagaacctctccccttccttttgagagaccccccactttacaccctgctaaaggaactacttgttttcacagcattttctgtggatttcttggcccataacagatataaccccagctgccgatgaccctgagcctcagttgctgggagtcaggcgcggggatgggggtggataggaggggctgaggggattgaaggaaaggtgtctgcaggcttgggactgggctgtgtctgaatcggggaggggcagtgaaacttttccaggccctcccagccccaggcggcccctctcaggtgaaaccccaggacatgatcggcggagttcagagcctgctagggtccccaaccgggcatcaccgctgcaccagagctggcccacggtgccgtccacaggcctggagcgtgtcttccccacatctttgcttctgccactcctccctgggggcacctcccagtccctccctgggaaccccccaacactgggctcctgagggcaagaggctcccgctaccttcaggtcctcatgcaggttctggagcagggtgtcaaagccgtggctcttgagctcacccagggggcccagcaggaggctcagggtgtcctggggtacctgccaattctgctccatggacatcctggaaggtggaggcagagaggtcaccccagccctgctcagcctatagccccatacccagggagccagacagccccctctcttcactctagaaccctcaatggctccccattctctatgggatcaagtcctcccatccatgttctccatgccctcaggacactcctccactacatccccttgtaactgggggcaagtgagcctcctccagtggtttgcccatctgcctaatagacagatcactatacctacttcacagggttgctttaaggataagataatgggtgaaacatctgcctgtgtgcttgccccagccagcacttgggaaatgtttgctgctgctgctgcaggccgtggagtcctcacacatgttgctggtttgaattccacttcttggcctaagcagctcctcctccctccaccttccagctcccctctcctgcccgctgagtgactcccactcccgcaagcccctcccaacactctcaccggaaggacaggcagttgttgatgttggcaataacattggccctgtaattcgtcagctgcttgcctctctccagaaattcattaaaggcgcgctggtagctggcgaaaccagaaggggcacattcaggaccagcccaaacactgggaccacagcagcagcctccctgccctccctgccagctcctggggttcacttttctgtttggctgcccatagccaagggaggggccgctagcccctgggcatcatggaactggcttcacaagctaaggcttgggctcctgaagagggtaccagcccatctctgctgctcccaggccctctctagagttgggagaccaggtaggagtgagcgtgtggttggctggagaagccctcagaggtcgagagggagagagcagagagaattcaggtggtggagactaggagtgttgtatgaaggggtggcggggtctcagtccctcctggggtatcctctttgaagctagaggctgctctgctgagagctttgctgatggggtgggcgcaagaggctcccacgttgaatcctggtggaggtcagaccacctgaggctctcagtgccctggctgagtgggaaacaactcctggctcagaatgacagggacaggggtagagggcggggatccagctcagctccccacctgaggcactagggaggggccgtggctctgagagcggtggctacagggaccccatcctgggcacacacccacctcctcaggaacgcaggcagctccaccagcagcacccgctttatctgtgagcccaagtccagcgtgatgctctcggccttggcctgggcctgggaggtgatctgcagggtggtggtgggtgagctgagcaggggctcgcctggacaagggggcaggggacggggaggaaacaggcgggaacagagggggtgccccgaggtgggcatgggtatgcacacaggacggaatgtgcgtggggctccccatgcacgtgcacgggcggtacgtgtgccctggggcagattgcagtacctggatgatgtcgatggccagctcgctgtggcagtggccgtccagcctctggggaggcacatcctcagcccagcgccgtgcctctagctccagagctcggtccatcaactccctcacattggcctggaggaggaggggcaggtcactggggcactatccctcacctcgctcacctggaagacccgtcaagctccctgcccatgtcctgtctgtctccgagcctctcctctgctgcctccctgcccctccctggcccaggtggagactcaccgcctcactggacaggaatgtggcctccagcagtcggatctgcctggggggcaggaggctcccgagccccataccctgcagctcacccaccagcttggggctgttgatgatgtcactgcaggcaggggaggctggcatgaggacaactataccaaatcagcaccaccactcaagctagagcccaggccctcagccttggtctctggcaggcccagactgcccagcacaccctcccgcacccccacccggtccccatttcagatgatgggtcctccatctacttagtttggtttggaacagaaactctgaagtcatcatgcctcctctgactctctcaccaccccccccccattaggtcctgctccaaaatagcccccaaaatcagcagcctcatgccactctggcgccctggccggctcccatcagctccccgctggctcactgcaaaagcctcctcccggcctctctgctccttccctcacctccaacaattccttcttcacccagcagccagagccacctttaagatctgatcttcttcctgctccaagactacctgtcacccagataaaaccctgctcctactcacagcagccctggaatccagccagctcccagcccactgcgctccagccctgcaggtcttgggcatctcaccagccccggccacctcccaatcccaggggtaggccagaatgggcaggaagggctgccccaaactgctccacagacgcatcttggctcactgtcctggcgcctctgcagcgccccagagctcccaggggactgcccagccctggcacttcctaagggccctttgtctgcctagaggtttacaaatgaccttctctctgcccctcacccaatccagatgcagctgtgtccctccgttccccacatttctggcacacaggcttcaacgatgcccccctgggcaccctctcaccagggctccatgcccagcttggctttagttgcctgttgctaaccccaggccagcagaccccgaggtcactgggacagaaagactggcaggcaggggtgcaggtgcccggcatttcctggtgagtcaggacgagcaagcgggaactggctctgggctgggttatctctcccgtggcccctgccctgtgccagttcccctatgccctgctgactcctctcccaccctctccactggaccctttctctatccttctgccagaggctgacccttcaacacgaactgagcccacaggccacccaaggcccccgagacggcagacactgcccacactgtctatacctccaggcttccttcctaaagtttcacactaggatctggggccagcagtggccaagccccacaataacagcccctggactcccccgccctgggcctttccacactgcagtaagcctctctccatgcagaccgtgcgaatgacgggcacgcccagggatctatggagtcaagggacgcctgaggctgtactcagcaggggtaccagctgcacagccagcctcccacctgaggggctccagctctgcggcgggctcacagggtaaccctacacaatgggggtctaacaagacacgtggccctagcccatcacttggaactctcctgcctgggggtgcccgcatagctctgctcagctccagagtgccctggaagaggacatgctcaggagcaccgaccttcctctcaccttctcccctacctgccctatcacccctcctcctgcctcctggcctgattccctggctcagagaaggaccgctggctttcacctcctccaggctggcttccctgacttctccaggcctgctttgggcccatgctctgcacggggcctggcctctgctgccacagcccttccagctctggatggttattgattgctttgccccctcctcagactgggcgctcgtgaatgaaatccctaccattttctgtgcctcagtttccccaacagcagaatgtgactgaggcccaggaaattaaggattccaagagcaacgcagacccagccccagccttatccctgtgtccaggcccagtctctgcctgtccaggctctgccccagggagtccaagtcccacccctgcattctcggacccaaaactctgcaaacaccgacctcactaaaagctgccggcggcacacctcgacacccctcgacacccctcctacagaggacaccctccctgccggcccgggcccagcccctggtctgctcacttggggtagaggttctgcacccagagcagcagcatgtaggtgtcgcgctcgcacagctcgaactgcgccacggcggccaggtgggccgcgaagtgctggtggtagctctcggcgtaggccgccacgacgccgaactcggcggggaacagcggcttcagccgctccaccacggcctccaggtcctccttcatggtgcggcccaagtgcagaaagacgctctcggggacctcggcgcccgcggccggccgctggcccatgcgctcctcggccgcctccgccacgccgcgccgccacagctgcagccagcgccgcgggcgcgtggccgccagccccgaggtccccggccccgccgccgccgcctggcggtcctcgcgctcctgctccgccaccacggccagcgcctggcgcagccgctcgggcggcgcctccagcggccgccgcagcacgcccagcacctggtcgcgcagcagctcgtacagcgcctccaccttgctctggcgccgcaccagctcctcctcgctcacaccgcccgccgccgccgccgccgccagctcccgctccagcgccagcagcggccgcgccgcctccagctgcccgcgctccagcgccgccttcagctcctccactgcgccgggaaagccgcgtcagccccggccccagcccaccgcccaccgggcggggcggccagcgccaagcgggaccgtcctcccctagacgcgcacagggccggcggccaacaccctaaagggtgatgtcggtgtccctgactaggctgaaggcctcccagccccccagattgcggcacaggtgaaagcagggagacagacgcgccttccagccccacttgccggcccactgtgcaagtggctcactcacgcggatgagcgccaaccccgtccaggccccagactagctctaacccagggtcctagagcacctgtggggggcgggccatccagcccctgcctggacccggctgcgtcctcgggctccgctgagctgggctgacccttcttcttcttccctttggtgaagacgcagaacacattggccaggcctttggacttcttcttcttctccttcttcttcttcgccgcctcttcctcctccctatatggggctgccccagcctccaggggtggcaccaggtcctcagaggaggcctccgacatggaggcctctgactctgcctctgatgtggactgcaacttttgggggcctctaggcaagtcgagggtgcctggcacaggctgatggctctagaggccttggaagaaggtcatcatcttcagcatcaccctggttcaggcctgcaggctcctgcggggtgggggtgaaggcatcagtggtcaccatggaccggccctggctcccaggctggacacacagctatgctggctgcattgagtacactcagtctgtttcacccattcagccaccggggctctgctcatctcctggcccagatgagcaccaacaactgtgcttcctccctggccacgagcatctcaccatctacagctccccttccaatacttcacagccccagaagcaaggaagaggctggggacgccaagcccgccacacagagggggactttcactttacttgggcaaatccttccctgccagcccaccctctgggcaggaagcaggcaatggacacctccctggatcccacgggaccctagggaagaggcggggcatgggctctgtccctttggacagagcaggaacagaggtccagaaaggtctgggacatgccggggtctagaacaccagaaccggcctgagactggaacccagcctcctcctgcccagacccagcccctctgccatcttgtccagttctgatccagcggtggggtcacagaaacacagctgctccagctgggccatgaaaggggcagagcctgaccaggatctacagaagccacagtgggtgggacctcagacagcctttcacacatcactggggcaaggggctcagcaagtcacagggcggcctgaagtcacacagcaactcgggtccagaacccaggcttcctggctcccaccccctcccaaatgggatcgtagcatcatcacaaaggcttccagtttctgcagccttcctgggtgcccatcccatctcttcctttctctcatctggaagggtgttatttcggcttaaactgtccctatagtcaatagcttgggcttggaactcaggccacccggtcccagagcccagctttcccctgcctccacatccccagctatcctgcaagctacatccagagaggcaagacccgagcttccccagagtccctgcccagcacctgaccattgtcagagcaaggccaggtccactggagaagagcatggctgatctgaaagggggaagcaggcaggggctgggcctccccaagaactggggtgacctgtaaccttgatgccacctgtctgccccaccccaagactaaatgcatgcagccttgtctcatgtatcatggtaacttcaagtgacccctgaaacagccctgcaaggcaggcaggatgatccaccatccagaaggagaaactgaggctgagtaggaggtgtttgccccaagcacagcagccatggaggctcagactgggcccatccgactcttcccatggccccgctgcctccaccagccccactaccctgtccccatcctggaggggcttggccagagccacctgagggacaggaagcctgggctcctcccacccccagcccctgccatgctcacccagtgccctgggcagagtcccacactcctggatggcactggcctccctagtgccatttgggttgagcattccactccaggaccaagaggggcatgctccagggagccccaggggcaaggccatggggcacct

SEQ ID NO: 4487 - DNA, 1290 bp, Homo sapiens
acgctcgccctgggaacgccagcggagccggcggcggcgagtagggggcaattcgaaggagacgcgcagcttacacccgcggcgggtggagggagcaatgtgacgaaaccattgagcttgaccgaccttccctcatggagttggcttttagcctcacggccggtttctgttgggtgaaagccgcaccttctcctcgaaccagggcccgacattggagccctctccctcgcatccactgccctagtccagcgtcaagatcacggaattccaggctgggcgcagtggctcacgcctgtaatcccagcactttgggaggctgaggtgggtggatcacttgaggtcaggagttcgagaccagcctggccaatatggtgaaaccctgcttctactaaaaatacaaaattagccgggcgtggtggcgggcgcctataatcccagctactcgagaggctgaggcagaattgcttgagcccgggaggcggaggttgcagtaagccgagatcgtgccacttaagcctcaccaagagcgaaactccacctcaaaaaaaaaaaacaaaaaaaccagccgggctcggtggctcacgcctgtaatcccagcactttgggaggtcgaggcgggcggatcacgaggtcaagaaatccgagaccatcttggccaaccttgtctctattaaaaatacaaaaattagttgggcatggtggctggcgcacgcgtgtagtcccagctactcgggaggctgaggcaggagaatcgcttgaacccgggagggggaggttgcagtgagctgagatcgcgccactgtactccagcctggcaacaaagcgagactccatctcaaaacaaacaaacaaaaaaaaccgtggaattccatgccacttacctcctcctctttgccccttttttaaaaatctttttatagagacgggttgtagggggtggcgtctcactatattgccagggctggtctagaactcctgggcttaagcgatcctcctgcccccacctttgtgctgagattacaggctgtgagccaccgtgccccgccctcccagcaccttccttgatgctgacccctgctcagcccctcaattaaggtgctgcactgcacctcattcgcagggggcctcttcgccggaactcgctttcaggtgggtctacaattagttgggaaacaacgggttgcaaggctgacctggtctgggacatgagaaggggtgaactacaagggtttcaaggttggaggacgttaggtcgggcctccgggggtgtgggattgaggctgtgttctt

SEQ ID NO: 4488 - DNA, 1807 bp, Homo sapiens
agcagccgagtccagcaatgtggacagccagacgcatgcttggtggaggcagccagcgcccccatcctggtctcggtcatcagttccatcaatgacaaatgctgctggggcccatgaggaccacccgcgccactcacatgttgctttccttctgcgatctgctagcttccgagatggccaaggcagatgcactcatggctcagtgagaaggtgaacgtcacctctgcgttcactgctaatggagactggagtaatgatgtctggtccgcgttaaggcgggcagctcggcagcccacacctttggttttctggtctcaggcccattatggataagctggtgtggggtggggcaggggagtttcaggggctggaagggcctcatggcagccccacgtagaggctgcctagcccctggactggccccaccaaggggaacaggacattgcagctgggcttggggaagaagggaggcctgtccttttgattcttctttctggcatcctgtgtgtgcacgtctgtgtaggtgtgtgtacacatgcacacctgcctatagtttctttccacttggaattggttttgacaaaaaggtgcgtcagcttcccaagctggtccctgtaacagtgaaggatggagcctcatcctcatcccagagccacaccctcagcttcccctggaaaaggcagcggcttcttccgatccacaccctcagcttcccccggaaaaggcagcagcttcttctgatgcatggatacagcccccactacggagctggggagggagctgcaggcagccttgaccccagaccaaattcaaaggacctgcctcttccaaaggcctccctccaagggccacggggaccccatgaccgtcctctcatcccaagctggctgcatggggtgggctggtttatacgcagataagactgcacctgctgatgaggccagatgcaggtgaaccccggtgctgcaaatgaggagtctgcagatggggtgaggctgaaaggcagttgtggaaggccgggcagtggcagccacgtggcagaggagggggtgggagacccggggcagggatgggacagccatggggtgcaggagactgcaccccctgtgaaggacaggccagcggccagcccccaggccaccctggctcctgtcagcatcccaggtcgagtccactgtcatcctcatctgaacaccctgactgcatctaacaccagggcatctgcttcctggcctctgcagggcccactctacagcctctgacgctatgtgcgatggtctcagggtcagggccaagagcactgtgatagcgaatttcatgtgtcaacctgagtgggccttgggtgcctagacatttagccaagcatcgttctgggtgtgctgtgggtgtttccaggtgagattagcatgtgaagggtggccctccccagggtggtgggcctcgtccaatcagttgggggcctacatagatccaaaggctgagtgagagggcctcctcctgtgacagctgcagctgggacctcggtcttttcctgcctttgggcttggactgaaatgccagctcttcttgggtcttcagccttcaggctggaacctgcagcagcatttctctggttcttgggccttcagactcagactggaccgaaaccatcagctctcctgggcctccagcttgccaacgacaggtctcgggacttgccccttccataagtgcttgagccaggtcttcaggataaatctctttccacctatcctgttggttgtgtttctctggataactcagactaatacaagccagtccttccata

SEQ ID NO: 4489 - DNA, 1386 bp, Homo sapiens
aaatgccgccacagactttcactatgttctcttcactgtcaaatggagagtttgatatactaagcttactctcaatggacataataggaatataacaaactagaaaaaagggaaacattaagatgttttagtgattaccagacaggtattcagtagttaacaaagccctgccaggtaggtagccatgtttaaaggcagaacaaattctataatgaagtccttggtactgtacttattctagtaacatcaattttaatatatacaaagctttttttttaaaaaaaagtcactcctttggaacaaaccactccttcaacctttttttaaaattgtacagacttgttccattttcatgaatatctagacttggtgagtgaagcaacctgattggcttccatccagctggtagcatcttgcaagtgataaaactccacgaaggcgaaaccacggcttacacctagagacagcattcagatatagacgggatacttgtgttagtcagttcctttataacaggtgaatctctctcccactgcttcaacactgcgtgacaaagccaattgggaagcagctttacaaatgtgacttgacttggggatcttcttgatactttgccatggcaaggaacaagccgcctgaactaaatgccactccatttgattccacgcttaaagtaaccatgcaaccgactatagtcaaaaaaaaaaaggagtttataaatcattacttacctaaggaaaaaaaagtccctaaaacaaagtttaaaaaagttcctcagatgctaacatggttttcaaagagtcacattccttagccatggcaaacctttcattctgaattcatgtgcttgaagactgggggaatcaggatgttctttagggactgaggtgggaatggggaagagaacaataatatcaggaactaagcaagctctcacctgttttcctcttcatcagcctcacatccgcaggctgagggccttcgaaggactccatcatttctcgaatctgcacagggttttacattatttacagttaaagcttttgccacacactattccccatggaataggaattacatcaactgtttaattagccaagttttttttttttttaagatgggagtctctgtctctcactcacttgattgcccaggctggagtgcagtggcatgatctcagctcactgcaaccaccacctcctgggttcaagcaattctcctgcctcagcctcccgagtagctgggattataggtgtgcaccaccatgcgtgactgatttttttttttttttgagacggagtctcgctctgtcacccaggctggagtacagtgacgtgatctcggctcacttcaacctccacctcctggattcaagcgattcttctg

SEQ ID NO: 4490 - DNA, 2105 bp, Homo sapiens
attttgactgtgatgatgtttcttaagacacacagagctgcacgccagaggggtgaatttttactgggtctgcaggtaagcagctgcacagacagatgtgcgggatggtctcactttaagtctgcactgagatctctcttctactctagacagactggaagggctgcgcagaaagcagcagggtggccccccagctgtgggctctgttcccagaagtcccagcggaggacccagggctcaaatggttgggtcagatgaaagtcagaatgggatgtgttagggaaggctggacaagaggggcccggtatcaggagcccacatctagagaaggaagacaggtgcttgactcatcccaccctgcccaccacacccacctctcctggcactgctgctggcgctgtgtggcacccggactccagacagacggaggctgccaccactgctgatgtggtctggagccaacagcatggccccccgccttcctctgagacatgcactgacgcctgcattccaggcattgctgttcttcccattgtctccccagtcatacagccaggggccagcacagacacctcccccatccacccgactgagacttgggagaaggctgatctacccagaggggacaggtcgcagtgcatcctgagtgctctcctggccgagtggcctgtcccacgggggagcatcctccatgccgcccttcagtccgaatgtgggtggttcgagactggcccaccttggggggctcagagcacagtggaagaggaacgcagctgtgggaagtgctcgtacctggcaggcgcacggcagtggtcaggggcccggacagagccatgccgatctcggtcatgccataccgctccagcagggtgtggcccgtgatgttcttccacttctccagcactgggaggggcagggcagctgagcctgagaccatcagcctacgcggcacaaccaaaggcaggtttagccccttgggacgtggctctcgcgtgcaaaggtggcaggtttagcccctcaggaggcggcccttgcttgcaaaagtggcagctccttcacgagtgcaggagccccaggccgtgggtacagcaccactgtgcgacacccgggaccaacgctgcagtctgcgctacggcgtgactttgttttttgaaaacgatctgttgggtgtattttagaaggaagcaggtccaacagctaatgagggtaaacaatgtgcttagggtccgcggtgtcccctgcaaagttcctgcgctgttcacaaccacgctcaagaacagcagtgaccgtgcagctgccgaccacggagctgatcacgggtgaacagccacggcgctgcaggctgcggccaggcacatccggggactacagccggctcagcttgcaggctctgcagcagaacgcggacatgggtgaatggccgcggcacccaaggggtggggccgggcacacccaaggggctcagaaccacccgcagaactgcagccatcttggcccacagggtcagctcaggcttggcaggagaacacgggccctgagaactccgagtccccgcgctctcacacagcatttcccgcagcctcacgggcagtagggaaggcgcttttgtttgcggtctgagcggagtggtccctgctgctgcccctgctttacgaggaggcaccactgacaggacccccgctgggagatccagatggccgaggtctcattgcctctgtcaccccagaaatcacctgatcctctccttcactgacctcgttcttgcccttggttccttagatttggtaaaacgttgtgctcaccctgctcagcttggggcctgcccagccccagggtatcccagcagtagcagcagcaaaaccatgggctccggtggcctcacagaaaaggggcaagggaacggcaaagagagcgaagcggttcagacatgtgccttggacaacccggaattctctccaggaacaaaggtgccgcttccctgtgcacttcctggggactgggaggagcgcgcggcagccacagacacacacatcccactggaaactggatggcagtggagccttcagttcctgcagtgcaccctccacgccacccctccctctcac

SEQ ID NO: 4491 - DNA, 6886 bp, Homo sapiens
ctctgatgccgactctgattaaatcacaagctctggtggcaggtccacgtatttttaatttgccaggtgattctggtgtgcagccaaggttaagaatccctgatcttagctcacacctataatcccagcactttgggaggccaaggcaggcagatcacctgaggtcaggagttcaagatcagcctggccaacatggtgaaaccccatctctactaaaaatacaaaaattagccgggtgtggtggtgggcacctgtaatcccagctactcagggggctgagacaggagaatggcttgaacctgggaggtggaggttgcagtgagccaagatctcaccactgcactccagcctgggtgacagagtgagactccatctcaaataaacaaacaaaaaaccactgttctggagagaggattttaaagcatctgtttccaacccgggcttgctctcagagtttattccttgaggacaatttctaagcaaggatatcactgttgttttgaccttcagtcccatttataagggtccaaattcctttgagaaaagttccagaaatcctcctccctccctacccaatctatgatcctatgtccttgtgatgcccgtttccacacagctgaagaactacggaaggaaaatgtagtaaactagaagaaaaagacaaatgccttcctgttcccacttctctaaaaccccatagctaggaacagaaaaaaaggaaaagacttgaaatgttctagagatataacaaaaacttttttttttttaaagaggatccacctggttcatgaaccctccctcactgctctctgcacatcacggccacacagcacctgcagggaggctgtggggaggtgtggagcaggtgcaacaggcagctactctcctgggggccacacggcggagagaggattcgatgcagcatgacgatcccttcctcccaggcatgacctcttctcagaacacgggaactgacaacactgcgagtggcaactcagcaggtgggcagagaagcagaaaggggccctcagcaccactaggccagctctcagaatcagaagagcagcctccagggagggagcagggctacagggacagcctacgggcagtggagcttctggtttggcacatgggaaaggctggggcgcatgcgctgaaacatgacaccatcagggaagccagaaaggacaacatggacaaggccatcgatctgaacccccagccaaaatgggtgctctcggcttgctcaaaaagtgctgccagcagcgataggttggcaaattaaaagcaaacaaatagaggtcacggccacacaaaggcagtaactgcactcacaaggtggctcagcccaaagaggtctgaatctgaatatgccgcactgtccctgccccgggggagaaggggaaggctgggccctgggaactagagatgatggcattcctttcattccttcctgaggcgggcctggagggctgtgccctggtgactcctgtctcctaaaggagggcagggccggctgaaggatccaggcattgatgtctagttctgaggacacccaggacccgcaactacaagggccatctaaaacgtggcctggaggggatgggggcaggcgggcacaaaacttctgctcagctcactccagctccccacgtgctcatctgttccccagatctggggctgcctagtgagccgttaaacgcctgggttccgcccagggctgccttccaccgggacgccgggcctgctgtggctggaccctacaggagacaagggaaggagaattaacatcaaagctggtaaagtatcctgtcaaaaccaagtgccaaatcctctgtgggacaggaaggggcagctaagacaggtgcttcgggatgccttgggaagtatcagagcagaaacaggagcgactggttagcagatggtcagccaacagatgccttccctgggagacggggaagctggggctgtggatttctggccccgagggtcccaggtcattatgctgaacaagaggcaccttcccgggacgatacagcaccctgtgctggaaggaagcaccattttccacagtggaggagtctcatgacccctcctgtcttccagaaggatggaagggagcgcccaccccacacccctggagaaaaatgccccccagcctggggagccatgggctctgctcctccctcagctgaagggccaggaaagggaagtgaaggggcagggagagggaagatatttaccttacgtgtgctctgaaaacaaaaaacgcgcactagtccacagtcatttatcaactgcagtttccaactgtgccaaagagggaaaggtctactgggaaggctaaagagagcagagagagaaagaagaggagaagctattgagcagaaatggttgtgcctcttggctccgggcagcaccatggagagggccggtgccccgggcaggggaagctgagggagagctggcagctgcagtgctggtgctgcgctgccccacagcctgcggctcaggatggcagagaaagccaggagcacagcatggagggctgcacagtgtggggactgcctttccctcggcaatacagttccatgaagaactgacgtggaggacctacccaggatttgaaatagtaggccaggggtcagacaactttttctgtaaaggaccaatatttttagtttttgtaggtcatatagtctctgtcacagctactcagctccactgctgtaactcaaaggcagccatagcaatctacaaacagatgtgtgggttctcataaaacttcattctcaaaaataggctgctagccagatgtggcccttgcaccactatttgccaacccctgctgtaggcaatttaaaattattgtgtcttccaagtctcaaaaaaggcacttctctgctgggcgtctagtgccaaggtctccagaaactggttctcatctgcatgatttaagcagtgccccaccaaaatctccaggtgtgcagcggccctacgctcctccggacagtgaagtgccaagctcacgggacaaaatgcaggacaacccgagttcaggcaagaaacagaaagacagcaggccagcctcactgaagcaactgtcaggacggcccagtgaagattatttaaaaatctccgggtgtgcagtgatgggaagagcattattttgggattaggtctgtatcttcactacaacacgtgcagtctgagtagcagtgagccagaaaaaggctcacatgtgggagaaccaaaaccaaaagactcccatttttaaaaccttggcctctgagaccccagtgtaatgtgacaatgtgaacttctgtagaaggggcaccccatacaataagaaaccatcacagtgggtaagcacagaagcctcaacaaccctaaaaggtgcggcactagctactcgtccagctactttggaggctgaggcaggaggatcacttgagcccagagtatgaagccagcctgggcaccatggcaagaccttatctcttaaaaaaaagtgcagcaccatccttagagagatctctttaggaagagatgcaacccatccccagatccaagacttaagcagcacgacctcacccgctgcctttttgccaacacccagatctggagcccacaggggctgaagcatccacatggcccagggtgggatttctgtcccttgcacctgcatgtgacctcacaattcagaaaggactattagaaaaacatgtttgtgctctcgagtgtgggtctgagcagccacagtggctccacgggaggcctacaggaagcaggtcagagtccctgggccttctctctggctctcattcctgccctgtagaacaggcagaacagctagcagccctctggccacggggaggttagcagagttagacatggaagctcctagcacagtgcctggcagaggaagtgctgataacagcttgtcttcctcgtggtggggcaggtgggggtgggaggaggcaagcctgcagctccctccacagccccaccagctcttccaggaatctcaagttcaggcatatctctgaccccaaccttaggaacgcaatcagaattaaagtatcttcttgaaaaacaagaacaagaaacccttcaccactcctacccacagcctacacttcagactctttcacctccctccttgcagtgtggggatggggttccatatcccacaacctttagttcgatttgcaaaatttcttccaacacaatcttcctgctcgcagtggagcactggatgggccacgcttaaatattagtatgaactgaccaaactcttcacaaatgcccttctagtgtctaggatggtgtctgccagccacacaccctctaagccagggccactgctgactcaaagtgacctaaacttaatcttaaatggccaaaagagtgtctgaactaaaacttattcccacttcccaacaaatctctgattaagtcaatccattctaagacgtccttgagagaaataccgacttactatactctactctaaataccagttagtctatagtttggtgtcatccatgctattaaagacagcaagaagttcaagttgaataatgaattaaaaaaaaaaaaagcaagaagggggttgggcacagtggttcatgcctgtaatcccagcactttgggaaggtgaggcaggcggatcatctgaggtcaggagttcaagaccagcctggccaacatggtgaaaccccatctctactaaaaatacaaaaattggccaggcgtggtcgtgggcgcctgtattcccagctactcaggagtctgagacaggagaactgcttgaacccaggagccggaggttgcagtgagccgagatcacaccattgtactccagcctgggcaacagagcaacagagtaagactccatctcaaaaaaaaaaaaaattatttatatatagatatatatatataaagaagggaaaaggatggggagaaaagagagaaaaaagacagagggtgggggggcggcgagagtgcaagtctgtgtgtgtgagctcacggccctcaggtccagacaccatgcacgatgtaccacttggcactcacctgccgctgtggtggtcttctcaccaaggagcctggtctggctgcctggaataacctgcaggtcggtgttctcaggggactgtggcaggttctgggctcgggtagccaggagtgcattgaggtactgcagtcgcgtaacctggaggatgacagcgttactgggacccaattggtgaagcgagatgcagaaggtaggcaggaaaggtgacaccgtgcccgaagaggacagaggcacaactttaagctagttaagggcagagaagagcaactgagtcaagtgtttttaagaccttgcttggaaactgggtgcaaaggtctgtgtccctcaggatgagtggaaggccttgttccgggcagtctcagaccagctggtctagcccccggtgacacaaagtcggctaaagccagcacccacaagcagcccaggcagtcaccttgatgagctgcagatcagagagcgccctcacggtgtagtcgggacaatacgcagatgaatgcgtgccgtcacctgggtcgggctgcaggtcatggcggatgggctggagcgaggacaccggggactggtgaactatcaaaggaacaatcagtgatggcaggagccatgctggcagctgggagcctcctcccctggtggggacaactgtacagtttcgaagacccaccccaccaatcactctggagaggcaatgtgcatgggaagctgggagagaaggacaaacacagccgggagaggttttgcaggggtggagtgggccacaaagttgagcgatgaagaatgctgccctccctcctggaagcccaggggctacaccaccttgtggggtggtgggctcaggtggaaggagaggtgaggaggggcactgagagcccaagtgatgatgggggacaggctctgcagcctccaccctggccctcagcatcagcagggccgtggcttacccgaggatggcacagttagggccgacactccatagtacgtgaaggccccattctcaaacttcagaccctctttcccgatctccacttcaaccctgccctgggaggagtggcaaggagagaaacagatgcggccagattacctttcccgtcagaagacagcggaaggagaaacccaccacctcaattgtttggggtgggagggtgcatatccgcatgcccctgctcccctcttctcctagacccttccctggcctgaggaagcaggagggactccaggcctgggacccacagctacctgcaggatgagaatgaagtaatccaccggctggctgcgctggtacaggtagtggtgtgtggccagccggttgctctcgtcaaacctcacttcctggttgacactgggatgcttcaacaggtgcagcaggaccttctcagagatgcgcagcgggctgaatacatccacttctgcacgtggtggaaaaaagggacagtgtccactggggcctagtggccagtggaaccacacccaacactgtaggcaatttaaagttattgtgcccaccagggatctcccgggtggcctgtgagcagctgcccctaacacctcaacacaagagaactaggcaggggccaggtgcggtggctcacgcctgtaatcccaacactttcggaggctgaggcaggtggatcacctgcagtcaggagttggagaccagcctggccaatatggcaaaaccccgcctctactaaaaatacaaaaattagctgggcgtggtgatacacgcctgtaatcccagctacttgggaggctgaggcaggagaatcacttgaacccagaaggcggaggttgcagtgagccaacatcgtg

SEQ ID NO: 4492 - DNA, 9786 bp, Homo sapiens
caccgtgttagccaggatggtctcgatctcctgaccttgtgacccacccaccttggcgtcccaaagtactgggattacaggcatgagctaccgcacccagcctaattacaacttatttttattcctattcattctgcacatcccaacacaaggcaagaagaatctagaaaacaatgcacaacctacattgagctccacctcctataattcctattagatgttatttgtatcaagtcagcaccctcctacatagtattattatactctgtagttgtttttcctatacagataatctttctgttacatattgctttgttaacagattttaattacataatatatctatcttaccaactttataagtttgttgtaggcagaagcaatctgtctttcctattttatagtgtttgaggctgtaggtagcaagtgttgaatgaataactactttgttacttctgaaaagcttactttttgattaatacttttcctttttaccaattcctttttctttttttttcaggctcatccatggaataccaattctttttcttagtgttcacattggatttttctgttaaaaatagattgttggagttggctaacaagttgattacttccagtcaggcactctcttctgtaaagtctcttttgtaaactcctacaagcagctatttcactggatttgaaaagactgactaaaaagaaccatgcactgtaactctcaagtatacaggaatattgttattaggtaattttttttttcaatatgtgttaaccttgtcttccctacaattttctttttcttttttttttttttttgagatggaatctcactctgtcgcccaggctggagtgcggtggcacaatctcagctcactgcaacctctactgcctgggttcaagcgattctcctgcctcagcctcctgagtagctgggattacagacgcgcgccaccatacccagctaattttttgtatctttagtagagacggggtttcaccatcttggccaggctggtcttgaactcctgaccttgtgatccacccgcctcagcctcccaaagtgctgggattacaggcatgagccacggcgcccagcctccctacagttttcaaacattcagagaggtgattatggtgtatcttttattctgttttgctttggatcttggcgttcttctagagaactcatctgctcaggagcttctcagtgcatcttccctcccaaacttgtcttacccagcagagaatgaatgtactcaagattaccagttttgcagatgaataaaccaatgattccagaggttatggtgcatatctagagtcacatgactaagaaatgataaaaccaggatttcagccaggttatctgtttcaagacattttcagacaaaaaaatctggagtttgccaccaacaagaaatgatcctagcctcagcatctcagcccacactgggagtgtcaggtgctgaaaaaaaatttttttaattttacatagtaaataattttataaaaaagaaagaaatgatcccttatacaagaaggaatgataaaaatattagtaaataagtggttaaaactaaaaactttttaccatacaaagtaatagtaagtaatttgtgtggttaataaggtaaagcaagatggaactgatactctggacaacaaagtcatatatttagaagcaggatgagtggagtgatggttggagttgaagttttccaaggtcctggtattgtttgggaagtgggtaaaaatattgattaactttaacctttactcttttaagtgtataagataaaatatgtagggtaactgcttttccaaattaacagaagaaaatagaataaagaaaaatacaaaaaaaaaggccgagcatggtggctcacgcctgtaatcccagcactttgagatgctgaggcggaaggattgcttgagaccaggagtttaagaccagcctgtgcaacatagccagactccctcccagctctacaaaaaacaaaagagattagccagctgtggtggtgcacacctatagtcccagctacttgggaggctgaggcagggggaatacatttcagttttaaagagtgcaaaatggacaagaaaataaaacttaggccaggtatggtggctcacgcctgtaatcccagcactttgggaggctcaggcaggtgaattgctttaactaaggggctcaagaccaccctggacaacatgatgaaaccccatctctacctaaaatacaaaaaaattggctgggtgcggtggctcacacctgtaatcctagcactttgggaggctgagatgggcagatcacctgaggtcaagagttcaagaccagcctgcccaacatggcaaaaccccatctctactaaaaatacaaaaattacccgggcatgctggcatgtgcctgtaatcccagctacttaggaggttgaggcaggagaatcacttgaactcaggagacggaggttgcagtgagccgagatcacgccactgcactccagccagagcaagactccatctcaaaaaaattagccagacatcatggcacatgcctgtggtcccagctagtcaggaggctgaagtgggaggatctcttgagcccaggagttcaaagttacggtgagcaatgatcttgccactgtacaccagcctagatcacaaagcaagactgtctcttttaaaaaaaaaaggccaggcatggtgtctcacacctataatcctagcactttgggaggctgaggtgggcggattacttgaagtcaggagttcgagatcagcctggccagcatggtgaaaccccttctctactaaaaatacaaaaattagctaggcatggttgcatgcacctgtagtcccagctatttgggaggctgaagcatgagaatcgcttgaacctgggaggcagagtttgcagtgagctgagattatgccactgcgctccagcctgggcaacagagcaagatcctgtctcaacaaaaaaccatttcacctctttatgtggcttctagaaaatttaaaatcacatttgtgacttccattttatttctcttggacagcactgatctaggatatatatagaactaatgtaagtgaataagagaaagacaacccagctttttaaattggtaaatacctcagaagaggaaaaattaatgtccaggaaacatttgaaaagctgtttcagggaaatcagggtgctggtcagagtgttaattgatacaatcattttggaaaacaagttggttggcattacctagtagagttgcatatgggcatatcttaaaacccaacaattgttcttagatatacaaattaaaactcttgcaaatatacaccaaaagacatgtctaggaatgtctgtagcagtattggcaaatgggcaaatgtctatcaactatagtatatataatgaactactattaaacagcttaaaaggcagggttttgcatttgttgctgaggcaggagtatcacctcaaacacttgggctcaagcgatcttcccacctcagtcacccaagtagctgggaccacaggtgtactccaccatgcctggatttttttttcccctgtcttatggtgctgatgtataattgttttttagtttttttagaaacagggtctcgctatgttgcccaggttggtcttgaactcctggcctcaagtgatcttcccacactggtgtcccaaagcattgggattacaagcatgtgccaccaagcctggccataactgaaattttcagctatgcctaccaaaatggtaaagtcttggggacataataatgaacaggaaataaaaggcatagaatgtttttccatttatgtaaagttttaagagtcaaaattaaacaacagatggtgttgagaaatatggtaaaactataaccaagagaaaggtaaagaaaaattttaggatagttttggtttggtttggttttcctttctgaacaggaaaagggattatataggggacacccaggaggcctcagagcacaggtaaatttgtatttcttaaactagttagtaagtggacagatatttgttttgttattttgtctacactagatgtaatgaatgttatttatatctatttattattccgtaacaactatgtgtgtgcgtcctttgacccagcaaattctatttctaaaattttggttcacggaaataaaagcactcgtacatagactaaatgtacaaattaatggtataatttgtggtgggagaaatgaagtgaatgctcataaataagggaatgggtgaatatattttggaacatccatacagaggagtattatactgtcattaaaaagaattgagtttgccagacatggtggctgacaactgtaatcccagaactttgggaggctgatgtaggaggatcacttgagctcaggagttggacaccagcctgggcaacataacaggacttcatctctactaaaaataaaaaattagctgggtatagggtcatacacctatagtcccagctactcaagaggttgaggtgggcggattgcttgagcccaggagatggaggctgcagtgaggcaagatcgcgccactgcactccagtctggacaacagagcaagaccatgtctcaaaaaataaataaatacataataagtatatgcatatgtatttagatatctattaagaaattaggccgggcgcagtggctcacgcccataatcccaccactttgggaggccaaggcaggcgaatcatctgaggtcaggagtttgagaccagcctggccaacatgccaaaaccctgtctctactaaaaatacaaaaattaaccgggcatggcacgcgctggtaatcccagctagtcgggaggctgaggaagaagaatcacttgaacccaggaggcagaggttgagtgagccaagatcacaccactgcactccagcctgggcaacagagtaagattccgtcttaaaaaaaacaaaacaaaacaaaacaaaaccctcacactatattccaaatcctgaaataagaaacaaatttgcaaattaagaaattatggattaacttattgattattgctcagaaaacgtaccttatttttactctgaaattcactttatttataatactttaaaacaatttagctaaagtagtgtttataggatgttacttctctggttagacatgtttcacacaacagttttcaatgctgaaaattcatttgataattttaatcacaatttatgattgattgatggattaatcagtaatttagatgccataagaaccattgaaaggaataatctgactattgctcattgtacaatcttgatcattagttataagccaagaatctgatatcccactcttgaattacatttttcaatgtgtgtatttggtcaacaacaggtcacagtgagccgagatcatgccactccactccagcctgggtgacagagcaagactccatttcaaaaaaaaaaaaaactgaaaataccaaatattgacaaggatttggagcaagtggaaccctcatacattgctgatggaaatgcaaaattatacagccaatttggaaaaataactgggtgtggtggtgtgcacctatttttccaacaacttgggagactaaggtaggaagatcccttgagcccaggagtttgaggttacagtgagctgatggcgccacggctctccagcctgggtgacaaaataaaactgtttcaaaaaaaagaaaaaaaaatgatgctataagaaaaaaactatataccaatgtccttcattaacatagatacaaaatgtttaatcacaattttagcaaattgaatccaactgtctcccccacccccacatctatctatatatctatatttgtttgtttgttttgagacggagttttgctcctgttgcccaggctggactgcaatggcatgatctcggctcactgcaacctccacctcctgggttcaagtgattctcctgcctcagcctcccgagtagcagggattacaggcatgccccaccacgcctggctaattttgtatttttagtagaaacggggtttcaccatgttggacaggctggtctcaaacttctgacttcaagtgatccgcccgcctcatcctcccaaagtgttgggattacaggcgtgagccactgcatccggccttgtttttttgttgttgtttttttttgagacagggtcttggtctgtcacccaggccagagcgagtctcatggttcactgtaacctccgcctcctgggatcaaggaatcccacctcggcctcctgagtagctgggactataggcacaagccaccacgcctagctagtttttgttttgttttgtttgatttggttggttgtttttttctttttgtttttgtttttgtagagatggcgttttgccatgttgcccagggtggtatcaaactcctaggctcgagtgatccacccacttcagcttcccaaaaggctaggattgtaatcacatctgtaggcatgagccaccacgcctgataaatctaacaatacattaaacgtaaaataccaggccaggtgcagtggctcacacctgtaatcccagcagtttgggaggccaaggcgggtggatcacctgagatcaggagttcaagaccagcctgaccaacatggtgaaaccccatctctactaaaaatacaaaaattagctgggcatggtggcacacgcctgtggtcccagctactcgggaggctgaggtgggagaagggactagccttgtctcagatgagtctttggacttctgagttaatgctggaataagttaagactctgagggactattgggaacacataattgtattttgcaatgtgagagggacatgagatttagtggggccatgggtggaatgatatgatttgggtctgtgtccccactaaatctcatgtcgaatccccagtgttagaagtggggcctggtaggaggtgattagattatggggatggtttctcatgaattgcttagtaccatgcccccttgtgagttctcacaacatctggttgtttaaaagtgtgtagcacctccccaccctctctcttggtctagctcctgccatataaaatgccggctcctgctttgcctttcaccatgagtaaaagcctcctgagaccttctcagaaacagatgctgccatccttcctgtacagcctgcagtaccgtgagcaaaataagcctcttttgtctataaattacctagtctcaggtatttatttatagcaatgtaagaaagaactaatacaagtggtttcacttcttatagcctaaaactacctagcatgcctttgaaattgcaactgctttctatttcttataattcagacttgtcttttcatttgtgaccaattcctgttatttcaaaaccaaagagtgcatgagggtgaattatattaccctgaagagatgagacaatgactctgtctgaaccattcagctggtctaggtgactagagactgcagagatgtcaggactgttgcctaggacacaaagcagacttacagggcattcctcactgaaagaacattttagggacacttacttatccagaaaggcataaataaggaactggtaaccctgataacttgagaaccctactgctacctggtgattagaggcagtctgagacacataagagagtggttcaggccaggagtggtggttcacacctgtaatcccagcactttgggaggccaaggtgggtggattgcttgagatcaggagtttgagaccagcctggccagcatggcgaaacccccctctactaaaaataccgaagttagccaggtgtggtggcacatgcctgtgatcccagctacttgggaggctgaggcacgagaatcacttgaacccgggaggtggagtttgcaatgatccaagatcatgccactggactccagccagagcaacacagtgacactctgtctcaaaaatatatatatatattttgggacctggacaggtgaccatggtgagacctttgaagacatatgtatgtccatagcatgcatatgtctttgaactgtgtatcttgaagtaatgttatgttaaattatgtaatagataatcataaagtgtctgagtcatttctaagtaagttaaaatgctgagatatcaatttaatcttttagttttttgttgttgactttagacatctagaaatataaagcataatcaatttaagaataaaaaatacggcctgggtacagtggctcatgcctataatcccagcactttgggaggccgatgcgggcagatcgcttgagtccaggagaccagctcggtaacatggagaaaccctgtctctacaaaaaatataaaaaattagccaggtgtaatggcaggtgggtgtggtagtatgcgcctatagccccagctactagggaagctgaggtcagatgatcacttgagcctgggaggtgtaggttgcagtgagccaagattgtgtcactgccctccagcctgggcaacagagtgagaccctgtctcaaaaagcaaaaactatgcaaataaggacaattattaacaaaacaatctgaaatccgtatctgaaaagtgtttctggccaggcgtggctcacgcctgtgatcccaacattttgggaggccgaggtgagtggatcacttgacaccaggagttgaagaccagcctggccaacatggtgaaaccctgtctctactcaaaatacaaaaattagccaggtgtggtggtgcatgcctgtaatcccagctacttcttaggaggctaaggcaggataatcgcttgaacccgggaggcagaggctgcagtgagccgagactgtgccactgcactccagcctgggtgacagagcgagaccctgtcacaaaaaaaaaaaaaaaaaaaaaaagtgtttctaaaggtaaccaggccaggcacagtggcttgcctaggcctaccagctgcagggcaggttacagctagtggcccaagctctgggataaaatattaatcaatattaatgatacttagtcttttaagcttaagcttatatactttgttgtctttatggtttaacaaagctaaatatatttcaatctgttaataaaaatggaagaaacatctttaaaaaattatgaagtaattttcatctacaaatattgacaaaaaagttcaaaattactttctaggtttttcactagaaattaggttactaaaagttaaaattatagtaaatatatatattaaaactactaggctgggcctggtggctcgtgcctgtaatcccagcactttgggaggccgaggcaggtggatcacctgaggtcaggagttcaagaccagcctggccaacatggtgaaaccccgtctctactaaaataaaaaaattagctgggagtggtggcaggtgcctgtaatcccataatcccagttacttgggaggctgaggcaggagaatcgcttgaacctagtaggtggaggctgcagtaagcagagattgcgccactgcactccagcctgggagagcaagactctgtctcaaaaacaaacaaaaaaaatttctagctataagagaaacaattctgtgtacacagcatttaaaaaccaaatgtgtctttggtaaagaagattataaagaaggcatgagaatgtagtttttcttaaaggaaaagtacttttgtctagagattcctaaagattattttaagttgaaaggataagaaagaatgatagataaaactaaatggaggccaggtgcagtggctcacacctgtaatcccagcacttcgagaggctgaggcaggcggatc

SEQ ID NO: 4493 - DNA, 33461 bp, Homo sapiens
ccgcgcttcccgcaacagtgaaatggggcgggagcggggacggcctgggccgggtggggccgcggtcctgagcctggcgtggctgcccttccgtcctccggccccgtcacctctcgcagggttaaggggcactgctgggaccttccccgggttgagcctccaggtggcagggggtccccgccgcttcctcctctgtgtgcagggccggggttgcgtgaccccgcgggcagtgggcagcaggaagctcgggctgtgcggccgcgtggcagagcggacgacggacttgcgtccgagtgacggggcgcgggctgcagactggcttaagccctcggtggcagacgaatgtgcccaggctaagctcaggggacgtgtgtggccccgtgctatgggcccgctgtgagggtgccgccaggccgtcgatcactgcctggacgtgaggagtgtggtggtgaaggacactccctggacagagtcgcttcccatcacggcttccccgccggaccgcacctcccggagccctggcgccagccagcccggtttagcggccggaccgggctcccccgcggtcccaggtctggttggggtgggggccgcggcctcggtgaccccagcccgcagcggcccggcccgtcccgtccacttaaacaaattgccgctgacaggcgcgcagtctctctggagccgccgccctcccgtcgcctccctcccgtcccaattatcccgcgcagggtggggccaactggctgggatggggcgggggacgcggggagagcgggcggctcgactccctcctggtcgcggggtggcccggggaagcgtctccgcagccacggcctgtgtggccccgtccctggtcttcccgggggatgcgagggcaaggcccagcctggcagctgtgggccctggaagggcgtcgttctgcacctaagggcgagatcacgcggccgagaaccaaggccgcatcccggatggacttcgggtgactttcccggagttctggggaatcccctaacccggggagctgcagacgactcactggccccgggccgcggttccgcgggtggccgctgtacgcttgagacacctggtccgcagaagtcaggtgcacgtctgtgcaccgtcgtgcgttggatgtgcatggaggcgagatcgtggttatggatgtctgggatcacgggagcgtgaacggggcgatcgactgagtgacttgagagacggggtagagcgcaggaaggacccctaggacgggcccacctgcgacgggcggcggtgggggagtggggggcttgccggcgcgttcacaggctctgggttcgcgttcggaaacgctttcgcagggagcgggtcgggattccccggagcagcacggtgacggcgtgccacaatccgggctccagctgtgccgcctccgccctccccatccctgctaaggggcacctggcctggctgtcaacttcccctcgaaccatgggtttgccttgtggacccgcagcttcccctctgcctgcttctgctctgtcgcgccttcggaagggcatgctgctctctcccctccactccctcctttacacatgaggaccctgaatcccagaggtgcagtcatgtacccaaggccacgtacctgctggtggcagagctgggatgggaccctgggaccttaaagagagcaagtccaaacccactcctaagaagccggtgctgctgagctgcctacccctgctcctacagcaaggtgatcctgagatgccagggctgccaccctcccctgggctcttgctctgaattcgagacatacaggatgcactgtccctttgcctctagagcctccagttctaggtctgcagtgggagggctgccttccagctacacaggggcaagggagcagctgcaaattcagtctctcagcccaggcaggaagcctgatggagtcaggatggggatcagtggggtcagcattctggatgggataggggcacaggacagggaggtcagttcggatttgggtccctctaagggaactggccagggtgtgaagcagccaggtgcagacagggataggctcactaggcgtgtgactttgtgaccttgggcaaggccctgcccttctctggggctcaggcttgcttgtcatctgcaaaaaaaatgaggctcgaacagaactctcaggtactttctagtttcatgagtccctgaattgtgaaaataaaaaattaccactgagaaaccatatacacttccagactggtggctgcctagcctggcctctgctccttgacagaggggctggccctggtgtttgagcttgtgtgcttgaattggcctcaggcccaccgtgccttttctcatctcagacagtactcttgctccttcagttgccacgctggctcccaccggcctctttccagatcatgaaggtatttttccttcatcaaattgagaggaagtccgtagtaaagctgcccgttgaccaggtagtgccgagagaatcggtaggtcacatggattcctaaaggtcccctgatcagccacagtttgattcatgttctgatgccctcccagatgatgccaccattaggtctgctggggctgggggtgagtcccagattgccctggatgttatctgtagaggataggaagcggctgctctggggccagtggccagtaaggtccccaaccctggggcccagctctcccttccagctgattacaggctatggcaggctccataacctccccaattagccggaggccaggcccaaggcctttctgataacctgagctccagtggcagccgctgtggggccagcttatctggtctctcttatcctcacccttcccccacatactcaaagagttgccctgacttcaagcagatgaataaccagattgtcctgcaagctcagccggcaagtccagccctacacccaccactttccctgcctgggggaggccacagctgttttgcccctgctggaggggaagggccgggccagggaggactcctgactctgtaagctgccagccagttccctgaatggttgagagagcccctggcagcaaggtctctgccacatccacgtgtcctggggtggtttcagaggggctcatgcttcctagggcagctgaacccatccccaggaagacaggccatgggcagcatgcacaggtagcctggtagcactctcctccttgtccctttttgattgaaacatggctgtagctgggggtaggggcagtgccaggcccatcaataattcagcaagatggggaaaagctgcagctcctccagcaccccctgctgctggggccaggctagtgttcgcaagcatgcctcagtctggcatgtgacttctcgccctgcaggtgccctggcaggagggactggcttatgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaatcacacctggctctgtgggtttccttccattctccaaggcctccctggggtctctgggaagtgtgggccagggaagggggcaaaggactagcattcgtctccttcctgctcaatgcaccattttttctccctgttcctgtctctgttgccacttactttaggtccggaagtggtggtggtggggcggggggacaaaatcaggaacgtgtcatctgagggttccggccaggtttcatgagatacccaccttcacctgaccacccttccatcttctgagttaaaaagaggcaattacaacaaggtgccccccagatgaggctttgccagactctccccttgacagcaacccaccagcacatggcaagccctgatccccagggaggagggtccaaccctgtggcaccccaagaactcattgcctctggtaacaggcaagatgcttagagaatgggcttcttaaatcaggccccatccaaattccaggacaaaagttcttcccattccaatcctccactgactccttctgcccccaagttgcacatgaaagggggtgttgggatcctgggcactcaggccataggactctgctcagcatttggagaggacccttaccccagcaactcagggatggacaccaactgcagcgtgatttattggacaagacgtgcacttttcaacagggcctcagtaaccacggtttccttcactgatcagtacaggaccagggtaaaggggcttaaagataagaaagacaaactcttcccatgaacagatggggaaagaaaggaggaagaagaggcatgtcctcccttcctccttccctagtactctgggcctccgttcaccccgtgctggagtggggctgaccaagggaagctgggggcagtgtgtgtcacagccagacatgagctgaggctgtgactgtccactcagggtcaaaatggccaggtggacgatcaactctgtccccactcaggcccccagatctggtcactgttccaggctccccccacccgccccaccgtgggtatggttaaaaaatacaaaagcggatccaatgcaggatgtcatatgcaaacatacacagggaccgagcttctacagtctctcctggccacagcctccaccgacaggtgtggcagagggcaagtgcgctgaggtgcttggagaagggtctcttctccatccaggtaggatgggcggctgctgtcactaagcttggggaaggtggttgatgaaggaagagcagagactgaagggtaggaccagagcggggcttctcccctcctccagcaggggagggggctggccagtcagaagcaggttgctggtacctacgggaagccagtcgggaagaggctgaggggctggctctcattggtgggcagcggagatcggtagccatcaaagtttcttggtatgctgccgctggtggagcctgagctgttactcagagtctcgatgcttccctctcgctgaagttctgcaagacacaggagagggccaggcctggttagagttgggtctggggagtgggggcaccatctgggccaggctgcctgccttgaggcaccattctgggttcacttgtgtccttccgcagggggatccccgcctgctccctggatgggcagggggcagctcaggtcacaggaaggctcagccaggggagggaaagccccctggctggcagactctggtgtgagagcaccgtctccctgctgcgggaagccctttaggcccgaagcacggccaccctgacgatgtgtgtggactacacagctcttcatgagcccgtacccacgcctgcacacactcatgctcagccagcatgcccccaactccacagtgccttctgtcccggctctacaggggaggcaggcggggagaagctaggacacgggagggcttgcagcatccctgcctgatctgtccccacctctctcctgccctgcctgtgcctagagcttctgcctggctttgccactcactcattcactcatgctcacccacacagtccatctgctggccaggtcttggctcatctttggcacctcctgccaagtgtcctgtttccctgggaggggatgcctggtttgagaggggcctgctccaatgaagagagggtccctgtctgcctgaagtgcctcctttctcctttcctcttaggccccaagtctcctggaggcccctcagcatcaacctgaagggcaggcagggagtcccgccctcctcctcctctgcctccctggccctgcacatccatgttgccacctcagatatggcagcttgatccatctaattcagctgtgggccgctcaattgtcctaccatctcttgacccaagtcaggtcctggggtaggtgggttgggaatggaattccctgcttgctgagtgcaaggaagaaccaattacttcttggctttttgaaggtggtcagttccgattccctttcagtctcccccgggggctctgacatatgggcacacacacaccgggcagtctctggagcctgccccaagccaagatatgtagacctgcaacctttccttctccaagggatgcctgcctgtgactgaaggagtctggcctgtccacccaggagtgcaggacctcaaagcagtcacttgaaacagcaagatgtgcaaaaacgttgcactcgtctggtctggcttgagaccttggtcttcatcctgcaaccgctcccaggccccctgccaccacacgcgcagtacagccggctctggttagggaatgaaggggtcatggccttcactcctgggctggccaacaccagccagccagcaacgaaccactgaccccgactccctgcaggcctgcagcagccacagagtggagtggggaggaggcgggcacctgggcctggggaggggaggggcccttgggatccatcagccgagtctgtcgccggggtctcggtgggacagttcactgggacaccagggcttcttggcaaattggggaaagtagggggatgggactgtggacagggaccgagggcctgactatggtccctgacctccaggggacattggctgcctgggaaagtcaagagctatctggatatggatagaaaacaaggcagataggatctttttctcctgctcctccttcagtatcaccctaatctggggggacaggccatcgtgccatgagatggagagggtggtaaagccaagagtagaccctggggattttacatggaagctccagactccaagagacccctctgttgccttatttccccaaaagcaagccgaggagttgtgggcgatctgtcccaccgccctcatgcgcggccggcccggcactagggggcgctgacagcagggccaggcgggcgggagaagagcaccggcaggcgcaagaaaagcaggggcttccttaggatcgggccgccaggcctaaggaagaaagcccccgaggaaggagcaggcagggccaccaggatggggaaggctggcccctttttacagctcaggggcagctttaacggccttgatgcaaaatgcctccacatccacactgccaaggaagccaggaaacgggagcccgggcccaggcatggcacccccaccgtcccttggcataggcccccagcaaataccccagcagcctcggtggtcccaccaatgagtcttcgtggatgcaccccagcccatcacaccacagtgcagggaaagccacccaggggcttacaagatgaatgtcctgttcttgggggccagggacaacctgagcgccttgctcgcattttccctttgccagttagacccgggtaagaaggatgggggcagcgttctccctcgcccccgcatcccagggtaaggtaaccaaggctctgctgaacttctccctcctctgcctctgccctggctaagcctgccctgtgcgcctcagtctcctgactccaggtcacccaccctgtgccaaagccagagtgggctatgtacagcacagccctcatcttgcttttcctctgcgtaaaagccttcagccactcctaacagttcccagggcaaggtctgaactccccagcactgtgaaatggccctccatgacctgccgccaacccctcactagtgatacccgttattatgtctgagacacaaaagtgatgaagctgtgtggtgtttggacccatccaggtggttctaggcctctgggcctgtgttcatgtaacttgctctacaaagccccagaacacctactcatcttccaaagcttagcacgagtgtccactcctctgtgagcccgtcctgtcccccgagcagagcctgccagaccctaccctgcgctgtgctgactcctagcccaggccccctcatcgtcccatgtgtctcatctaggggagaccccctcgggggggttctgtgccttaactctgtatccctagtggcctggaaaatcatgggtgccctaaacatttctagcatgaatgaatgaatgaatgaatgaatgaatgaatgaatgaatgatgtggtaaggggaggtgggggcccattcttcaacacagactaactgaaagaatcgggggcctgctggccccggggcagctttgtgggcgcttttctccacgcctcctctcagaccccttctgctcctccccctgcaggcaggggtgtgtgtgggaagtggaggggaggagggctgctcagattcccccctccaagtcatcccggccgcccagccctacgagcaagcggcaaatggaaacgtgtggccttaccttcctccatcccgaacgcatgctttgttactgttgggttgctcacggacgctgggctgttggcattgttttttttttcctttttttttcccttttgaaaagaaaagcattgaggaatctttttggaaaagatatggacaacgattgagaagtacactgatctctgcaagcaggtggagaggtgtcaggaggcgcaggggcacaccgtgaggagggggagtttgcagtcaaggaggacagtgacatgcatgtgtaggggctggggaccaatctgtcttgggggtcccagagatggatctgctgtgacagagggggccaagaccccgttcagagtgggggagggggagaggagtcacaggttcaacatgaagaacagttttaggaagtgggagggctggggacctacggcccatgcagtgccagatgggaccccatgcaggtgggttgctggaggaggacagggaaacagactgcagttttcagggatgcccttggaccttctgactcagtggcccaactcctggctgctgccctcctcccccactcccaagacctccaggtctgagcagctgtcctgcggttgaggtggacctgttggggaagtccatcaggaacctgccagggcccgaaagagagtgctgggggctctgtggcaggaaatgagggaagtgtccccagccacctccccccttagaggtgtggagattctggtcagtgggagaagctttaaaagagcttgttctccaggccccaaagtagggcaggagaggaggagtggcttccaggcaagtggctagacccagtcacctcattgtgaccttgcactctccagggatgtggtcccctgggtggtgggagctatatacccacattgcagagagcaaaaccaaggaagacgaagcaaccactagctctggttcttcacctcccacccccatcccccaagaaagaacgggtgctggtgcgggccacagggtgctggcagctccggcatcactaagaccggcccccatgcccatgctggagagccattccctgttggctcatattggaaatgggcctgttacccgcagctgcccctctatgccttgggccaggatggacagcccccaggggtagggggatgatgaatgagtagcaactgaaggaaaggtgcctccgctctcatgaaacaagtgaaggatgagacagccggatccttggcactactgttctcagggtgaaaaaaaagcaagctggatcctcatgctgccccactccatatggagcccatccaaactcagaggtgtcagagggggcagaaagaggggactggcctttttagagagaagcaaccctggtcacttgggagcgtgtgcccagggagatggggtggggtggggtcactctttgtctgtgaggaggcaagggcatggctgcccacaccttgtcctactcctgagctgggccgtgcagcatgggcccatgcacctccacccacagtgcagtgttgtggcccctttgccaggctgtgagttgacgggcagcagactccccgggaggggtgaaatgcggagggcacagggcctgtgtgagacgcagggaaagctggagaggccaaaccaggggccccagcagtaggtcggaggtgaagtcgggccaggtgcagtggctcacacctgtaatcccacactttgggaagccaaggcaaggggatcacttgaagccaagagttcaagaccatcttgggcaatacagcaaaaccgtgtccaaaaattaaaagattagccaggtgtggtagcacgtgcctgtaatcccagctactcaggaggctgaggcaggaagatcccttgagcccaggtgttccaggctgcagtgggctatgattgtgccactacactccagcctggcatctcaaaaaaaaaaaaaaaaacaaaaaacaaaaacaaaaaaaaacagtaaggaaatcctgctttgggcttggtgttctctgggtctcttccaacctggacgtctggccaatcaaaggccctgcgaaaagctcctctggcttcggaagtgggggcattgagccctagtctcagggacctgagaggggccagggaggacagtgctctgtttgtgtttaggaagaggctgcctggggcccctggttcaccctttgggcagctctggcacttccgtcaccacaaaaggagcagcgtccacggctctgtacatgagcattgatgctgcccactgaagggattggcagagcactgtgactgggccctggctgcatttctccacccacgctgactggtgggagtaggatgagaccttagggtccagtctgaccctgcacccacagctctgcctgcttccagcagtgagcaggaggatgaggatgtttcccctggccagtccagcccccagcctcaagagaacccgagaaggcagaggggcagtgtctgcccatgttggtggaggcgtttagggaagtggttaagagcacaccccctggccacctgctacctgggagactttgggaaagttactcgaatctttgtgcctcaggttcccgaacatgaggttaacgatgtctgtgtcatggcctggttctaagaatgaaattaaataatgcatgtagagtgcatcacaaagtgcttaacgcttccagtcagcaaatgtgagttactattattgctgcaatcggattagtcattgtgatgatccacaggactacagggtccctctccagcctccctccccagcaggtgtctctgccatccaggccctcaccagcttggcttccaccggagcttgggaaggattctttctttttaatcaagaaatggcccagggaggaagatggcagatgtgtgtttacagcttttcatttccctcctcgcctctttgcaaataccctcttccaaaatggaaaataaatttccaaccctgttgacatgcatcgatttttccctcctgcatccacctctcagctctcccacatcagcagggactgtggttaagacccttgctggggctgggttccggggtggcccaggggagcggatggcttcgcggcacacagcagccagccgagctgcccgcgcttgcccagtgcctggctttgagaaggtttgcaaccaacagcttcagtaccttctgcctgggggttcctgaatgggcagtgaggtacgtagtaggggaggtcctctcattaggaggtcgggcattttctgcattttcccttgatgggacatgtgaagaggagaccagcgggtcacgtgactgctctaagttcagcaaatgaaccatatggggtctgccccaagcgatcaacttggtcagcaaggggcctgcacccagggcccttatgtcctgcaaacaggaccagctatgcaaaatggggcttggagagagagagagactaagtggaaggaagacttgagcaaattgtgtggggttgagcagggctggcagcctcctggtgctggcgctggcacctggagaggtggtggcccaggcagacatggctccaggctgcttgtcttacaccagtcctgtgcctgaaaacaactgctgtctcttccagagcgtggctgaggaggcgggggcctgttccgtgagacagagatggagttggctgagattggctctaagcccctgacagccttgtcagagaccacactctgggatggagccagcctcagcccccagggcactttttaggaggtgaaaagtgcagcagttaaaggcagccctgcttcccaccacactgagcatacacccacctcccaggctgcctggctcccctgcgctttccctcttccccaggcttcaccctgcagtgtggggctcccctccccaccaggttcctccctcaggcttcagagctggctgccaggcccacagaccaggggtcctctttgcctaccagcagtgagcgcttgggaggacgggggtgctggggctagcagggactgagaaaggagtcccctttctcccctggcagagtacatgcggtcaccacatgctataccaggggagagaaaatgctgtgctgacccagctcctctgtcgctggtttggatgtatctgaggactggctggagccatgctcaggatcggccagatgtgggagaagccctgccctaccactccctgtggatggcccagggaggaggaggactgtgcgaggaggccgagacttcactctggcctcagttctgtcacagatgtgccaaatgacctgggcaagtcacttcacttctcatctgcgtcagcatctgtggcacaggaggggagggtctgctctagtgacctcactgggcgtgtacggctctaatgagaaaagcaagtggggggctttaagaagcagaacccgcactggacacacacgtgaaactgggtaaaaaaatacgctttgctgcctctgctgtctttagcagcggagggccctccaggagcggggctgaaatgtctctcctagctccagctactccatgccaacctgggggcagagccttggctgatgccatttagggtggactcagtgccgaggggcatggcaggtgggcttgggggatggagaatgcccggccaggtgctgccacgccaccactctgtgtggatgccaatggggggcctggaggagtctcaggcaccggcacacaggcccgctctgcccggctatgaagaggggacagggcttggagactcgtccttggcactaggtgctggcagctggccttgacctgcctgtgtcctgaagtccagccctgaaagcctggaagacccaccctagttcccaggaaggggtctccccgagctaccctccagcgtgacgagatagcactgagccctgcagaccacaggagagtggctgtcctttgagagctgctggccggcgggccagagccacatctgcttctcattcaaatgtccaaatgtaattaaattccctacgacgcagcggaagagtttggtaagatgtggctttccccttttccatcaaggttaagaaatcacagtctctcattccacaggcagacgcgcgttcctccctgccactggtccgtcctattctgcaaaggcaaaggcctgtgctcttatctgttttctagagcttatggggctggggccagcatgggatacacggatctcccccacccccgtgttccatttacccacctgagaggattaacagctgaggccaaagctgcgggcttgcagccgagcaagacagtgtgctgggggttcaacaggggtgggggtggtgagttagtgcccctactccttctgaaagtgtctccctgaccctgaggagacagcactgtgcccaggctcacctcagtgacacaccagtgtccttccactgctgggatgtgagggtgtcataataccctgctgaggagaccccggcttgctttgtagctcctcacagtaggaagtgcttgagggttacgattctggagtctttgggacaaggacctccctgtacctggcctggcccggccctacagcccaggacacggtgaggcccttccccacctcttacttctcaccttggggccctgggactgcggcaaggaggcgcccctctccccgccccctccctgtacacgaaggaggagaggtatgagagatggtggaggaatccgtctaacagacaaggcccagagtggtgcctggccctctccaagaatctccaggacctccatgtctctcaggactgtttgccacttctggcctggaagggctctggacagctgaagggacagcagggtccaaggtgcagtcctctgtgagagggggtgccctgtttcaggcttcagtgcctctgcccctcggcctcctgcccaggacttccccatatccaaatccaggcagaatggtccctggagggctgcttttcccggcttcccttcccactggaggatcttctgttcatggtttctttcagttcatggcatttatgactttcatggtaatggttccattcaccttcccctatgccaatttttctaatcattgtggtacaggctttatgagagtttctttctttctttccttcttcctttttttttttggaggcagggtcttgctctttcacccaggctggagtgcagtggtgcaatctcagctcactgcaacctccgccttctgggttcaaacaattctcctggccaggcgcggtggctcacgcctgtaatctcaacactttgggaggccaaggtgggtggatcacctgaggtcaggagttcgagaccagcctgaccaacatggtgaaaccccatctctactaaaaatgcaaaaaattagctgggtgtggtggcgggtgactgtaatcccagctactggggaggctgaggcaggagaatcccttgaacctgggaggcggacattgcagtgagctgaggtcgtgccattgcactccagcctgggcaacaagagtgaaactctgtctcaaaaaaagaaaaaaaaaagccaaaaaacaaaaactgattctccttcctcagcctcccaagtagctgggattacaggcacgcgccaccatgtctggctaatttttgtatttttagtagagatggggtttcaccatgttggtcaggctggtctcaaactcctgacctcaggtgatccaccctccttagcctctcaaagtcctgggattataagcgtgagccaccgcgcccggccccaggctttatgagagtttcttaataagtgggggtatttttcattttgaaacaagctgtcctgaaagttaatgacttattgcggctgtggctgctacccagagaccaatgaaggttggggagaggatgaccagttggggataggagagaattttctagattaataatgctgtgctgaggttgaggtccctttaagactcctggccagctcctgtgttagagtcccacatgctgctcacagcaaccctaccagagaaccagaaccacatacaggcacacatggcatctgcgtgctgaagaatgctggccctggggacaggcacacacacgcaagttggtgtgaaccaaccaatcccaatgtcactgacctggctctaaacaggaagagctttttcggtttccagatggtaaacctgagtttagtaatagatttaacttctcggtggcatttagcgtctggtagccttgacatcagtgaacaaggtttgaagttaaataacccagttcttggtctagtgttctaggccaagcctagccaaaggaatggtgttggggcacggcctctgttgccctctttggggtcccagcctgtgtctcaagcccacacgccgcggctgggaaaggatcacagtctcagctaattgtggtggtgccgccgcccgtccagatggaaacggcctggctgatgccggtctgcctttgtgcggtgctcacagactggctgctggtgccggggctctattcattattcaattcagctggctcaggcgagcctttccatttgctcctccaggaggaataacaaatctagaaatgcaattccactttggtgtattaagatatcgatttgcctgtcgggtggaagtgcatttgttctgtcagtcctcccgtgggtaggaaggggttaaccaaatgtttatcacaaggctggcttcagagttgaaagtaatgtgatcagtaatgaattttgtgttacattaggttgtataaatggacagacaagcgcagacaacaagtggccaggagtcggggctaatctaatgatgtaaaaatagagacagcaccaattatactaggggccagctccaggctcctgcagggactgcaaatgaataggtacaaatcaaattactcactaatagacgcactacaagaggggcagtcaatggtaaatgcattagagcctagtgacctccctgctctgcacagcagagtccgaaaatttcacttccatcttcaaagtggggggcagggagtggcgttctcaaagaaactcttgttgggtgaaggatgacaaccactccccatcccaaaccagtccccttccagaagagacctcccatctgagctgacccctgccctccctagagtgctcctgggcctgggcacgagggggtaggagggcaccctcttgagggacaaaagaagcaacgggacaaccccttccacataggcaaagataggacgttacataccaaaacacttcactgccacgtgtctctcaggggggaaggtttttactgctacgtcaagggctgtgtctgtattgaaaataaaatattcctttaaagcggatcacaaactggacctttaagagagcaggaagagctgagatcaaagtgagtcgatacccaaatctggtttgaccactgagagctttgcgggggtgttcatggtctgttcccaggcacagcacatctagggttttacagatttctcactagcctaaactggtatcatccttccctctctccctcctccccagtccagctgcctgagttcctacactcctgcctgctgcacagggctggggtagggaatgatgtagagagaaagccggcatcctgggtaacccctcagattttcttcctcctctcagcttccgtggatttagaaaccaggtctgaagttcaaagctgcatggcagtgtgtggttgggctgcttagagaaaggtcacaaagaccagctcaagggcactaaccacaggatcctactcagctctcagtggtcggggatggataacgcatgaaaccgagaaactccaggccttataaggccccagcccaggctcgtactccaccaacccacccctcgggtcagcaccaaacagtcacacacaccagcatggagatggcacgctggccctggccaactggagctgggagatgatgggaacattccaggaaaacgaacacagcgggcgtggaatggaaaagtcatcctgaacaaatgacacgactggatggcgcttctcccaaaactcaatgaagggtgcagaggggtggaactgcaagctagcgggctacaccccataaaacatatgtgggtaacaggggagggctgcgaagcctggtgctgggggattttgccagcaaattaaaaaatgtcttatgcagtgggccggcaggtccccgggggcaggggtgacgtgggaggaggagtgggcaggaagaaataagtaaaaggccaaggctggaaagctgtttccgggatgggctccaaaatgccttcttctactagggaacttcacttctccgttaagttcaatcggatgggcttggcttggccttcttggtacagtgctctatggcttctaggagccaagattctggattcctaaagggtcagagggtcattgccaactttcattttctgtgagcaagtgtgtctccctctctcagcagccaccacatccagggggtggcctccacatctcgggccatgtttcgagaaggcagaggggcagaggcaagggcagaagggaaaggtgggaatttaaccatccatgaccgcgttcaactttgttcagaatctcacgcctcacagaaaggtcagtggttaacagtcaatactgtggcagaggaggaggaacagggagaaatcctcccttttgttaaccatttacctatgttgatgcttccagaggagagcctggctctgggggtccaacagccctcccccagcccctcagtccaagcctgtgcctatccacagtaattcctgctttcatgttggggcagcacctggagaggggactctgaagggtcacagaggtcgcactggcacttcctccttgttgataggaatcactgtgccttggtgaaagagttgaaaagtcactttagacaactaagaaatatgcagaggagagtctcagcccaaactcccattacagctctgcccctggcggggcttccagtagccttagtgacgaaggtggggtgggggaaatgatctacccagaatcagatttgagacctggccagaaattaacaagtgtgacttttaatcaataactattcccattgctttgactggctttcatttacctctcaggggccacagaaacccatccagtcactcaacaaacattaactgaggctcagcctggctctccttccagtgctggttgctgggcagggagaaggctggtggttggggataacaaagatggttcagactcagttcaaagaaccagtagtgggtcaagacactcgtgggagtatgggtgagggaggggctgaagggaccaccagggccggcccttttccaatggcaaaacgaagggaattggtgagcaagttaatggaaaaggcagcatacactctttgcccagggccaagtatccagcaagtcggtggtgcagaaattcagagacagagagagttgcacacatttggcttcatggtcagggaaagcaacacagaggaggtgagatttgagcttggcctaagacgacgactgggcaggatgggagggcagcggtcctgaggggtgaccaacatgcaccagggccaggtaacagggtgcatgctggggatgctgggatcctatattggcaagaaggtggaggaggtgaaatatgcagaggttactgcagaaggggtgggaggtcaggctggaagggaaggtggggaaggcctgtaagagacagaaacatgatggcaaggagcctgggtgcaatgtgcaggcctggacactttctgagcagggaagtgcaacggcagtcaaggcaggccctgctagtgacagtccccttcctctgctggatccctacttattctgaataaaaggtgagaataactgataaaactccaacccttcagaccatgggagaccggcaggatcttaataactggaacctcttcccaaatttcttattttaatcccacatcttttagttatactctcacttcaaatctttcgtttcctcctttgtaaactggagaggggaaggtctacctggcagtgctctgacaattagaggacatttatgtggcaggcagagtcttaggcgtacaagtcccacgggaggtgtggccactgctatcgtggagaggagtaaaagagagagaccgagtgctccctgcagcagccaggacatcagagttacaggaggccaacgattactacatttactagctcctcctccccacactgtgtcacagaggaagaaactggcccagagagggaaaggcacttgcccagggtcacaggtttaccccattgcttgatgagggcttcaaatcccatcgaaaaggggaaaaaaacaccacattcttcccaatagcgggagcttggtgctgggaactgaaaggactctcagatttggcctctcctgccagtggaaaatagctaggaataggcaatccgacactgaaccgagacacaaatagcaacaccaacaacaccacccctgccgaggccaccggctgtcccacagtctcgctggcgcagctgctccctcttgtcccgagtagggatgcttgtgacctgctggtgggactgggctctctatctggtggccctgtgcctctggggacactttcttctctcaccctcagcaatcagggcattaggcactggggagttccagctttgcctccgcatcctagaaagaccatgccctgtgggcaggggagcactcctgacttccacttggtccagctcagctagggaggcccagcgggaagctgggggtagaagtcagagagaaacagacccaccgttcagtattgtggcctcctctggggctttaatctctttgagggtaggaaacttgtctctcttatttttctccagcctattggggaagaaactggcagataccgatggagaccctgcctgccccaaccacagaaagaacacgttgggccactgatgaggtcattaagagaagacactgagagaacttttgtagatgctgtagaaggaggaaaactccagggcccaattagataaggcagaggaaaagccctaggttctggctaagttgcttgggtgatagcatttgctgagacaggtgcaattttaggagcactgggcaatcagagatattacccagagaagcctagagactttggcaagagagccagaccaagccagaagctatggcttgcacagatgaatcacccttgtgcatcttgagaaggggacccaggaagttggagaggtaaggcttggaggaaaaaattaaaagacaagactgggtctcatgggcggccacactggggatcctggagaggagagcgattcctactttcaggaggccgaaagactaacccttcctgggtatctggggtaaataccagtttgcctgatagagtggctgtaggaagaggagagaagattctctggaaagatcaaagcagcttggtggttgtgtgtggtagggaagcagggaatgtgacctatggggctatgagccacgatggccctgtgaaggcagcatcttcagctcacacaacctccgggtttgcttaggacaggaacagtgtggctaacccaggacccataaaggaggctcacctttcacttagaatcagagaatctcaggtttgggaaagggacctgagaggcccacataacacatgtaaatgtcacttctccagctttctggggcaacactgtcagttcctatttccatggccttgcaatgagttgggccagtaggatgcatctatctacccctagggctggactggataaagttctctctaaattgcagattttaaaaatatgtgggatgcagaaaattctaaccaccaccacatcttctgaaatgtctgcaaagtcaaatgtggtcaactactttctgtagcgaatactgataaatcaattatctgcttttaaaatgagactgaccagagagtagggatggctaaaagataattggcccggtgtggtggctcatgcatgtaatcccagcactttgggaggccgaggtgggtggatcacctgaggtcaggagtctgagatcagcctggccaacatggtgaaaccctgtctctactaaaaattcaaaaattagctgggcatggtggcgcatgcctgtaatccacgctacccaggaggctgaggcaggagaatcgctggaacatgatgggaggtggaggctgcagtgagctgagattgtgccattgcactctagtctgggtgacagagtgagactccatctcaaaaaaaaaaaaaaaaaagataattaacacatggtactggtgcctacaattattgtcatctgatcatgtggcaacctggtatgggatggggctaatatgatccctattggaaatgtagccttagattgaaaaagttcccagccctccatactgacccaggcaggagttccaaggccctttggaagagctgattctagaggcaggagaggggtccaatacactgagatatttggattagttatttggtacatatctgattgactccagtaaaaacagctcatatttgttgggagcttactttttacagtcttaaaatgaaagactttattagtacacacacacacacacacacacacacacacacacacaaatagtgcttttaggtcatcttttgcaaaacatagcaatcaacaaatatttgttattaacttgctgaaaccatcccgtgatcacttaaaaactgcctaatgttcaaagtgttctttttatgttaacaagagaaaaagaaaggcgcagccctttcagtacataaaagtagcttctgacagaaatctttggaagagctttagttgaacataatcttaaagccttttctgcagagtaattaatacataaatgggaaaactcagaggatttaggtgaacaagctagagcattgattttcaaagcgcagattgccattcaccaatgtattgtgaaatcactttagtgggtcacgagtgcattttttaaaaaatgaaataaaatagaaagtacaagataattcttagaataatagaagaaaaggaagtactagaatgcactggccgtaatattgttttgtgaagggttatagatgtgggtgaactaggtcaggaagtaaaatatgtatatgacagaaggtaagaggcaaagactgagcccactatgttatccccaagaataactacttctggctagggcagagactgttaaagagacggcaggcaggaaaagatgaagccttttcctatctttaatgctgtcactgtaaagaagaatcagtgagcccggggccgcaggaaggaacagtcacggggaacagacagtctcccggaccctgagagctgactctgtgagcacttaagagtcaacagcaggccgggtgcagtggctcatgcctgtaatcccaacactttgggaagctgaggcaggcagatcacttgaggtcaggagtttgagaccagcctggccaacatggtgaaaccctgtctctactaaaaatacaaaaattagccgagtgtggtggcatatgcctgtagtcctagccacttgggaggctgaggcatgagaattgcttgaaccctggaggcagaggttgcagtgagccgagatcgtgccactgcactccagcctgggtgacagagaaaaaaaaaaaaaaaggaagttaacagcagcaaacagatactcagatactcctgcaacagagatgcatcaagaatactttaaatgggggccaggaactgcggttcatgcctgtaatcccagcactttgggaggctgaggtgggcagatcacttgaggccaggagtttgagaccagcctggctaacatggtgaaactccgtctctactaaaaatacaaaaattagctgggcatggtggcgcacgcctgtagtcctagtcgctcaggaaagggccccaggagaggaggctgaggcatgcgattcgcttgaacccatgaggtggaggttgcagtgagccgagatcgcaccactgtactccagtctgggtgacagagcaaaaaaaaaaaaaaaaaaaacaaagaagaagaagaagttaacagcagcaaacagatacttcctgcaacagagatgcatcaagaatactttaaacaggggctgggcatcgtggttcatgcctgtaatcccagcactttgggatcacttgaggccaggagttcgagaccagcctggccaacatggtgaaacctcgtctctactaaaaatacaaaaattagctgggcatgttggcacacgcctatagtcctggccactcaggaaagggcctgaggagaggaggctgaggcatgagaatcgcttgaacccatgaggtggaggttgcagtgagccgagatcgtgccacagcactccagtctgggtgacagagaaaaaaaaaatgttaacagtagcaaacagatacttcctgcaacagagatgcatcaagaatactttaaataggggccaggcaccatggttcatgcctgtaatcccagcactttgggaggctgatgcggacagatcacttcaggccaggagttcgagaccagcctggctaacacggtgaaaccctgtctctactaaaaaatacaaaaattagccaggcatggtggtgggtatctgagtcccagttactcgggaagctgaggcaggagaattgcttgaacccagagacggaggttgcagtgagccgagatcatgccactgcactccagcctggacaacagagcgaaactccgtctcagaaaaaaaaaaaaaaggaatactttacacacggatctggacccatgcataaggcctgggcttttgatatcagatgtgtgagagcactaaaaagaaagacaaggtgcagctacagttattgaaagagttaaagtcgaaagagaaaatgtacttaatatgtacacaggtgtttatttaaaaagcttttttactggtattaagttatatctttacctagacacaaaacagttggaataagtcaatgttttgtttactttaaaaattctatttttctagaaaaggcaatattgaaaggaatgtctgctaagcaggaattagtcaagttattttgaggggggtaacagagagaggagggggctttgagagacagcattccaggcaaaaggaaaagtatgcacagaagcctcgcgggcaagagactgcgtatgctcggggaccctctgggagtttagcttggctggagctggcccagggcagcaagagatgagtctggagcgagggcagtggctggtctcaaagggctttggacaccgggatggggaaactcgagagaaggaaagggcccgaagagaggaattcagttcgtagacatgtggatatgtcaataggtagctgaatagatggttctggagatcaggagacaaagccaacttggaaattatttggaaatcatcagtttatggatagtaattggagacacggaagcagagattgccaggtactgagagagaagagaccagggccaagacaaggccttgagaaatacgcctaaggacgacagaagaaaaggactgagaagtagccagaggctgagtaagaattcatcgtctctgcgtctctattgcagacactgcgctaggcactgtcttttgctgcaaaagatgggtgcaaactgagaatgggggcggggctatgaggaaaacacagagcaggctccagtggagagtggagaccatggatctgtagaggcaccaattggaataataagtgctctttcttcaggaacccaggtgtgagagcagagttggattgagctcgaattggagtttgccgaatggaaagatggaagggtgacggggcaaggggcagaaggatattagcaaaaaggcagttcagccagttgtcttagaactggacttgcaaatcacataggtgattgaattcaactatttggtcggcatccatcacggaccaaagaactgccatctgtcttataagttaaccataatttaaaactgaccttctcaaacttcagcatgcgcagggatcctgctgaaatgcagacctcggctgagcagggctgggcatggcctgaggctttgcatttctcaccggcgcctggctacggatgctgctgtgggtctgaagaccacacttttaaaaaaatatatattttttaattgacaaataaaaattatatatatttatcatgtacaacatggtgttttgaaatatgtatacatttggaatggctaaatcgagctaattaacatgcattacctcacatacttaacattttttgtgtcgagaacacttcaaatctgctctctgagtgattttcaagaatacattgttattaactagagtcaccatgctggacaatacatctcttgaacttattcttctcatctgactgaaactgtgtatcctttgaccaaagctatccttcaacccccagaccactctgaatagtgaggtttgaaaaggtttcactttactttgtggggagctgacctgccctagggtacagcttaccaaccaggtgctggagtgcacagactgttacatctccagaacctctgttagctagctgacactgtgtgacaggttgaaattggccataataggagtttttacattacagaaatccacaaatcaaggctggctacacctatgtaacagtgaggcgtgctatagaataggcttctgtgtcagggatcatgagagcaagttttcagttgctctctgtgcttcattcatactttgataaagaggccatgggtcccaattgctgtgtcacatgtggtgcctgctgcaaagcattaagggaactgacttagctctggtgcatcagaggacctatcagaggcaaacacttggggatacctcatttgtcctataagccacctagagaagtagagttgtgggaagaaagagggggactgagatgttgctataggcaaagagtggcttgctggaaattcttacccacgttgcactgtatttccccaactacctccgggcagtaggctgacctgggcacgggtgtaccagggtgccctttcaaagtcctgggctgcactaccaggctgatgctttacctctagttggaaaatgtgaaaagtgattctcagccatggaaactgggtaacttccataacatctgctttgcttactggcctttaaaatgggagtagttttaggctgggcatggtggctcacgcctgtaatcccagctctctgggaggccgaggcaggcggatcacgaggtcaggagttcaagaccagcctggccaacatggtgaaaccccgtctctatcataaacgcaaaaattagctgggcgtggtagcgggcgcctgtaatcatagctactcaggaggctgaggcaggagaattgcttgaacctgggaggtggaggttgtagtgagccaagattgtgccatagcactccagtctggtgacagagcaagactccgccttaaaaaaaaacaaaaaaagaacaagttttttcttaaaaataaaacatacatcgaatatggtcagagaaaaccaactaaattccttttggtgacagtttggggaggacaatgaaatccctctgctaaaaaaaaaaaaagggagtctcctattttctgacctgtgggtcatgcagttttaatttcctctacctttttttctttctctttttttattctttttaatttcatgaaactgcttaaggccacaaagcctctcctgaatccctcagctgtctggcagatgcattgctgccagggctgtgcaggttactatgccaggctgaagttccacagctgtgactcaatgcaccttcaaatcctcttgccggatgacagtgagatgctccaaggggctcctgagaaggcggtgggagagaagagccacccgggagctcctccaggcctcggaagagggaggctgccggggatgggtccagtggcaccgggctccggtttatgtgagccgaggctggctagggaccccagagatgcaggcaaaagcctgtgccgtaagccacattcctcacttaggcccccttccaggggaagcgaagtcaagccctggtaaatgcttctcatctctgggtccagctgggagaacagtggcatgatgacatgctacccatgtagccaagctccccctcttcctcccttgcacctatcgtttccatcctgttcatttgccagttattacaggagcaccacgggcaggccacacagctagtgctgtggagatgacacgtcttagtgaaggaacggagggaccggcatggggatggatgagggaaacgcctgaccataaacctaaacatctaaagatctggaggagccacggggaagtgggactgtgtgatgatgtcagacatttcaagccctgcctcagtgctctgactctgaatcttgctggtcctgatcagcgcctgccccattgttgtaagtttctccttactggggttctttgcagggaggcatgtggaacgggaacggagcagtgcacagcagagtgacagagtcttgagaggactcaggcaagcaggagagaaaaggcctctagccagagtcagctgcacccaacagaaagttccctctgaaaggagggaagaggcctgctggggcagcctctgtcagcacaaaagcagggctagggcagtcactaacagcacagctatctagaacaaagaagggttttggaaagaagaggcaggctgtattacagctgtactggagatggatgattggtggctttcctgagtgcatgttgtgtgtgtgtgtttgcgtgtgtgcgcacatgaacatgcacttgcctgggccagggctccctcatcatttaaggatgtcttctgattgctctgggatgcaggaagccacccagaccctagttgctggactcgctcagaggcaagaatgcaaggccaaaggcagcatgaggaaaagctggtaggggctgaaaccagcccagcctgcttcatgcttactccgctcaggttggcaggccctactgagacttgccaatctctaagtctccagcgtgtctgaagaggtacaacctgaggactcagtgcctgagcgctgctggaagacgtggggacacccccaaaggaggaaagtgtccttctgggagccacttgcacagtggtgttgatcatggcaatcctgcatgtggtattccacgtgggaggggcagttccactgggagctcccctttacacagggtttcccaacaccagagctcctcagacggatagccactggagtgctaactaaagaaaccaacagcaaaaacaaacatatgcccacaaacgattccagagaagctctgcaccaacaggtgctggtcctgaccaaatcaggctagaagtctgatgacacctttacctgttccggatcccacgacgtcccggctaggtgactcggccatggcgtcggcaagtcgctcccggaggccctcctccgtgtgctccatggaggacatgtgccgcagcccgaagccctcaggccagctcccgcacacctccagcagggtcacgctcctgtcaaaggtacctgtggcacacacgggacatctgacgttgagtccacaccttcagggagcaggccattcttgtctacctcccacccgctcctctccatacccagggtccattgtagccttcctgtaggatggaagcacgccgccaacagactgggtagcgcaggagaaatagctcatgccgctgagagagtgcagacctctggagtgacttccgtgacactgaggctggtggttttacaactgtttctgaggagctacagggttcccctggtcttcagggaccaccttaagaagtgggacggggaaggcaacccccttcccaggttcaacccaaacggatccctactttcctctttttgatacaatgggattccatctacaatttcatttagggcggggagtggtgccttacacctgcaatcccaacactttgagaggccaacgcgggaagattgcttgaggccaggactttgagaccagcctgggcaacagcgcgagaccctgtctctacaaataaataaataaataaataaataaattttcatttaaagaaggggttatatagcctaatgtttttaaagctttcttaaccattatattctataacctataaccaacttcctcattttatagttggagctcagagaagttatggcccaagatggaagagcaagtctgtggcagacgaggtccaagaactcgctctcctgatgcctcagttgagaacacgttctacttcactacctggtctcccagctacccaagggcatatgaacaaccagggaattactttgggggataccagcaaggagctaggaagttgaggagcgaagatgggagatatcagaagtgttcagcaaagaagcacctgatcatttctaccgtcctgagacgtcatagagaggatacaatcagtggtcctgcttatcctgctaggagtcccatcagaggctctgccatacccgctgtctctttcccttccacacctcgtagcctctttgctgaggacagcaaaggtgctcctggaatctccctgtcccagagtgagagcaaggctgcagatttggagatcctggaaattggaaaaaacaaaacaatctgtctaggacggcagagagagctggtctcatccaggtgagtgtcccgaatcctgcttcccagcttggcatcctgtgttatactctttccccagaggagaaatgggtcaggttcttgggtttcacaaacccattaaaggcatgctgtgacagctggcaagctggtagctcctggggaggctgggggaacacgtgctttgcctttgtacaccattgttaaagaggcaaggaagcctagtgactgcaggtggagggggacaggtaggatgctcctctaagctgatagtgtctaatcacactctagctatttaagagactgtggcacagcctccgctttgcgttaatgaggttctgcccaggtttggattttgctgagagcctgctgatcagatttctaaccaccagggaggccagataccaaaagcaaaacctgcattaagcagtgctttgcaagatgtaagccctccttggtgagaggttgtgatgatgacgtctacaataactaagaaatgatcccaggcatgatgaggggaaccagtgtagaggggagcctccttggcaagcttaccaaactgctcaccaaacggagcttaagagtgctgctgcggggagcacccctttctccacactacaagttggttcccataagcacaggctgaggacattagctcttcttggtgcaatggtcaatttcatgtatcaacttgactggactaagggatgcccagatagccagcaaggcttatttctgggtgtgtctggggggtgtttctgggagagattagcattcgagttggtagactgaggaaagaagattgccctcaccattgtgggcaggcatcattcaactgagggcctaaatatattaaaaaggtggaggaaaggcaaatttgttctctctgtcggagttaggacactaattcctgcccttggacactggtactcctggttctcaggcctttgaacttggaccgggacttacaccatcagctcccctggttatataccaccagccttcttggttcttcaccttcagacaacagacagtgggacttcttgacctccatttccaattcccaaaataaatcttcttatatctatgcatctctggagatatctcttttattagttgtttccttagagaaccctggctcatataattagccatcagatgtgtccacagatatattatatataccacagctatattatatattatacctgtggacacatctgatggccaattatatgagccagcgttctcccacagtgagatagatatagatatagatcagatattatattatgttatatattatgtgtatcatatcgcatggtcctgagccagggaaaaggagttcaatggcaattggactaagaatttctttgcaatctaacacagttattttgacaaggagaccattttcacaactgcaaaatatgcaattgcataatgcacactttaaagcttagaacatagattacatctgagtcataactggaattctcccattaacttttctggttactctgggcaagttgctactccgtctgggtcttttctttttttttttttaattctttttctctctcagcagaatcatccctctaggtcttaatttccccatttatgacacagaaaataaataaatgatgcccatttaaggggttcacattggcactaatagtttcaatgtcgttaacaatagtatacttccagaaaatggtgtctgatatttgaggtatcctagggtaaaagctaccaatttcattttctacaaaccagataacagtcagcagttataccataagagtcttgtttttacccaattaaaggcatatgttaagcagaagacctgggttcaaatgccagctcttgttactttctcactgcatgacgttggaagagtcattttccctgtttgaactttgctttccttatccactgcaatgggtagaatggtgttccaccccaccacgccacccaaaagatatgtccagcaggagcctcagaatgtggccttatttggaaatgggtccttgcaaatgtaattaaggatctcaagttgagatcatcctgggtttagggtgggtcctaaatccaatgactggtgtccttaaaagagaaaagaggggatcagagacacagaaggaagaagcccatgtgaagacaaagacagatgtgagttatcctgcctaagccaagtaatgccaggagtggtgagaagccagaagaagcaaggaaggacagcatggccctgctcacaccccgatttcagaatgctagcctccagaaatacaagagaatacatctgttgttttaagtcaccaggtttatggtaattccttaaagcagcctaggaaaataataaacctataaaacagggaaacaaatatttggcttccagagctgttgtgagcatcagaccagatagtattatgaaagactgtattaaacaaaagttggttgggcatagtggctcacacctgtaattccaacactttgggaggccaaggcaggtggatcacctgaggtcagtagtttgagaccagcctgaccaatatggtgaaaccccatctctactaaaaaatataaaaattatccgggtgtggtggcgtgcatctgtagtcccagctacttgggaggctgacaggagatttcttgaacccaggagatggaggttgcagtgagccgaggctgcgccactgcactccagtctgggcgacagagtgagactctgtctcaaaaaaaaaaaaaagaaaagttatgggaggccactgttttgaactgagctcctgcactaggccccacacaccagaccaaaatgaaatggaatcacccatgctaaatgccacacaatcaaactgaaactttaaggaagcagatagatcccaaaacagaccagctattcctgaaaatgggagatttcagtctaactgagtcagggtagcctttaatcctttacaaaaaaagaacctggccaggcgcagtggctcacgcctttaatcccagcacttcgggaggccaaggtgggcggatcacctgaagtcaggagtctgagaccagcctggccaacatggcaaaaccctgtcgctattaaaaatacaaaaattagctgggcatggtggtgcatgcctgtaattccagctactcaggaggctgaagcaggaaaatcacttgaatttggtgggcagagattgcagtgagatccgcggcaccgcactccagcctgggcaacaaagagagagtccgtctcaaaaaaaaaaaacaaaaccttgaagtaacctgatgttaaccaatgagcttttttttttttctattgtttccttgatctcaccttaaaaaacccgctgttctaccactgcccagtgggagctctcattctattttgtagaatggaggctgcccagattcatgaatcacaaataaaagccaattagatctataatgaagtttgttataattttgtcttttgacaagtgctttgtaagctacacaggcccattcaaaattagaggattaccccagggctctgtaagcagctcttctttggggcagtgggattctatgaaaggctaagagagtgactg

SEQ ID NO: 4494 - DNA, 429 bp, Homo sapiens
aggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 4495 - DNA, 379 bp, Homo sapiens
gcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgccctgcctgagttgtgtgcatccaggggcctggtgagcccccaggctggtggcatggcccccctgccccgtgct

SEQ ID NO: 4496 - DNA, 3612 bp, Homo sapiens
gcagtgctccctagacgcctaggtagctgcgcggcccgtccggcagtgtctgatggtaggggcagatggtggagacaggtgggttctaggtgcgttaggaaggtgtatagacctggggctcaggtgtgggaaggggccagcgagtgagagaagctcggcctggggaagaggctctgagaggatgggcatcccaggagtgagagtttcgagatttcttcgggaaagacggggttttgggaaatgtgctgtggtgctgtctgtatgtcacacgatctgcgaggagctgcgagattaaaggggacgtgcgtatatcgagcccctcattcattcgttcagaaaatggttattttttaagcatccagcttccgctgcgtaccgttctaggcgctgagaatcagctctgaacatgacagacaaggctcctgttctcatggagcttaattctggtggagggacgacagacactaaccaaaagagtggctaagaaggaacacacaagcggagactccttctagtgaactcagcctccaactctgtgtaacttaggtctgtccgtgccctctaaccaaatcccaccaggaagacacggatcgttgaacaagctgggtttattactagttgcagtgactgagaacacacattgaggaacgatagggcctctcggtaagagttgttagtgatttgggagagggtttaaggaagtgagagcttcactggattagatactgtcaggaagagagggtcgttccatgattgagcatctcagttcatcttatctagaggaagggaattctagattgaggctaaagctgtgcagataaagaaacagcagcctggccgggcgcagtggctcacgcctgtaatcccagcactttggtaaaccgaggcaggcgaattgcttgagcgcaggagttccagaccagcctgggcaacatggcgaaactcttctctacaaaaaatacaaaaatgaaccgggcctggtggtgcgcgcctgtcatctcagttacttgggaggcagaggtgggacgatcgcttgagcccaggaagtggaggtttcagtgaatggagatcgcaccactccactgtaccctgagtgatagagccagaccttgtctcaaaaacgaaaaaaaaaaaaaaaagtgcagcagcagctccctcatattagccaagtggggatgttgagtcattttttgtggtttggacaatcatcaggttttatctttttatcgtgtttagacctgattatagagtggtcttgtatttgtctggatctatcatggtcacagaatgacctcgtctgatgttgatgttctttggaattgtttttgttctacaggaaaacacaaagcctagctataagggccaggctgtggtctagtaacatcatggcatggctgattgtaccaggccagcttccagatatcagaggctgcttttcactttctcaaagtgtttttgcattctctgcacctataaagtcaaagaggctggatgacctagaaatctttccattaccaaggaccaagttacagtaatttgcatgcattcaggacacagtataagttccctgcaggtagactttgaagtttcatagtccttacctggtgcttttcaccaagggaattgaaagaaaagcaataggaagagcacagaattggaaagttcttaccactgtcatgctatctgaatttcaccaggtccgttccactatggcccttaggacattcattagtaaaacaaagggattagatatgacctctatttcagttacctgttgcaacacaacaaacctccgaagacttagtagcttagaataacaatggtttattatgattttacaattgtgtgggctgacccgggctcagccggggcccacatgcaatcagctgggaactcattcaaaatgacttttcatcttctagggcctctcctccctgtggctttttatcattcaaacgtctgcatagtgacttgagaaaggacaagccccagtgaacaaatgcttatcaaacctctggtatgcaccacacttggtaatgtcccgttggccaaaactagtagtatggccacacccatagtcagtgtgggaaaggattgtacaggggcataaaaacaggcatggggtaggagtcacaagctggatgtgaccctccccccgccgacccggcacatacatatgtttgtcctataccgtcttttttactgtttttaaaatttgatgttcaggttttcaaaatctgaatttccagcttttcttgaaaaattagaatatctgacaattagatctacatggcaacaatatgcaggggttaaatagcaactacctttatttaagcatatattctatggttttccacagttgccatcactcctttttgccttgtatctgcatgcttcactcatttaagttgcatccctaacctgtatagatatttgagtttgcatcccctggcattggaactgtagtggagataaatcaaggtttctgtccttttattaaaatcgtatacctgggagcatagggaggggctaccatctctgtggctgcaccatgatctacaaaaaaaaaaaaagaaaattgtatgctgccttaaaaggaaaaaagtactaatattattaggtcaaattccaggagctcagtggggttaaaagctcatacataggaattagccaagtatgatggctcacgcttgtggctgcaactactcaggaggctgaggtgggaggatcacttgagcctgagaggtcaagggtgcagtgagccatgattgcaccactgtattccagcctgggtgacagaatgaccagcttgggtaccagaccagcttgggtgacagaacaagaccctgtctcaaaacaacaacaataaataaataaataaacactatatatatgataaaagaagtcttatccaagctacgtaagaggcaagctgagccaaggctttatcaccttgctctcacctcttctcaaacaagaactcaggtgctcttattgcttcaggcttgatggcagctgttgattagatttggtcatagacaaaggcagaacaccctgaggcatattttcccaccgtgtttcagatagctcttcactgaggtttgcaagacatgatcataacaaagtggtacaggtcgtgattcccctgaggtccagttcagaacccagaattgcttagattgtacaaaggcacaatggtgcattacataaactgtacaatgtaacactccttctggggtctcaggacagcactccgtaatcaaataccttcttctgcagcagaacatgtatgtgcctgccatcaatttataacctcatagctccaaatctaaccttcttttctatgctttgaaatactggagcaggatcctgtaaatacttctctgccagctggcacagtgtttaactttgtcagtagagagcactagaggaacacagcagaatgaaggggcttctcatcctggttccagtgtactttcttttccttcttgctttgtggcacatggcagcaaatggcttatagaaccatcccttcctccccacacacaaagggggctgggacattcagagggtggtggcttcccggtgagtttagtggcacctcagtaggca

SEQ ID NO: 4497 - DNA, 417 bp, Homo sapiens
gagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaga

SEQ ID NO: 4498 - DNA, 1676 bp, Homo sapiens
gcctctgggaggctgtgtgcacctcagtcaccacagctcacggccgtccccagttgagtcccccttctgaggacaagtttgaaactgggaaggagacaccccctggttccgccagcacctatcccactgatagtgatcccctggcctccccgagcctccttaggcaatggccactggtttgtagacagagagtttcttgcagccttgaaaattttattccctaagtggggacagctctggtattactgcttctttaatttgttccacaaaaattatgctgaaatggacctgaatcagccctgggtgtgcttctgttggcgcctgctgctgaggcccggcctgcccatcggcctgtagtacgccatcgaggtcatcatggagccagccagcttctcttctcatcaaggaggcagagacccctggtggaagccaagagtgaccgaagagggcttgcatcacgtcactccagtggttccctccttgtccaagtcctcgttttaagggcatggcccgttggctccagccgttggcttctgttcagggtccttgctcccatcagaggtgtttgattttgctcctggggctgcgatggagaaccttttgtggcagatggtgctgcctacatctcattggttctctgtacctgtgcccgttgcgcatgttcacagacaggagagtcgccagcaataccttggcagcctttaaatgtgaaacgtctgttacttgcgctggaggcagaggctgtgcagggagcctgcttctaatcgtgggctcccttatctgttacggttccctcccctcctgttctagatgctgattcgttttctcactggctggttaattgctgtctacttaggcctccaaggccataactgtgcaacattttatctgagaaggaaggaaggtcagaaagtgatcactggcaccaccactgtggcattcctgtcacaccaacacagaaattcacagctcatactgttctcacctgggaaacttgggaagggctgatgagtttggggcagatcctgaattgcagccacacttggccttctagaagctgaagttgtgccctcaagtggtcctaagtagaagtccacttgaggtatttgctggcacacaccctcaagggtggttcagaaggtcctgaaacctaaggcaaaaggctgctggggcatgaacagaacagaccgtctcaggggcagccatgtaagtggcaagcagggctggtctccctcaaggtggttcttcattaagtaaagatggcttcgtgactagtgtttagctcccagatttatatttgggttaaaaactaacttttcaatgtggcagtttcaaaggattacttgatgcaaagtatgtttcctttcaaagggatcttgacgtggtaccaggactgagtcatgatttgggcagaggcagttaacactgggaagccctgcccctccctatgcccccttcactccggggaactgaaacctactctgagtctcacatctctaaacctcagtgctgagacctatgcagtgggactaatctcatcaagaattttcagttgaggccgggcgcagtggctcacgcctgtaatcccaacactttgggaggccgaggtgggcggatcacctgaggtcaggagttggagaccagcctggccaacatggtgaaaccccatctctact

SEQ ID NO: 4499 - DNA, 16461 bp, Homo sapiens
actcttacccgctgcagcacgatgatgtcgcggtctgtgagtttgtctccagtcacagggtccaccatgtccttccgaatcagcttctccacgcattcgagggtgaccacagccccactacggtgaggccgaaggcgggagactctgatcaggggccttcctggggacctactggccccaaagccggaccgccccgcaggttcccgagtggtcccttccctcccctcccaggtgactcacgagggccgcagcacagcgcagggggtggcgttgctcaggctgtcgcgggtcacggcacacacgtagcgctcgctgcgggtgatgagccccacgcggtccacggagctgtctagcggtgtgaagtgcacgggcgtcaggtccgacatgcgcaggggcttccctgacatggggcaggtcaccgtgcgggactgcaaggggcagagagaggcgggctcagtaggcagggctggcgcaggtggagagcgcgtggtccctgtgcgtgaggaggacggtggggaaccctggcgccctggcaccgtgcgtgccggggcgctgtgggggctcaccggcttctccagcttggtggccttggcttcgggcgtcagcgacgggatccagaagctgggcagcactttgtccttgtccttacttggaggacccacactgggcccaggttggacatcatctgtgggggaaggaagggactcagatgccgccccctgggcccgcccagcccgcggcgccccgccccccaacccacaagaagcccaacctgagtcacctgggctggtgcccgagagggccttggctgtgaaagggttgaggggccggctcacgatagccgactccttctccaggaagccccgcacatggtcctgcgaggccgcccgctgaagctccttctgctcctcgcgccgggtgccccgctgcttctcgtaggcctgcgtcggggaaagtgggctgagcatctgcccgtggggctgggggtatcttcctcccatttcacaggtaggtaaactgaggcccacaaaggggaccctctgatggaggcactatgtggcagagggtggtaactgccaccctgggtgggtgtgaaccttactgcgttgtatagccagactgccagggctcaaagcccatctctgtcactctgtggcctaagtgagcactatgacctctcctggcctcagtttcttcatctgtaaaacagcctaacagtggttacccacctcagcggctcactgaagggttacataaggtgagtgtttacagcatggagagcctcacctggcactcagctaagcatttaattaatgtcacctgctggccaattaagttttctatacagtgcatgccccagcccgtgtttgggacgggggatgtagacttcagatctaagggaatgctgaggagcccatgtctatggacggacagtgagtgaggacgggagaagtgaagccatgacctgagctcagccctgcctggcgcacagcagttgcctgggcggtgctgcagttccagaccaccctgggccacccagctgagtgaggaggtaacagtgacagtgatggatgctcatgagggcctccgacatgaccaccaggctgtgtggaggacatgggcacagggggagccacctgcttgggacaaaaagcccaataagcatgtgacctgtagtgtttcctgagcgccagcaaccaggcaggggaagagggggacagacccactgtgcctcaaacagggcccctcctacccatcaaatggctttgtccatggaaggccaggccgggttcccagtaacacgccttgagaatgctcatctgcgtgtacctcccaggtgccctgctgtgtcctctgatttggccgtcagcccgttttacagacgatgaaactgaggcccagaaaaaatgaggtgatgtcaattcacgtagcacatctttttttttttttttttttttgaaacagaatctcgctcggttacccaggctgaagtgcagcggtgccatctcagctcactgcgacctctacctcatgggttcaagcgattctcctgcctcagcttcctgagtagctgggattacaggcgcccgccatgcccggctcaatttttttttttatttttttatttttagtacagacagggtttcaccatgttggccaggctggcctctaactgttgacctcaagtgatccgcctgcctcggcctcccaaagtcctgggattacaggtgtgagccaccacccccgacccatttagcatatctttactaaggacctaagctacagggtgggaaaactcgaagtccataagggaaagtgggcatgtgtcagacagccacatgtacagctacaactatgctaagtgctaagagaagaggtgactggggcagatcctggggactggcaggagctcagaggaggcagcatctgggctgaaatcggtgagaaggatttggccggaagcaggggaggggaatggtgtaccaggcagagggaactgagatcagagggctctgagtggctctgcctgtgagctcagactcaaaagctcctgcctccgtgtgccgcctcctccccatccccatcaccttcatctgccgggcaatctccttcttctggtgcagaatgtactccaggatggcctcacgctcatacaggtagccatctgggctgcaaagacagggtgcaatgagaaagaaagaaagtgatcctcccgcctcggcctcccgaagtgctgggattataggcagaagtcatcatgatcagtcccaagttcaattatttgctagaattcacagaactcagcaaagctgttatactcatggtgatagtttactgcagtgaaaggatgcagattaaaatcagcaaaggaaaaaggcacatggggcagaatctagtagagactagatttgagcttccagctgtcctctcccaatagagctgcagggaaagtgcttcattctctcagcaacaatgtgtgccacatattgttgcagccacgagttcgagaccagcctgggcaacaaagtgagctcccctctctacaaaaaacaaacaaaaacgccaggtgtggtagtgcacacccgtggttccagctactcgtgggggctgaggcaggaggatcacctgagcctgggatatcagtgagccaagatgtccccattgcactccagcctgggcaacaaagtgaagactctgtctcaaaaaaaaaaaagaaacctgaaggtggccttgggggccctgatcattaattactgtcttctacaaaatataccactaattgagcacgtatttagtgcctggactcagcacctgttaagcctttgccctaccatcagaggtaggtcatgggaagtgtccaaaggtgagctgctccgatggcctcggcaatgctctgagagccctacaccccattagaagtatgttcctttccatatgttccacactatgaaacagatgctaggatcatgcccatgtcccatgtgagaatacagaggctctgaggataaactgctcatccagggttccctggctgtgcaggtggccagacccacgcacacagcctcctcctggcggttcccttgctctccccacccagacctacccatccctgttcccagctcacgtgacaacaggatcgtggcaaggctgcagggagagacaacagcagtcgaagtccttcacggcatcccggctcagtcgaatgttctgggtcccatagcccgaggccgctggggacagagatgggcagagtgatggaggggcggagcaacaggagacatgtccgtctccaaagccccagagagaggcacagagacaacgcggtggtgggggtgggggactcagagagaaacaggcagttgggagccgctgcctgtgtgctggggccacgggctgaacccacagggagttgtcaaccctggagggtgagaggcagacaggcctggtcactgagtggcagcttggtggaggggctgacggctgactcccctccacccttctgactgtgaccaagctcaagtgcctgtccctctttgggcctcagtttcttcctctggaacatggggtaacaagagcaccctccctgacactctgttgggaggagtgagttcatgcgcagaaggcagagaacacagtgccgggccacatggggtcatgggatcacccagctgttgtttacatggtcatggccatcagtgtatatcgggggcgggagagagacagggacagaggaagcaaaacctggggcacgaggggagagggtgactccaagacacagccatgtcccgcctcttcccaccccagccctgcacctgtgtccttcttcttctcgtggtaggtgtagacggcccctgcggtgcagttcttgccatgccgcgtcatcctagggaggaagggacagtggcaggactgtggttaccggaggcaggcagcacagggaagacctctgcagccctcagagctgatctgccccccttgatgggaaagcggaggcggagaaggggggtgaggtggaagagagggagggcatgtggtcgccaggcctcctccaggaagtcctccttccagactcacctagactcatttatatgtgaaaatagcacctttaacaacaaaactctttgtttggaggtaagagggtgagagaccagagttcaaattctagccactacttcagattagctagggtggtggctgtgccatttaatggaggggaaaaaaaaagacaccaagggggccactattgttgatgaatccactccaccttcccttcccctctcatatctgtaagctctgactgaggccaaggcgtggaccagcccagtgattggctcaaggctgggcacttagctaaggcttgacacttagctaaggcttgacccaatcgctgcctgccagtccactagcgactggatctagcagctgtgattatgtctcagatcgaccgatcagagggcaggtcagagtagggctctgtgtctaggggaagagctacctccactcccactgcaggtaaaggaggaagagaagaccccagaaccctggagctcaattcaaaaagcaaagctttttttattctgtaagttttcaaacacatacaaaaccagaatagtataaggaacccccatgatgtacccatgtcctgcggtccagcagctgtcaacattttgccaccttactttgatacctttgatcattccccatacttaagggcaacccccacccttttaaatgactttattgagacacaattcacataccataaaattaacccttttaaagtggtttcagaccaggtgtagtggctcacgcctgtaatctcagcactttgggaggctgagtcaggtggatcacttgagttcaggagttcaagatcagcctggccaacatggtgaaaccccgtctctactaaaaatacaaaaattagctgggcgtggtggcacacgccagtaatcccaactactcgggaggctgaggcactgagaatcacttgagcccaggaggcaggggttgcagtgagccgacatcatgccactgcactccaacctagacagagcaaggctctgtcacaattaaaaaaaaaaaaaaaaagacattgcctaagccaagataatgcacatttattcctatgttttcttctaggggtttgatcattttaacttttactttttgagttaatttttgtgtatggtgtgaggaagggagccccctacttttctggagttcatttgtaaaaggagaagccctgaacccacagaggctgggcagctttcaccaagactgcttggccagtaaacagcctgcatgcctgtttgtttgtttgttttttgagacggagtttcactcttgttgcccagactggaatgcaatagcatgatcttggctcactgaaacctctgcctcccaagttaaagcgattctcctgcctcagcttcccaaatagcagggattacaggtgcctgccaccacgcctggctaatttttttgtatttttagtagagacggggtttcaccgtgttggccaggctggtcttgagctcctgacctcaggtgatccacctgcctcagcctcccaaagtgctgggattacaggcgtgagtcactgtgcctggcccctgcaggcttttttatcccttaaaatgatttagagccaggctcagggctcacgcctgtaatcccaaaactttgggaggctgaagcaagaggactgttgagcccaggagatggagatgagcctaggcaacacagcaagatccatctctattaaatttaaaaacaaagaagttgatggccaggtgcagtggctgatgcctgtaatcccagcactttgggaagccgaggcgggggcggatcacgagatcaagagatcgagaccatcctggccaacatggtgaaaccctgtctctactaaaaatacaaaaattagctgggtgtgatggcacatgcctgtagtcccagctactcgggaggctgaaacaggagactcattgaacctgggaggtgcaggttgcagggagtggagattgcaccactacactccagcctggtgacagacagagactctgtcaaaagaaaaagaagagaagagagaagatctagtaacattatatacttgtctcactcatctctaagttgccacctaaaaattctcccaagcttaaacagttgcaaaggatacaatttccagcaacgtaaatgtgtagctgatggaatctaaatactgtaataatttgagaccatttgaaaaatgcaagaaaaagctgtttcaacagcagaaaattatacatgtcctgtttttctctttgaacttgtatttccgttccacttccctctctgccacccatttttaatctaacatcgttttttctttttgtttttttttttgagacagggactcactctgttgtccaggctggagtgcagtggtacaatcacagctcactgcagccttgacctcctgggctcaagtgattctcctgcctcagcctctcgagtagctgggactacaggcatgtgccaccacgcccagctaatttttatatttttagtagagatggggttttgccatgttgcccaggttggccttgaactcctggactcaagtgaactcctggcctcccaaagtgttgggattacaggtgtgagccactgcacctggcacatcatatcttttgtgcttgaaaattcttttttttttttttgagatcgagttttgctcttgttgcccaagctggagtgcaatggcacgatctcagctcactacaacctccgcctcttgggttcaagcaattctcctgcctcagcctcctaagtagctgggattacaggtgcatgccaccatacccagctaattttttgtatttttagtagaaacagggttttaccatattggctaggctggccttgaactcctgacctcaggtgatccacccgcctcggcctcccaaagtgctgggattacaggtgtgagccactgtgcccagcctgaaaatacttgctttagtgatcaccctgttatatgtctctgcaagaaataaaaaatatggataggaaatccttttaaacatttcccattgttcctaggctataagagtccaatactcttctagatcagtggttctcaaagtgtgggtcctaggaccctgtggtcccccaacacatttctagacagtctgcaaggtcaaaactgttgtcttaataatactaagacattatttgcctttctgattctcattctctcacaagtacaccagaggctccatgaggtgtgacactgcaacactaaattagtagtaatttgttacaacaatgataggaaactaatatagtcaccagggaaacgcacattaaaacttcactgaaggccgagcaccgtggcttacacctgtaatcccagcactttggaggctgaagcgggcagatcacttgaggtcaggagttcaagtccagcctggccaacatggcaaaaccccatctgtactaaaaatacaaaaagttagctggtcgtggtggtgtgcgcctgtaatcccagctactggggaggctgaggcatgagaatcgcttgaacctgggaggcggaggttgcagtgagccaagatcacgccacggcactctagcctaggggacagagcgagactccatctcaaaaaaaaaaaaaaaaaaaaaaacaaaataaaacttcattgagatacctccccacacgcaccacaagggttgcaattagacagaggggtgcaggcgaggacatggagctactagaaccctcgtgcactgctcaggggagtgcagaccagcacaaccactttggaaagcaactgtcagtatctactgaagccaggcatatgccagtcctatgagccagcaattcgtctcccacgtatacacctaacagaagggtacacctgtttacaagacacatacactgccctattcacaatggctcataaactggaaactaccccatgcctgtcagcacagagtagataaagaaactgggccatatcacataatggaaacacccagcaatgagacacaacagcctactgtcatacccatagtatagctgaatctcacagacaccacgcaggcgagacaccagacacgcaaaagaaaacttactgtatgatcccattcatgtgacgttcaaaaactcacaaagtaattactacaccagaagttatgtgtgggtgggtgtggtggctcacacctgtaatatgaacacttggggaggccaaggcaggaggattgtttgagcccaggagtttgagaccagcctgagcaacatagcaaaaccttgtcactacaaaacatagaaaaattagctgggcatggtggtgcatgcctgtagtcgcagctacttgggagtctgagatggatcacctgagcccagggaggtcaaggctgcagtgagccatgattgggccactgcactccagcctgggagtcagagtgagaccctgtctcaaaaaaaaaaaagtcaggtgcctttgggaggcagaaggtgggggtgactaggaggggcacaggtagcatctgggaggctgggaatgttgtttcttgatctgggtgctggttacatgggtgtgtttgctctgaaagtcgctgggttagacagttatgctttctgtacttctctgtacatgttataaaaagaaattggctgggtgccatggtgcacgcctgtaatctcagcacttcgggaggctgaagctggaagatcacttgagctcaggagtttgagactagtctgggcaacatattgagaccccatctctacaaaaaaatatatatatataaaaatttgctgggtgtggtggcacacgcctgtaatcccagctactcaggaggctgaagcaggaggactgcttgagcctgggaggtgaaggctgcagtgagccaagatggagccactgctctccagcctgggcaatagagtgagaacctgtctcaaaagaaaaaaaaaagaaagaaagaaagaaattaatggcgggggaacccccactccatcttggacatcattccccatcagcccaccaggcacgtccttggtctttatgtggctacagattcatccctgaatgaacacaactcttggatttgacacctgtggacagacatccttgtccactatgacaaagcagtttggtacccaatgtctagcacgtgtccaaggatgtttttcagataaattctttttttctttctttcttttcttcttcttttttttttttgagacagtctcgctctgtcgtccaggctggagtgcagtggcgcaatctcggctcagtgcaacctctgccacccgggttcacgccattctcctgcctcagcctcccgagtagctggcactacaggcgctcgccaccacgcctggctaattttttgtattttttagtgaaaacggggtttcaccgtgttagccaggatggtctcgatctcctgacctcgtgatccgcccacctcggcttcccaaagtgctgggattacaggcgtgagccactgcgcccggccttttctttaagacagggtctcactctgtcatctaggctgaatacagtggtacaatcatagctcgctgcagcctcaaactcctgggctcaagtgatcctcccaccatagcttcccaagtagctgggaatacaggcatgcaccaccatgcccagctaattttttatccaggcagggtcttgctatgttgtccaggttggtcttgaactcctgggctcaagtggtcctcctgctttggcctcccaaagtgctaggatgaagggtatgagctactgcacccaaccctgcttttaagataaattttaaaagtggaataactgattcaaagggtgtgtgcatttaaaatgtggttagaggctgggctgagtgcagcaatgtttacaactaattgatcacaaccagctacagatttctttgttcctttccacttccactccttcacttgaccagccttaaaaatataaatacatatacatacatatatatatatacacacatactattttttttttttttttgagacagagtctcgctgtcgcccaggctggagtgcagcggcatgatcttggctcactgcaacctctgcctcccaggttcaagcaaattctcctgcctcagcctcctgagtagctgggattacaggcgcgcaccaccatgcccagctaattgttgtatttttagtagagatggggtttcgccatgttggccaggctggtcttgaactcctgacctcaggtggtccacctgcctcggcctcccaaagtgctgggattataggcatgagccaccgtgcccagccaaaaaacttttttttttttttttttgagacggagtctcgctctgtctcccaggctggagtgcagtggcgcgatctcggctcactgcaagctccacctcccgggttcacgccattctcctgcctcagcctcccgagtagctgggactacaggcacccgccaccacaccgtataattttttgtatttttagtggaaacgggttttcactgtgttagccaggatggtctcgatctcctgacctcgtgatccgcccgcctcggcctcccaaagtgctgggattacaggcgtgagccaccgtgcccggccccaaaaatttttttgttagaatttactagttgctctccatacagactgcacaggtctatatacctccaacaacatgagagagccactcctcacaactttgccccagggcttcctgggactggctctgagctgtgcctgggtcagcaaggaacctcctgcaccatgctgtggaaaatgtgccatcagtgagagactgggagaagatacttgtaatgcctacaatcaacaagggactaatatcattttcatttttattttatttattttgagacagaatcttgctctgtcgcccaggttggagtgtagtagcatgatctcggctcactgcaacctctctgcctcctgtgttcaagcgattctcctgcctcagcctccccagcagctgagatgataggtgtctgccaccaggcccggctaatttttttgcattttttttttagtagagacagggttcaccacgttggccaggctgatctcgaactcctgacctcaggtaatctggccaccttggcttctcaaagtgctgggattacaggcatgagccaccacacccaaccaacaagggactaatatgtagaatagtcagttctactataaggcatgcattcatagaaatcacagcaatatgcaaaatcctgcagtcaaaaaccacaaggcttacagagaaaacaggattgtgtcacaatcctcgtaaactttgtcggtgatgcttaaagaaaaagataagaacagaatacaaaaggagagaacagtttcacacgggctaggtggttaagacataccaacatactccaaaaatatggcagttgaccttgacaaagacttgaagtttgttgtggcaatgggtgtggggtggagggagcgccttgtgaattactgtgatgtggtggaaagagggttatttgagatctgatggaaagtcctagtaccagatgtggatgggtgtggctcctaacacccggggaactgcggtggtggtatttgtttgaagtgccgtgtatgtgtgctttgtgtattcccacacacacacttatagcagagtgcagtttcctggattcaccttggatgcacataagcaaatgtgaaattggtgttatgctcaaattgttccctgatatatcaactgcattggaataaattcacattttcaaaataagcattatagcagaactgatggtacatgaaactccagcaaatcaagaagaaaattacagccactccaatagaaagatgagtaaaagaggctgggtgccgtggctcatgcctgtaatcccaacactttgggaaaccaaggcaggaagattgcttaaggccaggagttcaagaccagcctgggcaatatagctagaccccatctctaaaaaaaaaaaaaaaatagtttgtttgtttgtttttttttttgagacagagtcttgctctgtcaccaggctggagtgcagtggcgcaatctcggctcactgcaacctccgcctcccaggttcaagcgattctcctgcctcagcctcctgagtagctgggactacaggcctgcaccaccacgcctggctaatttttgtatttttagcagagatgggctttcaccacgttggtcacgatggtctcgaactcctgacctcgtgatctgcccgccttggcctcccagagtgctgggattacaggtgtgagcccactgcgcccggcctgggaggatctttaaatcataatgcttagtgagaaaagagtaaaacaagagctcaataccatgtaggcacaggaaatctactgtgcatacaatgatactttttttttttttttttgagacgttatctcgctctttcacccaggctggagcgcagtggcacaatctcactgcaagctccacctcccaggttcacaccattctcctgcctcagcctcctgagtagctgggactacaggcacctgccaccacacccagctaattttttttattttttttttagtagagatggggtttcaccatgttagccaggatggtcttgatctcctgacctcgtgatctgcccgcctcggccttccaaagtgctgggattacaggtgtgagccaccgtgcctggcctacaatgatacattttaaagaacatttggccgggcacggtggctcacacctgtaatcccagcactttaggaggccgaggtgggcggatcacttgaggtcaggagttttgagaccagcctggccaacatggtgaaaccacgtctctactaaaaatacaaaaattagccgggcgaggtggcaggcgcctgtaatctcagctactcaggaggctgaggcaagagaattgcttgaacccgggaggtggaggttgcagtgagccaagatcgcgccatcgcactccagcctgggggacaagagtgagactttgtctcaaaaaacaaaaacaacaacaacaacaacaaaaaagaacacttgcaggtggggcgaggtggctcatgcctgaggtgagcagatcacctgaggtcaggagttcaagaccagcctggtcaacatggtaaaaccctgtctctaccaaaaatacaaaaatgagccagtcgtggtggccacctgtaatcccagctacttgggaggctgaggcacaagaatcgcttgaacccaggaggcggaggttgcagtgagccgagactgtgccaatgcactccagcctgggtgacagacactcatctcaaaaaataaagaaagaataaaatataaagaactcttgcagacaaaaggctccacatgacacatattagttgcattcaggaaagattgtctcctgctctcaagtagcctgcaagtaggatccagaagttggggtggggagcacaaccaagggtcccaccgatgtaaaaagcaacttcatctctatcgcccccttctggttgctttgaaaaacttgcctttcccattcaaaacttgaaacacaaacctctgggagctatggagctctctctccccctactggcgtcttctcagaagccactctttgggttttaggtatatttacacagaatcaaagcaaagacctttacagttggatgcgatctgacaaatgtatacacccttgtgaccacgaccctatggagatacagaaccttcctatcacgctaaataccccctcacgccccttcccgatcaatgtgccccctgaggcagccagggctgcttgcagaagggcgaccttgatcaaacaccccaacttgacccagggtcccctccacatgccaggctcctcctccgacttccccctgacccccaagcttctcagtgaacgtccaacacctgttgcctcccctcacctgccatccgctccccagcccccacaactgccactcatgaaggtcacggtgaccttttcatggacacattccccactctattcttagttgtcaactcccttgaccctctgcagtatttggctctgggcacctcggctttcccagagatgagcttgcttgctgttttgtggccaagaactgaggtttctacatagatggggacattttccctccaaaaataggaggaacacctatagagggagcatttaaactttttttaatttaatttgttttttttgagatggagtcttgctctgttgccgaagctggagtgcagtggtgtgatctcggctcactgcaacctccacctcctgggttcaagcaattctcctgcctcagactcccaagtagctgagataacaggcgcccacgcccagctaatttttttttttttttttttgtattttttagtagagacagggtttcaccatgttggccaggctagttctgaactcctgatctcaagtgatccgcccacctcagcctcccaaagtgcaaggattacgggcatgaaccactgcacccggcaaactctttgatttttaaaactcagtgatttttaagatcctgagaccagaaagcgtgagcgcctccaaccaagggtggaagaatagccagtttcaggatttacaaactctgaaagctgagctctcctgccccacactatattgtctctttggtaggtccaatttcaaactacaaagcagactgctgccatctgctgtcaccagcatttcagagaggaaacaggcaaagagcaggagcgaccgatgtcagcataatccctacctcacagcacaggaaacaggctcacagcatgtcccagctgggaaatggcagagctgggactcagacccaggcagccaggctctggagccattccttttaactaggtgacaactgtcagttttcctaggaaagtcacaatctcagaaaaaaggccaatcaggctggccacggtggcttaaacctgtaatgccagcactctgggaggctgagacgggtggatcacaaggtcaagatgttgagaccatccaggccaacatggtgaaaccccatctctactaaaaatacaaaaattagctgggtgtgttggtgcgcgcctgtggtcccagctgctcgggaggctgaggcagaagaatcgcttgaacccaggaggtggaggttgcagtgagcccagatcgcaccactgcacttcagcctggcgacagagtgagactctgtctcaaaaaaaaaaaaaaaaaaaagccaatccattcctttatttgtagcctttgaaatccagaatgtattttactctttcagcacatctcagtaatttcagtaattcagatgctaaattttcttttttttttcttttttttttgagatggagtttcgcttttatcacctagggtggagtgcagtggtgtgatctcggctcactgcaaccttcacctccccgattcaagtgattctcctgcctcagccttccaggtagctgggattacaggcacccgccaccatgcctggctaattttttgtatttttagtagagatggggtttcgccatgttgggcaggctggtctcgaactcctgacctcaggtgatccacccgcctcagcctcccaaagtgctaggattacaagcatgagtcactgcacccagccttttttttttttttttttttttgagacagagtctcgctctgttgcccagtctggagtgcaaaatagtgcaatcttggctcactgcaacctccacctccagggctcaagccattctcctgcctcagcctcccaagtaactggaattccaggcgtgtgccaccatgcccagctcatttttgtatttttatatttgtatttttagcacagatggggtttcaccacattggcctggccatcagatgctaaattttcattggagatactttaaaatatatatatatatatggctgggagcagtggctcacgcctgtaatcccagcactttgggagcccaaggcgggcagatcacctgaggtcaggagt

SEQ ID NO: 4500 - DNA, 1907 bp, Homo sapiens
tcttgatacctagaccatcaggaaaattaaggagcacttccagaaaaggagttaactggaagaaatgagaactagaacatctgcagatgccctggtcaactgtggagggccaggctgggaaggatggccattttcaaatgaggacgtagctccattcatcattagctgagaactggtagagttttctgggatctgtgagctcctgacggaagttacaactggcattttgggagctatgcggcggtagtaaggaaagttactggctcctccccttggggaacctatcattaccctggagaaggaggagtggaggcccaaaccagacctggaaaagtccatcccaaactgttctcctccttggtagcctgaagtctgcacacacggcaggcccatcacctcctgcataggcctgacgaagtgggagtctgcaggttcactaaatgggttctctacatgggagccaggggcagaggagggcccacctgcaggcccagcctctggactcaacaaatagggggcctcactctccagcctgcagtcactagtggtgtttggaatattatcatcattgttctgatttgcagtaaagttatttcctctgctcttgttaagaaaattcgaaatactaaaagtggacttatgctctaggttatttgtgacttccaaaatatggatatcacctaccctgtctgtgctagactggggatctgaaaaactccgatcactgctttcagggctgaggtctatcttctcggcactgaccacaactccttccacttccacagactcgctgccttctgcttgtgaggtcacatcgctcacttcatcctgaggctcaggtgagctcaggggctcagatttaaccaccactctcatgtgctccttctcaccaaggccaacctcagggttttcacactgaaaactacttttctcaggtgcagcttcctgatcaaaactagtctcaacctgagttgcacgagaggccatggacaactgtgccatgttgccagcactgttatcagactggctgggcacctgggcatcttcttgagtgccaaaagactgatcaaacatgatcgcactatcttcctggttatcagtcattccatcagctttaggattatccacaattttcagagaatctggtgaaaagaactcctcccgagaatgaacccctgaaggcccattctccggtgtaacatctgaaatggcagactcatctatggagggtcggaggcgctgcctggcccgctcctctgcagactgcttgcgcttatgaaggcgtctcatggggaagggcgtgcgctgatccaggttactgcgcatggaagagctcatgggggctggctgctcctcgccattctggctggaattgagggctgagctcacgatgcttagtcccagctgctgtagcataaaggagcgctgcatgcgggcgctctgctcctgaacgcgctcactggggggagacatgggcagcgtccttgtcgttaagtaatgtttacatgccttaacaacagagttcaaatgcaggtgagaggctgccaataagacatccattacattgctctcccccagcatgagggtggaggtatacatcatgtcaatcagtgcagcaaaggcctctgctgtcaccacctcgctatccagctggatcatgttcatggtctgatctccttctgccactgagaacagggctcggaaatgcgtgctgcatgctgccagcacggagcggtgggctttaaagtgtctattccccactacaatgacacaatcacagagctggccatgaagtctctggtagttcagctgctggaagatttgttcaaagtgaccaggaaaatccatgatcctacagaaaaacaaagaaagaaaatgttaagacctagaaaagcttcaaagtcaga

SEQ ID NO: 4501 - DNA, 3410 bp, Homo sapiens
cgtaagctgaatatgggggtggggtgggggtgggcacagcacaagtggacatgcctttcaggcccaggatggcgcatgcaaaggcccagaggcagaaacatgtttggtatgttgaagagcagaacaaagacaagcatggcaggagggcaggagctaaagcagtggtgtggaaggaggccaagaggcaaggattgtttgtggccagggttgggtgtttgggtcttaagtgttcaggaaaaccattgcagaatcaggcagaaggatgcagtgatggttcctcccatgtggaagatgaatgtagatcccatggcttctgtttgcttcgtgaagtaggagagaaaatctgggagagagagggtcaggataaagtgtataaaaaaaggggtcttttgaaatagtcattttggacagtgggggaaaggaacatcatattaaaaagtgtgatcagtttccaggcagtttgtgggctggaaaattgtgattgtgaagttaaagtgaggccagttagcatggcgtgtgtttcccagcgacactgtgggtgtagacctaaggtcagcggacagctggtgccacccggccatggagaccccagcaagcacagcaggaggggcagcgtgtcagtgccccgatgcagctcagggggtgcaggagtggagagcgggtgaagtcagctgcaggaggggtggtgcctacaggagattcgggagccggagcagttgtggtgacagtgtggctgcaggagtggtggcaggggtcggggagaggaggtcatgggggtggcagggtcgaggggctgagaggaccatcagtcagcctcacagggcgaagtcaccgtgagtggtgatggggaggaagccagtgagccaagggtcctctgtgaatcagggagtgacctggcagttgacaggtgacatgaggacatggcagattaaagtgatctgaacttgagttacggtatttagggaaggaagagaaacagtgtggaagcagcgtgggagcacagggagcttcctcttgtccgggccggaggccaagccctgagagcagccatccctgcagaggggctgccagagagggcctcgggcaggcagccagagccagtcagggcaaggccggggaagggagggtaccacggggcatcacaaaagacgcgggacggacaaaccaggcttcagaggggaggggacggtggctaggggaaaaaggcctgaacagaggaggtagccaacccaggtacgctaggaggcgggggccccagagtactcccctctgcagcgatggtcaggaggcccacgaggtggctgcggggcaggggggctttttctctgccctggcgtggccattagcgggtgggagaagcaggctgagctggggcaccaggcatgaagactcggttgtctggctcagctgctgatggaggagtgccccagaagcagaagtggggctgagggtcccgtgggaagtgccctgtggagcacaggctcctgcccggctcctcgcttgcctccgccctctgctcactggctagctctctgttctcttcattccaggcaccgccacccccacctttggtctgaacacccctgcgcctggagtgggcacatcaggcagcagcctctcctttggggcatcctcagcacccgcccaaggctttgttggtgttgcacctttcggatcggcggccccttcattttccattggtgcgggatccaagaccctaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggaaacacctgtacatagtgtccgctaccctgactcccgcttagcgcacccttaggcaggcgccccttccacctttccccgagagccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccattttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgccctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccagcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagt

SEQ ID NO: 4502 - DNA, 617 bp, Homo sapiens
gcgctgctgtgttttccggcgctttctccgcgccgccaaacccgttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactggtccttcatccccccaatctcccgtacctggcgagtccagctcgtcgcggcctgtacctccccacagagcttcaaaacgggcttttaggaagaaggaatggaggctttgaagcaatgctaagaaaagagtgatatgcaagctgagaccaaaaatatggtatgatttagccatactgaaggggaaggaaataagagctgggcaaagcattctgtgaattggctgactccacttctatggtgagagagaggagtgcatcaaagattactcccagtagagatggtttc

SEQ ID NO: 4503 - DNA, 709 bp, Homo sapiens
gcagaaaataatctacaccaacccataattattctttacgatgatccaccttttataatgtagatgtttaaaataaaaaccaaaggaatgaccaatgagagccacagtccctaggaagaactgtaaatgaagacgaatccacatggcacaggatttctcccaacatcctcaaacgggaatcatccgaaggcatcgattctacagcccaaagcctttgtccacaactcccaggggtcagagcttccttctttcgcgccaggccaaagttgctacgtgggatccgatgttgtcgccagactttcagccaaaatcagccttcaaattaacctggaccgcccaacctccgtgcctttccgttacgccgtctcaagggcaaacattccaccctaactcgccagagggtgaactgcccccagatctaactgaaaacacttgcccttctcaagcctaacgagctgggcctgcagcgcttttctgccaccactgactacgatgacatagcaaagaaaaaaatatacctatgaaatccttcgagatcttcactctcaagatccctgggaagcgcacatacaccaccacatggaagctgacgggaaaggaagagtcggtgttttagcaagaaaagagggtgccctaacggcaggagctacgctagatactggcgcggccgccggtcccgcctttccccgttcttccggcttggtcgccc

SEQ ID NO: 4504 - DNA, 1458 bp, Homo sapiens
cccctttgtgtctctcaagccgggactgatgagttccaaggccagtgaggctgagtcttctgctggtgccccagaggctgtatccaggccccgagaacaccgaggccccgagggactgtgctgtctggctgctcatggaacctccggccggtggcccttgcggtggatgaccagctgcgacttccagtcgaaggcgcggccacagtcactgcagaagtgacgccgctggcctgtgtggctcttgcggtggatgaccagctgcgacttccagctgaagctgcacccgcactcctcacacgggtaactccgggggcctgtgagtgagcgtcgggggtggtgcggaaaggccacctccccttgtggtggcttctctgtgctttccccggtggctagccccggggactgcacacctggcccactcgtgtgtgtccggtggtggatgacgaacactgacttccagtcgaagccgcggccacactgctcgcacgtgtagggcttcctgggggtggcagccggctccagtctcgtctctgcaggtgtgggctgagtgggcactggcggtgtccctgggcgcacagtgggggcaggagtggcagccccagacaagccctcccaggctgccggccctgggccctggggcggctgggcctctgggcagccaggtggaccctcactctcatttcctgggggcaggggcaaaccaggtgagtcccggcactcagcaacccctccctcaggcttgtggccgtggcacaagctcccgtccccccatgagtgggtggctcaggtcccaccgatacaggaggggtgattcaggctggatggtgtggggcactcacccgagcgcaggcttctgcagacgcctgtccccgtgagcagcatccccagctctgactgggcctgtgcctctggctggtggggcggtaaccctgcccgggtggggggcacagttaggcatggggtttgcatgaaggaggggtggggtcggttctggtaggtgacagggtgttcctctggaaggtgggagagctgggtagggctggtagcacagaggccctgcccagctaggcctgctgcagggtgggtgcaggccccagggagaggggcggggtggggctggctggtcctcacccagggagaccactgtgccgtacttctccagcatcgcatcccagtacagttccttctgtgaccggtccagcagcccccactcctcctgcggatgtggcccatcactgtaggcgtctttccaccccttccctgccctgtctggttcacattcttacctattacccggaagagtcagcaggttacctacgcctcatctgcccctcctgctgagaatgatctcaaggtgtgtgtttgttaagtgcagaggttctccttcagatcacctgaccagtgctgctgccagcactcatccccctctactacaccatcctgctcagagggcaggtt

SEQ ID NO: 4505 - DNA, 2162 bp, Homo sapiens
atttcagagccaacaaggaggtattactgagcgccacctggctgcaggtccccaagacaggccagctgcaaatgggcccacctggctccaaggggagagacgaagtaaggtggctgagacgggacctggaactcagccatcctgcagccaggccggaccccgagggacagtgagcctcactccatttcccagcaagcctcctgccggctctgcggatgtgtccctggacaggacgggccctggctgtgacagaaaatgacactgacccattcccagtgtgcctgcgctccctaacagccaagtccagcggaggagaagtggccttcccacggctcgggccgtctcactgcacagcagccggggaaacggatgtcacgggggaaccaaccagctccagccccgggtgaaaatccgcgtgcagtcaggcaagaggtgccgcaggggacatgggcgctcgaggcccaggcaccaccggggccgccctcgccctctcccgccccctgctggctgagtgtcttcaggcttctatcccgctgggcctcaggtgggggtcgtgctgggcatcctcgtggacctggtggccggaggggtgggctccaggcccggactgcccagggcctcctgctccctcagcctcaggcctggctgcctctgggtgagcagtgagcacctctggatcagaacgaagccctctgctgcagaagaggaagggcctgaaccaggagggaacaagggtggaggtgtgctggggaaggccgcacagcacagcgaggactctgtttcctgcagcctcatggcaagaggccagcaaagtcacttctggccgctccccagcctgagtctggggctggcccaacgccgttacctgctgctgggcgaagaagtccttgaccagggagcccatgacctgctgcggggaccgggcggtgctgatgtgggggaggatgaagctgccgtgagtcttctcggcatagcagatccagcctgaggtgacagggggcacacggggctggcgggggcgcacggcggcccccgcacccacaggcagcagcacgacattctgggggcgggcccgctcatacaggagatcatgatgacattaaagagtgctcattcctgttctccccaccaccacgcggagctcggcgtgcaggcgacaccgcctagggacctgaggtgactgcgcgtggctcccacgggagggcagcctcttctccagaaaaggccatttgtgccaacatttccaacccgtcccgcaaaacctgcttgcgtctccaccccccatgcccccgccttgtcatttgtgtccatatcacctcacgtttcaactgcacttgaacttgactctcccaccacccgcaccatgagcacacctgggcaggcagaggccagcaggggcagcgcctgtctgcagtcggcctgtcctcggaatcgccgcacaaactctcgctggctctccaggaggctgaagtgccttgagaaggcggtgtcgaagacgaagtgcacccctggaaggtgaaggtgggtgcctggttaaccccatgcgggacgcccacacgagcacacgccggcgtgtggaccaccatggtgctgccagggcacgtgtgtcgcacctgcttgccgtgccaaagccccggccccaccgtggggacctcctaaagccacgttgcgccaaagccccagccccactgtggggacctcctaaagccacgttgcctcggcatcccctgtgaacccaggccttggtttcccaccccagaggcagccacccagcagctcagtcctccaccctcccagctcttcagcgtggctggtccagggaattgccacgtgcgctgctcccggtgaccctccctagggcacagctggacgcagcctgctggactggcccctcggaccctgactgtgcagacctaccatagtggccacccctcacacacagcaggactcctggaacacgccagccagctccaagcccagccattagaactgctcagtaaacctgcctgatcgtgccctggacccagcagaggcacccgcgtgtgggtccctctctctctgcctgacttgtcattcctccctcgcgtaacccgtggtcggaggactcgctgtgccccacttgcccgtcatcatcatctctaagtaaaaatctttgaacttgc

SEQ ID NO: 4506 - DNA, 883 bp, Homo sapiens
acacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggcagaggagactctaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtatggctagacactttgtacatttttacatacaacttaacgtatggtggaatgagcgactttgctgtgaaagcagtgtgacatgagaaggaaagtgattagtaggtgtctggaactttttaacaagctgctggagaacccagagcatgaataaaagttacacttggcagccaggaactctttcaggagataaaataacagatagatattctccgaaaggatcccaggaaagaggatggcaactgccatttattatgtgaagtgaactggggacttttaactaagccatctaagttaatctcccaatagcactatgcgtaggaagggggtattgttccttttttgcagataaggaatctgaaactcagaaaggtcaagggacgtgcccaaagtcaccctgttggaaacatgagttgagaatggaaccctggtatgcttagttctaaagctcttttctctataccatactgcattccagaatagaattatgtctttcttctcatgttttaggtatctaatgtgatttttcttgcagcaatataacttc

SEQ ID NO: 4507 - DNA, 1608 bp, Homo sapiens
ggcctcgtgcgccgcgctttgaggacttcctaaagccagtccaggagcacagtttttacctgttcagtggcacatatctgtgattgaaactctgtttttgcatctttaaccactgaaggaagaatgcagcagactgctcgacaaacactgcgccaagagctcctcagcagaagctcctcgcatcagatcctctgtgctgggaatcctcccctcttgagcacactctgtgctcctcttccagttacggtgcatgtgaagcaatggtatgggaaaattgtttgcagaaggatgaaaaggctttattgccaaacgtccctctctcagctgtagctccttctgcgtctgcaacctggcttgttcccacgacaaaggaacatcatattttttcaaatcgtttttaaaaaaatacacacatatctgaccatcttcactcagcgcctctgatgtaacaggaagccgggggggcgtccagtctctcagcttgtggttgatacacaaggcgataagatcatcccatgggatctccatgaccgaggggcctgccccatggactggggagggactcttgctcttccacctacagtaggttctgtggagcaggttctccacctgggactggaggacaggctgtgtctggcgtgagctggggatctgggaggcgtactggacaaccatggagcacacggggagccagggggcccccaggggtggaaggtccatctgcggaagctggaacccgagcacagcctgcttcagccaggccaggtgctctggggcattccagtgcaggtgaggaagcagccggctgccccctgcctcagcaaactcagtgacaggccaggacaggtcacacagctgttcagaggacaccacagaagccaggaactgcagcacactgttaaacagctcaatgatggcgccaggctcctgagaagcaagaccgcccagacgcctctctcttctgtcatggaaaaagcggccactaaactcatggccaatcccgtcttcgacgtactgaatgagagtctggcagcagaggtcaagggaatgggggcagtgggaaaccagccactgcactgcttgcaaaaccttagttgaaccttgtagatcattaatggtatcagggatctcggtaacagtgtaatctgaaatcagcttagctgaaaccaagtcctgtagcatcagaccatcttctacttccttctcaacggcgtcccctcctgggctaggcacaagaaccaccagaggaagcgcaggctggaagggcttagcctgcaggagctgcttgagctgcagcaaggccgacagccagtacacgtcctcctctgccatgtcctcactcttcattttggggggaagcagcagcatgagcccactggctcccaggaggtccttctgtgtctccacagcatcaatggcaccatcactgagggcgccatgggccacctttatacacacgttaacagaaatcatctgatcccctttgctgctaagtgagttgaaaagcgaaagcgtctgaatcccaccagcatcgctggatgtgtcatccactgagccttcatctcccatgaacttgacttttaaccaatttgctagaattctacagat

SEQ ID NO: 4508 - DNA, 662 bp, Homo sapiens
ctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggctta

SEQ ID NO: 4509 - DNA, 1029 bp, Homo sapiens
gtgtgtgtgtgtgtgtgtgtgtgtgtgtgcgcgcgcgcgtgcgcgctgaggtggagggagggtgatctggattccaaattgcagtttccaacattaaagttatgctgtaatgcttctgattcataaaatgagctcatagtctcacagtatcctgaatgttgcttcgaatgcaaatgcaggtcccttagtaagaattggggatttcagcctactccaccctagccccggcccagcatgcaatttttcagtcccagagtcaagagttctcatgtgcagaaagaagcaattcctccaacagaatgcggccactggctctgcttcctgccacctgcagtgagtcagggaagaatggagccccaggctgcttctgtactgatgcatgcacgcctgcacacacacaggaagggtgccaatctgggctgaccaaaggaagtgcccaggctagcagatccctagggagatggctccacaactctttcaccctgaggtccccttagggtcaggatgaccgacacatgcactccacaaggccagctacagggcagtgccaggaaactgggttcaccagccccagaatcacccacggtggactgacatttttgaaaccagtgatgcaatctgaggaggttccaggagcagggactcactgggcccaacacatgacaagtacacattttttttgatggagatctttcactaatttgttcaactaacatgcactaagaccaggtgaggtagttcaagactgtaatcccagcactttgggaggccaaagtgggtggatttcttgagcccaagagttcaagaccagcctgggcaacatggcaaaaccccatatctacaaaaatagaaaaattagccaggtgtggtgatgtgtacccgtagtcccagctacttgggaggctgaggtgggaagattgcttgagcccaggaggctgagattgcagcgacctgagatcgcactactgcactccagcctgggcgacagagaaagaccctatctctaacaaccaaaaaaaaaaaaaaaca

SEQ ID NO: 4510 - DNA, 1212 bp, Homo sapiens
cacggaccaatctgaagaaaactgcatttcagggcctgttgaggctaaaactccagttggaggtccagaacatgttctcgtgactcagcaatttccttgtcagaatccattacctgcaaatagtggccaggctcagtgggtcttgtgtccttcaaattcttcgcagcgtgttcctttgcaagcacaaaagcttgtctccagtcacaagccagttcagaatcagaagcagaagcaattgcaggcaaccagtgtacctcatcctgcctccaggccactgaataacacccaaaacagcaagcagtccccgctgtcggcacctgaaaataatcctgaggaggaactggcatcaaaacagaaaaatgaagaatcaaaaagaggcaatgggctttggaagaccttgaaattggtcgccctccgggtaaaggaaagtttggtaatgtttatttggcaagagaaaaacaaagcaagtttattctggctcttagggtgttatttaaagctcagctggagaaagcaggagtggagcatcaactcagaagagaagtagaaatacagtcccacctccaacatcctaatataatcagactgtatggttatttccatgatgccaccagagtctacctaattctggaatatacaccacttgaaacagtcaatacagaacttcagaaactttcaaagtttgatgagcagagaactgctacttatatcacagaattggcaagtgccctgtcttactgtcattcaaaaacagttattcatagagacattaagccagagaacttacttcttggatcagctggagagcttgaaattgcaaattttgggtggtcagaacatgctccatcttccaggaggaccactctctgtggcaccctggactacctgccccccgaaatgattgaaggtcggatgcatgatgagaaggtggatctctggagccttggagttctttgctgtgaatttttagttgggaagcctccttttgaggcaaatacataccaagagacctacaaaagaatatcacgggttgagaattcacattccctgactttgtaacagagggagccagggacctcatttcaagactgttgaagcatgttcccagccagaggccaatgctcagagaagtacttgaatacccctggatcacagcaaattcatcaaaaccatcaaattgccaaaacaaagaatcaactagcaagtattctt

SEQ ID NO: 4511 - DNA, 831 bp, Homo sapiens
tcctcgggcccgggccgcgcccgtgggtgctccggaccggactccgcgggcgcagctgtcccgacgctgagctggggacccgtggggttctcggagaggggcagagacccaagggctgctggtggggtgaggccatcccacgcaactctggggtctgtgaagccaccaaggatcaaggaatggaagagctgcctgagtgtagagggagttcggtcaggcttcttaaacttggagacttggaaacagaaggccttgtaggccacataggttttcagagactcgcctggcagaggcctggagcgtcctgctgcgtggactgtgggcaccgagccaccaggaggttgttgatctcattcttgctcactggtccctgccagactggtggtgcctctctactgtcgggcagccccacctctgtgctgccccatccacctacagccctcatgcctgggcccagctggaggttctgacaggggccccctggggtggcatgcggacccttcagggtgccccaggcgcagcacaggtctccagagacacaggcaccagggcgttcagagctagtcccctcgctgctgttgactgtccttgagcagccccagggccggtttctcaacctcatttgctcacctgagcaatgaagtgaggtgggctcctggaactgcagcagccaccccccggggccatcgtgaggctaagaatccagtgcagggtgagcaaccagcgaccgctacaaggacagtgaagagctagcaccaggaccttgggtagcccacccgctggagggagcgtgtgctgcaaaaagcaagagtgggctttggaggccaacgg

SEQ ID NO: 4512 - DNA, 1267 bp, Homo sapiens
aaaagatttgagaaggcagctacagagatgggaaaggactccttcaagtatgcctgggtcttggataaactgaaagctgagcatgaacatggtatcaccattggtatctccctatgaaaatatgagaacagcaagtattacgtgaccatcactgatgctcaagaagacagagactttatcaataacatgattatagggacatctcaggctgactgtgctgttctgattgttgctgctggtgtcggagaatttaaagctggtatctccaaaaatgggcagacctgtcagcatgcccttctggcttatatgctgaagtgtgaagcaactaattggtgttaacaaaatggattccactgagccaccctacagccaatacagatatgaggaaatcattaaggaagtcagcacttacattaagaaaattggctacaaccccgacacagtagcatttgtgccaacttctggtgggaacagtgacaacatgctgaagccaagtgataacatgccttggttcatgggatagaaagtcacccataaagatggcaatgccaggggaaccatgctactcgaagctctggactgcatcctaccactaactcatccaactgacaaacccttgcatctgtctctccaggatgtctacaaaactggtgatattggtactgtgcctataggccaagtggagactggtgttctcaaacccggaatggtggtcacctttgctccagtcaatgttacaactgaagcagtctgttgaaatgcaccatgaagctttgggtgaagctcttcctgcagacaatgtggacttcaatgtcaagaatgtgtctgtcaaagatgttcatcacggcaacgttgctggtgacagcaaaaatgacccaccaatggaagcagctggcttcactgctcaagtgattatcctgaaccattcaggccaaatcagtgctggctatgccactgtactggattgtcacacagcttacacagcttgcaagtttgctgacctgaaggaaaaagattgatcaccattctagtaagaagctggaagatggccctaaattcttgaagtctggtggtgctgccatagttgatatggttcctgacaagccgatgtatgttgagagcttctaggactatcctcctctgggtcattttgctgctcgtgatatgaaacagagttgccgtgggtgtcatcaaagcagtggacaagaaggctgctggagctggcaaggtcaccaagtctgcccagaaagctcagaaggctaaatga

SEQ ID NO: 4513 - DNA, 12890 bp, Homo sapiens
agtgaggctcagcatggggcacagagaggaacagtcacccctcctctcccagcagcctgcccagggcacctgcaccctgcattctaagagggacacaaggcgctgctggcggtgtgtctgcaggacccacaagaatgcctgctggtgacgtttcagcaggactctccagcaaccccactcctgagcacgtgacgaacataagccatcttcatatgccaccagaagacgagcctcgggagcagttttagttctaagagctccaagctgaaagccgactgcctgtcatccttgaccacctgtccacaaggaagaaggggtacattttcctagattcacacaactgaatgctacacacccgtgaaaaagaacaagttacaggtccaggcaacaatgaggatgaacctcacaaacataacatgaagcagaaggaggcagacatgaaagagtacagactgcagcattccactcataggaagtccaagcatgggcaacgaatccatgcggctagaggtgagagtcacggttacctaaagggggacaatgtgggacaggggatggggagctgtctgggagccagaaagggtccatcccttaacctagaggatgactacccctatgggcatgtacagatctgccaaactgtacactgaagatttgtatacttagtaagtgtaaatcatacctcaatttaaaaatatccctggggcaggggaccacccacccaccaaactgtccacagaaccagcaagcagggccagggttggagacacttgtctgggaggtgggaggaggggaaagccatcgccctggagtttggtgactggctgtgtgagcatgttacttgctgcccctgcctcggtctccccctctgcagacaaggctgctgcccagttacagaagtcactgggacccgtgacgctgaacaccaggctttttgcacagagcttaggatgacacggcccttgtgaaacaaaccctgggcagagaggaaagctcatgtgtcgggaggcagaggggcctgagtgggtgcttcttgttgggaggcagaggggcctgagtgggtgcttctcgttgggaggcagaggggcctaagtgggctcttcctcagggcattccttgggaagaggaacaacacttccaggacagcgccacatgtggcaggggctcgtcttgttgcgggggaaactgaggaagacagaatgtgctctgtgactgtgtgtccctccctggtggcctctgtcgctcccatgcttctcttctcaggggtctctgtagtgatcattctgcactattcaagattcaaaggagttgccccatcaagcgtgagtgatggcggcaagtgaagtccttgtggtcagaggggtgtcccttagggggatcgagtgcccattcagtgcccgtgataccagaggggtgtcctcgtgagctggaacctgagagaggccaggggtctggagggcagtgcacaaagctggctccaggtcagggcacagaacgctgggcagggagccaccccagtgcccaggcaggcagcagccggaagtcctgccccccctcttcaggagggagtggccaacaaggctggccactttcaaaaggccagggcttttgaatcggagctagacaccctgatttacagctggcagcacgtgggccacgtcactgagtcccggcatgtcacacgtgatgcagctgctccacggtcacgtgactctgccgtcatcactgggctgttctgctataattaaacactgtccccaaaaactagccaagggctctactttacaatgcaaagtcatcatctgcccagcagctcccttggcagagctggtcctccctggaggcgccatgctgacctcctggcatctcaggaagagagtgctttcatttgctccccaactgcttgggtccccctggctgctcctgcttgtgttttaagttctccacccaaggtggacgtgaggggctgggagtgtgatcgtgagacccagggcgggtgcctgcagcccttcctctctgtatcaagctggtatctgtggcctttctctgttcacccgccgccttgttgaacacttctccttggcaccttcagaagccaggtgtttctgcccacctttccctgctgcctcccatggaagtcaatctggccacgcccaaagggcctaagcatcgccactacaattcacctctgactgaagaaagccacagctagggcaggaatacaggacattccccggctgagggagaatcatgtgcagggagaagctgaagtttctaacattaacctggtgcagaagaaaggaaaaagagattctgcaggccgccgcttaaaacagaattttatatcctttgtgatttaatatttctggggaggaaccacctgtggaaaacatatccgattagaaatgttccctttttttcataaataagcagaaaagttttcctagttttgttatgtaatgagtgggggtctcacatcctggttagggatataggcttcggcagcagacaggcctaagctgggatcttggtgcctctctgtggcttctggccttggtgacatcacttacactccctggccatcagttatggagttggcatgacaatgcctgtgtcccagcattactataaagatggaccataatcggagtgtgcctctctggccctccgcccctgggaagggtccaggaaagggccactgtgagtccgggcgcctctctggcccttctccttgatgttggaaaggtcaccttcacccgcaccccgcagacctgttggaaggctgctgccaaagccatcgagatttcatattactccagcacaaagagttctgaggatatttacataaccacaggttttcaacaacattgctatatttcagtatttctatgagttttatcccccaaacgtggcgttccagagacaatgcaaacttaattaggttaagatgaactggtaagcaaacccctcgccaggtgagcaaattctcaccaaagcacttcagggaagcaccctcacctctgcatagccacaccatccctgcggaaatacttggggagggggtcaagtcctttgggaaacgtctgctttcataaaagcagctttctttacacctttttacacaagtgcctttcaacaagttacatacaaaatcaacctgtgacatcaggtagatattaaaaactgatcaggcaaaagcctctgcagcaactgaactccacacttatgtgaggcgggaggctgagtgggccctgtgaagacgcgggcgtcacggctgctaaagcgtccatgcaacacacagaacagcaacaaaaataaacagcagatgccatcgcgggtggagggtgggggtgggagaagaaaggtgccaatcttctggaagaacacagaaaaccgccaggagtcacagcgcgacgagtgtgcggggaaggcggcggggccgggagtcacagcgcgacgagtgtgcggggaaggcggtggggctgggagctggcaatgtcttctgtctacagactccctcgccacatccagccctccccacccctcccactggcagcgagaggaaatcccgtccggggagcagcaggcagctgcggtgggaatttcatgacactagaaaagactggactcctccctcatcctacacctgcagagccccacgcagtcatttaggcacaaacattcactgtattcgcctgcattccatgaaggctccgttctttccatgctgaatttgagccacttcgcagacagaagtggccctgggttctcagccccacctaagttgcctaagactacagccacgcgacacattctctgcagcaggtacgtggcctccaatagaggagattatcaggcagtctggagggtgcaggagccactgaaaggcaacagtgagaggacaggacaggagcaggggattcaggcctcactgaatccccctggaggacagtggggttaggccagtttcactccaccttcagccaacacagagggggtgtgtgtgtgtgtgtgtgtgtgtgtgtgtgtgtgtgtgtgtgtgtgtgtgtgtgtgtgtatcatctgcatttgacgatctgtctagtcaactttacgtggctcattaggctgtgtgggtgcactgattctaaccagtccttcacattccttttataaggctacaagaattctccaaagcattatctaagtcctggaagagcaattacagttttggtaccaaaagtaggagcgaccagccaggctctcccccacagacaacagcacctgcccacggccagcctcctgcgatgagtcacaggtgccacgtgaaatgcattatacacactcagggacagacacgcaaatgctccactcatgaaggatacagaaatagatggaggagcttcttggtcattgtttacttctcaaaaatggaatcattctatacatccttatgcacatgttaacttcttactcaaagtacctcctggaaatgtttctgagtcaactggtttgcctgtgatgaattcttttagggacctgcacatttcataatacggacttgtgataatttattcaaacttttacctacttattaggttcccttgatatccagcattgtttttttttcctttttgctttttttggtcactacaaagctgccataaagatgcttatgaagatattcctaagtaaggtgcttttatttttagggtgaaattcccagaagtatgtctgaaggctgtagtgttttttatttcactgggtgtcaccaaaaggcgctaacgcttgacatcccatcaagaacgcatgaaaactcctctcccctcacgaccagtgaatagcgcttactgccctgggcaatgctgtgccagccactgagcacagtgttgccttaatttgcatatggaataccggcagactcgaacaccattcacatatttcctggcgatctgaattccgtgtctgtaaactgcttgttcatcccccttgcccgttgtttctttgggtttcctaacttcacactcactcctacgataaacataattttcttcttggatttgtactttttgtattttacattcatgtctttaatccatttattttattttacttttttgagatggagtctcactcatgtcacccaggctggagtgcggtggtgtggtctcggctcactgcaacattcgcctcccaggttcaagcgattctcatgcgtcagtctcccaagtagctgggattacaggtgcccgccaccatgcccagctcacttttgtacatttagtagagatggtcaggctggtctcgaactgctgacctcaggtaatccacctgcctcggcctcccaaagtgctgggattacaggtgtgagccacagtgcccgggccatttgtttttataaaatagggattcaacatttatttcttcctgacgaataaccagttgtgccgacaccatttattaaatttattaaataagctctgtcaaatattccatattttctaatctattctactgacttttttgtctattctcatgtaatatcataatttgattatggtattaaaatatgttaatcttttgcatattttcatatcataaaatgttatctttacacttttcttgataattcctggacattctttcatacaaactttaagattattttattcaattaaaaaaaaccctgctaagattttcactggagttgcattttatttaaatattaacactgggagaattggaactttccaaataacaagtttcccacccatagtacatacttccagcttttcagactttgttttctgtctgccactgaggattattttatttcatttttttttagatggagtttcactttgtcgcccaggctggagggcaatggtgcgctctcggctcactgcaaacttcgcctcccggattcaagctattctcctgcctcagcctccccagtagctgggattacaggcgcctgtcaccatgcctggttaattttttttgtatttttagtatagatagggtttcactatgttggccagtttggtcttgaactcctgacctcaggtgatccgcccacctcggcctcccaaagtgctgggattacaggcgtgagccactgcgcctagccagttttctccttttaagtcctgtgtgtccagagaggggtgggcacactcacattcaaatcaatgctgccatccccctggctccagggacccctgcagtttaagcttctccgggaagcctctgctttcaggtttcttttctggcccagtccaggtgaaaagagctcgcactaagatctctgctgggagtcagactcacctgtctaccagcttgggcagacgcttgccttgagtcctgaggctaggccacagctggagcagcagatagaagggacagggttgcacttataacaccactatcctcccagccctggttttatcatcatcatcgagaaaaatacaattaatcagcagtgatcaaaggtaagtctaaacattccatttaactaacttaaatgtgacctggtgtgccgtgtcattctataaatgacataacagaataagactcactttctaattcacagcctctggttcaatttcaagtaagcaaatacattttgctttggttttgcttacaatattctgggaaatgcaggctataaataatcactcaactgttttgtgggtcaacagaatcactactactttcagtttcgttgatgccatttatatcatgagctcaagcacacgggcgcttcagaaggcactataaagtttagttttgatgtggtgtgatgttctgatctatcttgaaaggtaaagaaacccacaggattcagcgtcaagccaatccatgcccaggcacatcgcagctgctaggtcaggaaatctgtgcgtttaggaggctctgagggtgatgctgggactgtactcaggtaattaaacccggacaaaccctgaggcacagagaggatgagtaggggccctggaggcagcctgacccacagggaattctcgagtgtgtggcagccctgcctggggaacgaagacccgagcctcaatttcctcacaggggcactcgcagggttgctgtgaggatcacaggggtaatgtatgtggcagtttgtcataccccagggctctgtaagcggcagttatttatattgttacttatgacactgaactaagagctgaccctgacgccgcctcctcagaagccctaagtcttgagtggcctggacaccactacacacgagagtcaggggcgggggctttgagatggaccaccaggaaagccgggagagggaccgggacagggctcccacttgctcctggctcacaggggccctcatagtcatcaggtggaccccaacagctgtggcctgacaaagattcccccaaaggccagcccaccttacacgctacatctgccccaacagccccccagcccaacaggtggtgccttcatggagatgcccatccctgcacgtagcactcaaggcagttctcccacctgtaaagctgtttttcttcccctacaatccacacccaacctttctaggtcaatcctgaaaccccacacaagctccccaactacaccagatccttcaactccaacacgctcaccaagtctcttcaatagtcacttccatctttataatttaccattttcttgagctgtttgtatatttctctaaccagaaagacaagaagtagtagtattcagatttataatgactggttactggtactgatttgagagtttcttgtcaagcggatgagtgtttaaggcccaccacctcttttcatattcttctctcttaaaaaccacattttcaaaggtctgcaaacgttttccacagtcaacaacttgagaggcatggaagtttcttgcttatcaggggccaagggggaattttagaatcttttgggtaaatgaatgtttaacatcccctgaaagctgctggagagtggggaacctaggaccgtcacaaaacagccagcctctgcattgcctctgccgaccagggctgcagagggcagccacccagggctcagccaccggcaggagtggaggaagcacagctccaaaggtcacagaattgcagtcctggagctgggtccctgccaactcccggagagtgagcgaggggccactgggctgtgaatgcactgtctctggcagtggatgatttcctcgttcttctacgatagagactctaatgcctctcaggcccctgatggtctacaggccgggtgacgtaatcccaatgagggtaagaaaattattcctgcttttctccaggttataactggtgattatgtaggcttgtctgctttaatcttcttttctcaaagtctagtagaacacctgcttaacaacttcctgcccacccatcactcagacaaaaatgcagcgttccaagaacaatggagagccacctccgcagccagacctagggttggatcgcacgaagagctggaatttggggaaccacttaagactggatacatttggaaggaacagtcacacaagataaaataaatatttagctaagctttcaaattctggaaatgtcaactaataaaactaaaagtctactacctctgaaagtataaatccaaaaaacatttaaaagactttaattttagcaaagggaaaccgaaaagccaaagcagcagaataacttgtttctacataatctgtttccccatgtacctgctaccatccccatcctctgccccacaagcttttcaagtgacgaactcctcacagagacgacaggcagtgctttccatgattcttaccttaactatgctgataggctttcgagataagtgaaaacttgcatacagcagaaatgtcaaaataaaaatgaaggctctgtacctgaaacacaaaacagtgggagaggatgatatgaaataacagaagttatgttaggaatacatatcactgtgttctgaaacgttcttatgctgtgtattattcattcagttctacagccattatcaatattacttatgtcactataatattggaacattaaaaaatattgccacgtttgctttgtccaaatggaaactgaacactgtaagagacaggaaaaaccagactgcttttcctaccctcatgcacaacacacaacataccatacttctaacactacgtgtgtaggggttttccccatataccaagcaattctccagctgacactggatgtcctctaagtgaattcaattctcacactgtcttccaggagtcagcatcagcccccacagggcggggctccggccgaggctgccccgcttcacatgccaatggcaacaagccccaggttgtgacctgctcctctgaccaactggctctcagggtggttcccaagaaccccttctcaggttcgattaatttgccagagcagctcgtagaactcagggaaacacatttactgctttattataaacgatgttacaaagaatacatacagatgaagagatgcacagggcgaggtatggggcagggagctcggagctgctgtgccctcgccagggctccaccctccgggaacctccccgtgctcagcagcctgcaagcccccaaacgctgtcgttgagggagtctgtggaggcctcattacacaggcacgatcgagcagaacaccggccactggtgatccactccacctctgcgggctccctcccctccccagaggtccacgggtggagtcccaacctctaatcacgtggtcggttgccctggcaaccagtcccccaggaggttgtcctggggcccgccacagtcacctcattagcaaacaaaaagacactcagcactaaaggttgtaggagctgtgtgcccagaaccagggccagagaccaaaagcatgtttcttattattacgtcacaatatcaaaagcattcatctatttaaagaaaccgtaaccaaagggaaacctgggactcgagatgcacacttgagtttacaaagcagaacaagcacgatgaaatgtttagtttacaacaaaactaaccacaagtttctggcgtagcctgctatcctgggcaattaagatcatatttatttttggctctttggtttctatgcaacttttcagaagcacacaagcaaggcagacatataaatatttcacggccctcaaagagaaaaaggcagtgacgctggcaggctctcaataggccagtgacagaaacactggtacaaagcccctcgctcagtttggctgggagaaaagcagccgaaagagtcagcatgagtgtgaggaagaaagaagaaaagaaggtgccttagaaagaagacaaagggcaactccagtctaagagtctcaaccaccgcatagaaaaatactttttggggcaacaaaatgggttgggagaaagaagtatttgacaggagtggaaggcgaggggcagctcttctgtgtcctaggcacatctccctaccctggagaacctgtcctgcttgtggcctgggaagagacttcaaatggcgccaccaacaacctgaatcaataattacctaaggcggcgtcctacacaggacaaagaaaggcagcgtttccgagagtccctgggataaggggttgcttctcccagctgcgcatctacatttttaatgttgtgatttactccgagggaagctttccacaagtaactaaaatcctaggatcccagagctgccttcttctctggtcaccagctaaagtaggggtcaaataaatatttccagatttttcttaaaaaaaaaaaggccatatttcaggtgggaaagaaaggttggtggctccgtgtgacacaaaactacaacctttggaatgcctgtgcctttggggaaggaaccaaaccaaaccaactcgcagaatacctgctgactgaagacagaaattccccagtgctctcttcttcatcagggaactatcttccaatggcctttctccaattcttcctctccaagcccatggcaagggccaaatgggaaaaaagcgaaaccctaaaaggcgagcctatcatttatcccaaagcccaaagaacaaaggctatgtgggtacagtggatttgctccagaagccccggcctctgtcctcgtgtttctgaaaaccatcctttctggcaaggaaagaaagtctcagcgctttggatgaagctctctgttaggccaccactgcttctcacgccttcgactgctggtgcaggaagattccaggccactgggcttcaccggccctcaatgctcacttgtccagcccacagcttgacaaactggtcacttccaccccacctgctggagctgactagggcaagtaaggctgatgggtgaccctgatcggccctcactggagtacagggtttccttctccaatctcctcaaaacaggtgaacaaagttctcaggccaagttgcctccagcacctccccagtctcagacaagtccatggaccatctctcctgctccatgcaggaggattctccaaccacagtgccagttctacaggtgttatcacccagctaggaaggattttgagaagagcagctctgtcctatgggctgtgggttcacatctccactctccacccagacagcccagaaggaaggctgtctccctttgtcgggctgaggtctgaagagtgctgaggccccgacacacaccgcgttcccaatggtcagggctgcttgggtgatcaggccctggtgatgcgttctgggctcctgccttcctctgcggggtgactcccggctggtgctcacagcacacgcctagagatgccctgagaacactgaggagcacacaaggggcagcacatgcctctggaacctttagttcagccttgtgtggagggagacaccttaatgaatgagaccctttgggaagagtcactgccacggtgtagccaggctgacagaagccgtcctgtagaattgggtgaagggtccatttacacagcaaactggaatgttcctaaagactgaagaggaaaacgctgtatttatttagctggtgtcaggccaactctacttctatttccaaattcgtctttcctctctcatttcttcatcttctgtacttaggacttggggcttggggatgggggacgcagtggctggaggctagactttcctctttgaaaggtctgacttcagctcccgtgactattgctaaaccgcggcagccacactcgggccgctgccttgctggttgtcaccccgatacgcctggcctctgggtaggcagacgcttcactctgcagcatggatgggctcaaacccccagaagccaaacagccctcccgaagtcctttcttatttcgtaattctatctacgttttctttatcatttataaagcagatgttttggatgatatgtttccttttgttcattttgtactgggttgaatatcatcccccataatttcatgtccacccaaaacctcagaacgtgaccttatttggaaatagggtcatgtagacatgattagctcaggtgaggtcatattagatagagtgagccctcattccaatgactggcgtcctcaccagaaggccacgcaaagactcagagacaggaagggaggccacgtggccacacaggcagagactggtgtgatgcagccaccagccaagaacggcggcagcagcaggagctggaagaggcaaggaagggtctgtccccggagcctgcagaggaagtgtggccctgctgacactttgactttggacttctgacctccagggatgtgagagggtaaattcctgttgtttcaagacacccagcttgtggtaccatgttacagcagccccaggaggctaatataatcctttcatttttgttttgtgttatgtttagacttatgaatataaaacaaatacaataaaaaaataaatgatct

SEQ ID NO: 4514 - DNA, 7675 bp, Homo sapiens
agacgcggggtcagcggctcagagcgcggctgtgtggggctgcggggctcccgccatgcccgctggggtaggtcctgcggaccccggccactggagccactcatcatttccgacggatgggccggaggggccgccggccgccccagccagggtctcggtagcctgcaaggagagaaagagggcgcggaattggaagcagtcgtcacccggaggcctgggcgtgcaagcaccgaagctctggctggccctgagcctccccaccccacccgctcttttcgctggaacgcgtgtactttgggcagttgctgacgtggagacaggacgtatgtcttcatattttagtaaaacccaatgccctctgcctctctgattatgttctttaagttatcgccagttccaatttgtatttcttggaaacggttgggtcttccctcacttttcagtattttcatgtagactcaaatactctggattaatatttgtatttgcccaaaccatcacgagcacctcttaccctgatgggcaatacttcagtgtgctgcgttctggccacagagcaaacagggtgctcccaggcactgccctctcggatttcttgccttgttatttaatcattaagatcgtgacctatgagcaggactgtttccagccagcacatacacatgtcctctcctggccagcatccatgctgattagacggtgcccctgccatactagctgcctaatatttcagataccccaccccgtgtgtgtgtgtaaatcatgtcactgccctctttgtagctaatgacaaaattccaagagtcaccattagcctagcacattatgcctgtctcatttctgcccactttggagcactcggcttctctgctgttttcctccagagcacactgaaacactgccatagcacagcagggcatagaagacaggctcatgctcccctggacgctcaggccttcacctcgggcacactaggtcttgtcattccatgtcaagaatagctcttcactgccctcacccacccaagaatggctaaaattaaaaggactgacaatacctagtttgtcgaggatgtcacagctggaaccctcatacatggctcatgaaattgataaaaccacattggcaaactggtagtatttacaaaacctaaacatatgaatacctgatgaccaactaattcctcaactcacccaagagaaatgagagcttatgtgtaccagaagacatgaacaaaactacccacagcagctttcttcctgatggccccaaactggaaatgatccagatgtccatccataggaaaaaaagattttaaaaagaaagtatggcatgttcacagagaggaaattctgtacaacaatggaaatgggcacacaaccacaacccacaacaatgtggatgaagtgtacaatgaagtcagaccccagaatgtacagacaattccatgtgtgtgatgttcaaaaccaggaaagcaaatccatcatgacacaggctggggatgtgaaggaaactccagccaccctgcccctgtgctctgagtaacaaggcctagatcccaatccttgctctgcctcttatcagagacaggtatcagacaagttgcctaacttttctgagcttcagttttatgtctaaaataatgataaccatagaaccaatcccaaggaagtttcagaagatcaaatatgaaagagcatgaaaggtgctcaaaaaccagggactgtcatggtagctcacatctgtaatcccagcactttgggaggccaaggtgggaagatctcttgagcccaggagtttgagaccagccttggcaacgtagtgagacctcatctctgcaaaaaatttaaaaattaggcatggtggcacatgcctgtggtcccagctacttgggagtttgaggtgggaggatcacttaagcccagggggttgaggatgtaatgagccatgattccatccagcccgggtgacagggccagaccctgtctcaaggaaaaaaaaaaaaaaagccagacagagtccagcacacgtcagtttgtgacgtgagtgtgcttcaggctggaagtttggccactaccactgcctgttttaggcttttgtttccaaagcccccaagtagagggaaagaggagcagaatgagatctttgtgaacccaaggtaatgggtacccaagccaaacccacagaacctccttgatcccagggagagagttgcaggttcctcccagatcacacctccccaggcagcctatacccagacagaagcagggttcctgggcacagttgtgtggtttcttcactaatcaagggtcccttgccaagaacacaagtgaggcttgcatttatcctgtgctcagctaaccaagtcatgcaccccagcctgggccttagcctgctccaaagcagcgccatatgtgaacttacacaggagcaccctgggctagtggtggccctgcagagaggcctgacacctgagcagcagaagctaccaccagaccagaggggaccatcaacctggctagacagggcagagaagcagtgggccactgaggcaaacagcctcactttcacctgctaatggctccttccaactgcgagagttgcttgacccatgtgtggggacagccatcagcagtgacagggtggggtgaatgttccagccactccactctgcagtcaggacaacttcaggacatgttctgcactggctcctggcatcccccgcaggatggctccagccgcctgtgtcctgaccttcttggtcatgcctgtagttccgcctcctgttgttcgaggccatcctgactaacacggtgaaaccccgtctctactgaaaatacaaaaaattagccgggcatggtggtgcatgcctgtagtcccagctactggggaggctgaggcaggagaatcacttgaacccgggaggcagaggttgcagtgggctgagatcaggccactgcattccagcctgggcaacagagcgagaccccgtctcaaaaaaagaacactgagtacaccgtaagggatggcgaggatgtggcacagggggactccttcatccgctctggaaaatgtggcagtttctcctctgatgcaacatgtgcttaacatgtgacacagcagtcccacttttaggtatttaaaggaatgaaaacttatgtccacacaaaaaatcacacagatgtttatagtgattttattgataaagtgtccaactggaaactgcaagtattctttctggggacacagatacattgtggtgcctccaccctgtgaatcctgctcagcaatccgagggatgagcggttgattcaggcaacaccgcggatggatctcagggcatcgtgctgaagtcccacattctagcaaggtgctgcttcctgcagatgggcaaacactggtccttggcaggtagggggaaacacatcttgcctttttttggagacagggtgtcccactgtcacccaggctggagtgcaggggtgtgatagtggctcactgcagcctcaacctcctgggctcaagcaatcctcctgcctcctcctgagtagctggaactgtcttcctctcttgaagtaggaagcacaggtatacacacagtacacaaacagtatgtctgtggtggtagaatttcacgagggtattggaaaaacgtctgatgaggctccttggaggagcaataattgtgcattattagaggagcaataatgcacaaaggctgagccgcaccctgccaaaggagaaaggcagacagactccctgctgggagagcccactccccagacgttctggttgaggctgaactacggggtggagagcagatcaggggcgccaggggctggagatctggggaggcagagactgcagcgtcagcatgaagggattttgatgggggctggagcactccatgtcctgatggtgcttatttacaaccatctgtcatctcagaactgcacacacggtaaaatttcactataaatagcttacacctcaaaaacctaaccaaaccctttttattttttttaatttcttttttttcggggcggggggtgggggaatggaatctctcattatcgcccagaccggagtgcagtggtgcgatctctactcactgcaacctctgcttcccggattcaagtgatcctcctgcctcagcctcccacgtagctgggataacaggcaccccccatcaccaccaccaccacacccagctatttatctttttgagacaacgtctcattttgtcgcgcaggctggagtgcagtggcacaatctcggctgactgcaacctctgcctctcaggtttaagcaattctcccacctcagtctcccgagtagctgggattacaggcgtgcaccaccacactcggctaatttttgtattttttggtagagacagagcttcaccatgttggccaggctggtcttaaactcctgacctcaagtgatccccctgcctcggcctcccaaaatgctgggattacaggggtgaggcactgctccagcccaaatgctttttaaaaggaaggaaaaagaaggacagctcaaccctttctcactaaagggcaaaggactgctagctgggcatgtaaaagtgtgcattttcctgaagtgtgttctctggaatcctcttccccagagatgttgaaacggaggtgctttgtttagtgcagtggcggcagatgacagccacaggacagctgctctgggggccttggaaactacaaatgctcaaaccccctccccaggccacatctcagcgtgcgggaactggggtgtgcatctctcccaacagcttcctggtgacgccaagcttcacacccacccaatccatgggagcaaaccgactggactgcatggcagacggtggcccactggccattgcctctttgctttgctcaggaactgggtggaatgtgcccggggaaggtagccccagaactgcaggggagccacgacagactcaagcctcacggaaacccctttccctgggccagagttggttcctgggtggcgtggggctggctctggccagtgaggagtcagcccctgctgaggtttctgggaattatgtgtctcccaggaggagaggaagacagctgaggacacagcatctcactagcccctcctcacccaccaggtgccaggccaggtgtcacctgagccaagcagcacacgaccgcccctgcccacttccacctcagccctgaccctccctgcacctgggagtccaccgcctcctgatgtgtctgtgatcggggcagccccaagagcacgtatcccgggacatgatgtgttgtggtctgtgtggggtcagagccgtcagtgttcactgccgcgtgcccagtgcttagcactgtttgccgcatgggagatgcaggtcacaacccggtagcgcctagtggcccgggggacacctggcttgtctgggcctgttggctgacaggtaggagggactgccatccattgttggggcaaaggatgctgctcaacctcccacaacgcatggagcggcccggcgcacgactcacccggccccaaacaccaactgtgccgaggtgatgccctgccctgaggcgagcgtacaaggcttgagcgtcgagaacactgcaagggtctcagccagtgaggggctgcctgggccccgccgcaggcctgactcctagagccaagccgttttctcccttcaggcagtgggtagggctctcacatgacgaccctgggtttgcagctcggctgtgcacacaggtggaccctccgtgctttgtcagttcctactgcttggccctggggccggaagctgcttctcaggcctcactctgagaagcatcttcacaacctgggtaggtccattgcctctttccaccgactctgctccttgacaagggcatgttcatcagcagagccaggcagggagagctcaggacagccagacctggggccagtggcataggtacgtgtgggaaggggcaccaggtgcctgtcctccctgcgggcagagccgtctgtcctctgcagacctgcagtttctgtaaacatcctgtaaggagccaggaagcagcaactccagatgcccagaggagccccagccaaggcagatgcagccagggcatcaggccgtggggctgggcaaggtgagccacaggctggaaaggcaggggcgcacggcagatggggatgcggaagccagatgctgacccagctctacccacatttgtgaggggcatgggggctgcgccgtcagaggccttagctggctccgggcttgaaatgtgagtcccaagagcccaagttttattcccacgtggccgcagcatgccaggcttagcctccctgtgtttctgtaaaacagcaccctcgtgtttttatatgagaaccgaattcaaggtactagaagtcctcatatgggaagggaaaagtcgtggttttataagcaatacactctggctgagcccaagttaagatttccagtccaagttcatcagcgcctagcttcagccgggactgctctggccccactgctgtgtgagctggcgcttctgattccaccccacactcggtgaaagggtcccagagcaactgacactgagcgtcaccggcggcggctcttcctagaggagcatgttcaggagaggtgaggctgcggggctggggccctgggctaatactccctggctgtgtgaccctgggcaaattactcagcctctctgagctgctgcttcctctcctgtggagtgggctgatcccagccacaccagcactcctggttgttccgtggttaatgtctgccaaacacggtgccatggagaacacccagcagagcccagctgcttgtttgctggggagggacagcgctgcaggggcgcctccccctggccctccagcacctttccaccttgcttccaggacctccgcggctcagaggcagtgcaggtgggcttcagggacggcagggagggcccacgccggcacacaaggaagaagggaaggcgccagggatcgcacccctcaggaagaagagggacggaggcaaagataggaaggacacgcattgtgccttctgtcacttggggattttcaagtcaaaatggggagggggccggggtaggtttggaaactatccaaatggcattttgtttcacattgctggctgggggcaagccctctgcagtgaccctacatgcccactagaggtcacaccacaaaaggggacctcccctaaggaggggggacaaacggaggaccctgggcaccgtgcctcctgcaaggggaggaaggatgaagccccgccatccatcgggtggggaaagcgccatgcctccggcagcacagccaagcggcccccacagggaggagtgagctccatatgggcccaggtgacccggccacaacaccctctcggcctccgcctcacctgctggtgttgggcatggccagcctgggcagccaccagccctcgctgcccatctgctgtcccctcaaccccagcagcagacagaaaagtgcagggtctgagcccccggggggatgctggtgtcggacagatccctggagaacaaagcctgtgcccttgtgtctaggtgaggctgcggcacccaggcccggagcaggtccccccagctgggccatccccactcttggagcaagaggggaactgcagcaggaagcagccttc

SEQ ID NO: 4515 - DNA, 271 bp, Homo sapiens
ttccacatgctcactgcacattgttgttgaggatgcagggatccacctaaagaaagaaacagactatttcagttcaggtaagaacaaaaagaacaaaccagtttagcaatccgtctaagtcaacttcttatagaaagcttaggacaaatttaacagtaaagatgacaatcctcacctcagtataagtcggtggtggcatgaacttgaactcaggggcatacataaagatagggctgtcttgagagccatccatgtcatctagcagaggagt

SEQ ID NO: 4516 - DNA, 17152 bp, Homo sapiens
agctttgaagccggcgagcggtgaggaggaggcgccctcgcgtgtggagagcggactccgcctggactccaccgcccacggccgcatcccatcgccgcacaagatcgccggagtcatattatcgacgtagttaaagcccactagcctaaagccgggcggactgcggtaaggaggccccgagaccgaacctgcagcccctgcagccccgggggggcgccggggaagggactcccgagaggtcgcgaggggcggaaggccctgcaggttgtcacccggaaataacgttctgaggccccccagccaggcgaacgcaccctgctcggccacggcctccgaggctaaccggaaaggtgccaggccgaggtgcaggggcgggatggccccaggaagagccgagggccgaggagggcgttgggtgggctccgcgctgcccgaactggggccgcagtctccactccctcctgccccgcggccctccgccgacagccaggcgccggcggggagtcctggacccctcccgggccctggaagccccgtcccgccggagctgacgcgccctcttggtatccatccggccgcctgggctgcccctcgcccctcgccttggcaaaaccagcccccggaccgagccctgccttggagagtgtgggtgcgcaaggccagccgagctgtcggttccggggtttcggggtgcgccactgtatggcggcgtaagccgagaagtgtccgaggccgggctccagcagttgagaggctgatttggccacggtgaaggacgcgcccggaggaaggaaacgggaatccgaaacgggcggtggccgcgcctttcccgaggccggcgtcgagggcttcagcgcctcagggtgggcgggaggggaaggtcgtgcgacccgcgtggccggcggaaaggagcagcgggagccgcggccgtagggaagccacgggaagacgggcggctgcgctgcgatgcgcggccctctccctgaagccctcggctcaggcgccacaggaaaggctccttcgggcaggcctcagctttcagcttaagtttttttcctttggccgagtcaactgcggtgccgagttgtattttcctttcagaggtgtgtccgagaaccattcttaggagacgcctgccggccgctttgggatagggcctgtctgcccatgctggcttccaaaggcctctgtgtgttcctgtatgtgggcgtgcacgtacctgtcacatgtgtacgcgcagaccacaggatgtccacactggcttccaaacacatctctgtgtttctgtctgtgagtgtgtacgcaggtgtcaaatgtgtacgcacagatcacagggtgtccacactggcttccaaacacgtctctgggttcctttatgtgcgtgtgtatgcacttgtcatgtgtacacacagatcacagggcatccacactggcttccaaacatgtctctgtgtttctgtctgtgggtatgtacacacatatcacatgtggaagaggtaggaagaggctggaacaggtaagggtcatgaaggtgcagtgcactattgtactgtttgcgctttatatgtgtttggttagttttgcaagaacatgctggtgaaggagagagaaccccaaacaattgattagcagtgctactgaaactcagatatacacaggaatggcaaagaaacatctatgaaaaaaagcagattctggaactccatctccctgagattgtcactcatggggtctgcaggaagtttcaggaatctgcattttcttctaataaacgtggtccacaggttataagttgagatacaaatagaatatataaagtaaaaaaggaaaatttgaagtttcctgcctagcccaactcttctcattggtagtgtctgttaaattggaaacatatctctttccagacatattaataccttttatacagttgactcttgaacaacattagtttgaactgcgtgagtacacttatatgtggatttttttcagtaaatggaatatttttggcgatggcaacaattttgtgaaaaacctcacagatgagtcgcttagccaagaaatatggaaaaaaaaagaaaagaaaaagctagatatgtcatgaatgcataaaatatatgtagatactaggccattttattatttactatcataaaatatatacaagcctgttataaaaagttaaaatttatcaaaacttacacgtacaaacagacagttacatggcacccattaggttcaagagaggtgtaaacagttgtaaagatgcaatattaaataataactgcatcaaattcactgtagtacatagagtactactgtaatgattttgtagccacctcctgttgctattgcagtgagcgtcagtgttgctggtattggctaaaaattccaagtaacataatcatctctgagtgagcagttgatctctccagtacattgcatatcacagtaaaaggtaagctcttgaggttctcacatatttctcgttgtgttcactgcagtactgtaaaccttgcgtaacaccatgggaccattacgaagtgccgctagtggtgctggaaatgctcccaagaatcagagaaaagttaatgacattacagaaaaagcggaattgcttgctgtgtattgtagattgaggtctgcagctaaggtcgcctgccattttaagataaatgaatccagtataaggactgtggtataaaaacaaaaggaagtttatgaagccatcgctgcagctacaccaacaagcatgaaaaccttgcactttttgggaaatacctttttatctcatattgcaaatgcagctttttgtgggtgcaggattgctatgagaaaggcatacctatataatctaatattcaagaaaaagtgaagtcattatctgacaaagcaaaaggaagatgaaggaaggtatgataattttaaaaagtgggttggctttcaaaaaatgtcaagataacaggagaagcagcttctgctgacccagatgcagccgacgagttcccagataccattaaggaaattattgaggacaaaaggccaggctttgtggctcatgcctgtaatcccagcactttggaaggctgaggtgggtggattgcttgaagccaggagttcgagaccagcctggccaacatggcaaaaccctgtctcttctaaaaatacaaaatttagccaggtgtggtggtgcacatctataatcccagctactgaggaggctaaggcatgagaatcgcttgaacccaggaggcagaggttacagtgagattgcaccactgcactccagcctgggagacagaatgagactctctcaaaaaaaaataaataaaaaataaaaataaaaaaaaatagagaaaatcactgaggagaaaagatatctgcctgaacaggtttttaaggcaaacgaaaatgccctattctgggggaaaatagtgccacagaggatatttattaggaagagaagtgaacatcaggatccaaggcgggaagggatgggctaactgtactgttttgtgcaaatgcagccagatgtatgatcaggactgcccttatctataaaattgagccttgaagggaaaagaaacactgcctgccactcttttggttgtacagcaagatggctgagcagcaactctttttctggatcagttatataaatgctttgtttttaaagtcgggaagtaccttgccagtaagggattgcctttaatgttcttttgatattggacaatgcccctggccacccagaaccccatgagttcaatacaaacacattgaaatggtctacatgcgcctaaacacaacacctctaattcaacctctagataagggagtcataaggactttaaggatcattacacacagtactctgtggaagagaaccccaattgagagaatatcatgaacgtctgaaaggattacaccattgaagatgccattgttgtttcagaaaaaaccatgaaaagccatcaagcccaaacaaattcctgctggaggaactccagatgttgtgcatcacttcacaggatttatgacagagccaatcaaggaaatcatgaaagagattgcagatatggcaaaaaaggtttcaagatacaaatcttggagaaattcaagagctaagagacaccacaccagaggaattaacagaagaccacttgatggagatgactccttctgaacccagtgccagacgatgaggaagaagacgaagcagtgccagaaaacaaattgacattagacaatctggcagaagggttccacttattcaatatggcttttgacttctcttataacatggacttttctatgaaacaggcactgaatctaaagcaaatggtggaagaagaattggtgctaaatggaaacatgtttagagaaatggaaaagcaaaaaagtcagacaaattatgatgtatctccatcagattacacttattgtgcctccctctcctgcctcctcttccacctcttctacttctgccacccctgagacagcaaagccaacccccgcttctcagcctattcaaggtgaaaattatgaggacggagacatttatgatgattcacttacacttaatggagagtaaatatattttctcctcatgatttccttaaaacgttttctttagcttactttattataagaatacagtatataacatatgtaacatacaaaattgtcgagtgcggtggctcacatctgtaatcccaacactttgggaggctgaggcagacggatcacttgagaccaggggtttgagaccagcctggccaacatggcgaaaccccgtctctattaaaaagataaaaattagccagacatgatggtgcgtgcctgtaatcgcacctactcgggaggctgaggcaggagaatctcttgaacccaggaggcggaggttgcagtgagccgagattgcaccactgcactccttgcctgggtgacagagcaagactccatctcaaaaaaaaaaaagtgttaattgtttatgttgttggtaagacttccgatcaacagtaggctgttactacagttttgggggatggaattttgactgtgagggtctgtgcccctaacctcatgttgcttaagggtcaactgtacatagatatgttacatacacacacatacttcctccctctctgtaatttggatcctatgcctattatcttttagtttactaacttgacttaagaagtcctgatcattttttgatgttcatgcataccgtatagatcctacctcatttgactcctacaaaatatttgttaagggtgttctaaaagttactttttgtagttaaactacactttatttacatttgtttgttatggaaataatgcataataatcgttaaaaatccaaacaaaaggggggaacatattaaaagaaaagtaagggtctccctgctactctacctacctacccacctaccttatctgttaccatatcctagacccaactgcaattaacaatttctggttttagttcttctggttcttttcattataaccttaaatactgtacatatacatcttgactcaccagctgaaaatccttcaaagggacaaaaacttattcttaactcctaatttaaaaaattgtattacttttagttttgctagaagctttcatgactttaggttgtttacctaaatcattatttataaattttacacactgtatattggctccctactaggagaggtgaggaattggtacattcttactttctcgtcttttcccctccccctcctaattttgttagtttcattctcatttttagtctgtcaagaatttgcattctttttgtaaataaaattacagacatcccttggtatccatgggggattggttccaggacctctcgtatacaccaaaatccacatacactcaaatcccacagttggccctgtggaacctgtggatatgaccattcgcatcccaagaatactgtattttccacctattcttggtttcagttgtggaacccactgatatggagggccaactgtatatattgaaaacaatttgcatataagtagacccacactggttcagacccctgttgttcagggtcagctctatatctttccaactttgtgcattgattgaaaaaccaacaacagtatgatattagggctataacagatctgttaggccaagcccacatgcccctgaacagaacattctgcacattgggccaacttccaactgccggcacctgaagttatttgcattatcagctatctttgtccaccagagcctgctctgcctgcattttgggaagacctaaagtgccaaggaattaacacaccctgcaagtatgctcaattgaaggcaatgaatagaaaaagacccctgactccttcacccctggatttcagggaggtaaatccaagatgtatgctaaggaggtgacacttaatgtcagacacacacacctgttatgagagtttcctgattgaataagaaagaggcattccaggcagaagtacccgaacatacaagagtgcaagaccaagaggctaaggcagattgctctgtgcaagaagtggcaggtagtgtggcgtggctggagatgaagaaatgactggattgggaaggactttatccaccaatctaatgaatttgactttcatcttgaaggtgtgaaatagcgtgctaaacaagtttaaaagcaaaatgtcattagcctatttgtatttagaaagagcactccagaagcaaggaggggatgggtgaattggatgtactgacactggaacaaggaaattattccaatagtccaggaaagaagaaggacatcaactaaaattgcacaagtgaacatggaaaaaagaggatgcgtctgagaaatataaatattggccggggcggtggctcacacctgtaatcccaacacttcgggagggtgaggtgggcagattgcttgaactcaggagttcaaaaccagcctgggtaacatggcaaaacccctctctacacaaaatacaaaaattagccaagcgtgatggcatggcctgtagtcccagttactcaggaggctgaggtgggaggatcacttgagcctgggaggttgaggctgcagtgagccatgatctcgccactgcactcccacctgggagatagagtgggaccctgtctaaaaaaaaaaacaaagaaatataaatattgtattagggtttaccaaagaaacagaaccaatacgatatatgtatgtatacgggtatatatataaggagattcatataaggaactgactcacaagatcactgaggctggcaagtctacaggatgagccagcaagctggagacccaggagaactgatggcatagttcctgaccagaggctagcaggcttgaaatccaggaagagtcagtgtttcaatctgagtctgaaggcaagaaacaagctgatgtcccagtcaaaagatcagaaggcaggagagattctttcttactcagggaggatcagtttttttgttttattcaggcttctaactgattggatgagactcactcatatgttagggaggtcaatttgctttactcaggctatccatttaaatgttaatctcatcccaaaacaccctcatacacacacccaggataatgtttcagcaagtatctgggcactctatggcccagtcaagttgacacataaaattaatcacaaatatgttccagtaacttagtttttaaacaactagattcttatgagaataaactcaggataggataggggaaatgctttctggctttccacttgcatattcttggaatgtcactttttcttaaatgttaaaaattgaaggccaggcatggtggctcatgcctgtaatcccagcactttgggaggctgaggtgggtggatcacgatgtcaggagttccagaccagcctgaccatcatggtgaaaccccatctttactaaaaatacaaaaaaatagctgggagtggtggcgcgtgcctataatcccaactactcaggaggctgaggcaggagaatcacttgaaacctgggagacggaggttgcagtgagccaagatcacgccaccgcactgcagcctgggcaacaagaatgagactccatctcaaaaaaaaaaaaaaaaaatgaaaatgtgtcgttaatcatcgagatagtctttcagtctgcactcagtaatattaatgccttctcattgaagtcatctattctgttcccataaagatcaggatagtttaggtagtggtgaataaataaggttctcaatggcctattagtttttttaaatgttcaaaagatagtagcatgttgggaaaagagatgaattccacatttcttttggtacagtacaacttactgaaattgctttcttatttcaacaaggatttaccaggttgtgtgtagtggttaaaagcatggactttacagccacattacatgggttcaaatccacttactagttatgttaaccacaggaagttagctaatgtctctctgcctcagttttctgtttgtaaattaggataaaaatctccgtagatgtgaatatgtatagctagatagtagattgtattcaaaatcccaatcataacataataaaaatattaactattattagttgttttgaatatacaacctaatttcattttctccatgatctgagcatgttgagttatttttaaacaactccattttacagatgagacagtgttccaataagctaggtagtatgcccacagacacacagctagcagctgagatgaaccacccaagtctatttggttttcagctcatgttcttttcatgatattttgctttctctcaatatttatagaatttaatttaattgactagaattaaactaagagaaaatgattgaatgaagagatgcagaaggcaagagatagcaaaggtcattctgggctgggcatggtggctcacacctgtaatcccagcactttgggaggcctaggcgggtggatcatctgaggtcgggagttcaagaccaccctggccaacatggtgaaacacccccgtctgctaaaaatacaaaaattagctgggtgtggtggcaggcgcctgtaattgcagctactcgggaagctgaggcaggagaatcgcttgaactggggaggtggaagttgcagtgagccgagatgtgccattgcactccagcctgggcagtaagagcgaaactccgtctcaaagcaaaaaaaagaaaagctacctttaccaaagacagttaaaatgatggccaccaaggggcagtgtgcagcaggcagagaaggtggctttttaaattatttttcactgcctgctgagacaaagatgttacaccagaatatgccaccctaacatatgcttctttggcataaggattattttgagctgaagacgattgagaagaaacaaataaaagaaaaactctgccttccctttctttgcctaaaggcaggacatgctagttaatgatcaacccctgacctaatcggttatgttacctatagattacagacattttatagaaaaagaaaaacacggtgaaaatccctgtcctgttctgttccattgtaattaccagtgcatgcagcccccaatcacatacccactgcttgctcaatcgatcatgacactctcatgtggacccccttagagttgtaagcccttaagagggaaaggaattgctcacttggggagctcggtttttggagacgtgagtctgctgatgctcccagctgaataaagcccttccttctacaactcggtgtctgaggggttttgtctgtggctacaaacctgtctttggccagtctaatttacaggacctcagccagagaactaagatgggtagaggcaatacaggagatagaaataatttaggtaggtagatagggtgaaagagtccctgacaaaagcttttcttctgacaaaaaacagctcagaaattacttccattctaaccacaggcagtccaaataaatcacttctcttttaacaaagagcagcctggaagattggactgtataatgtagataagcatctccggcacagagggagagtttcttgggtagtcaccaaacttacataaatgggtcccagtaaaaacagtaggctttaatgagcacattcctttccccttttttggacagggacacactaaggttagctagaagcttgcatggtggggtgggggaaatgcctgcagctgcaaggaggtacccaggacaaggcatggaaactccccctattcttgttagcacatgcaaggtggaaggagaaaggcagtgtggagtcgcccaagctaagagcctgcctgcatgataaaagaatggggtaggggctgccagagattccactctatacagatgacacacctggtcctaaccaggttttcatgccctatgtagataagatacccgctccctactagctcgttgataaaaaccctccattttactgcagcacggcaacccgtctgggacctctctctgtgagagagagctgtccttttccttttgcctattacacttctctaacttcaccctttgtgtgtctgcattcttcatttctgtggccatgagacaaaaaacctcagctgatatcccagacaacaaggctgctttagagggaaaacggatagctaatattatcagttaattggctatgttaattgataccttcaaattaggtgttttaaaataaatgctgagaacaatatgaaagtgtttttcttttactaattctctgaggattttgttatttatttagctttacaatgcctagccccctttataaatgtaattattgtgttgctaagtgcatgtatacaaaaaattcattggttcaaaagccataggcctggtaccatagccatatatggtacgttcaaaccttggaaatgcacattctcagtgtgtcggaagctctgtactgctccttcttgaagaactactttgatttgtggttaactcgctgttttgactcactgttttaactcccattacttcagtatctgacattcagcctcagaatctggccagtgtatcagggctggaattaattgattaacaccattagatggcagtactatttaaattccaaaaatggttataaactcattctctaaaatgtgtgtcaaatagaatatttgactgataataactctaagagcacaaaaggattaaacacacacacaagacaaagtttgggatatacccattggaaaaacccttggtctctttaaattttttttcatatgtatgtatattgcacatattgccggcctctttatctcttttttccttttttttttttttttttttgagaaggagtcttactctgtcacccaggctggagcacagtagtgcaaacatgactcactgcagccttgaactcctgggctcaagcgaccttgtcaccttagccactgtgaccagccttcttttcccttttgactttgttatatcacactgactctagaaatgtggttctttattggggcgattttgccctcccccggggacatctgacaaggtctggagacattttgattgtgggtagggggagggacactctgctacaggcatctagttggcagagcccagagataccgctacacaccctacactgtgcagaacagcccctacggccaggaattatcaggcccaaacaaaataccaagttagtttttaatttcaaagtttacgcgtaacattattttttagatataaaaaatattcacacattaatttgatcacaagaaattttaaagaaatttaaacattttcagaaaaggctacttcaaggtgtcatgacagctttggaccaaacattaatgttctatatgactttgggcaagtcagtcatgtttattagacttaataacccaggtaacgttagctgttggagggttttttaaaaaacgttttattttgaaaaaacttcaaacttaaaggaaaaatggcaagaatactacaaagacctatttattcagatacaccagttgtcacaattttgccatattaactttatctattgatcaatttctctttcagtctattgacctatctatcttgaactatttgggattaagttgtagacatctgatccccttacccttaaacactttaccacgtcttcctaagaataagaccattactccacacagtacacttatctaaatcaggagacagcattgttataatactgttaccaagtggcaagctggtgcactgtccagacagggagagagggagagaggacctgatttgtaacatttgccagttcccatgtgtgatggtttactttggttcataactaccattgtccttgttacagtcttttattaaaatgtggggtgtgttaggccgcaagggcaggcctcaagaaacagaatctctctcctgccctcctttcacctgccccaaggcaggattccatcttctcccacctttccaactgtgggtcttaagacttttcagagagggtcctgccatacacactgggggaaggaatgctgacgtcatgaagcttccatgaaaactcaagaggactgagttcagagagcttccggatagctgaaaacatggaggttcctggttcctggagggtggcgccccaggcatggaagctctgagccccttcctccgcacctcatctcttcatctgtatcctttgtaatatcctttattataaaacagcaaatgtgtttccctgagttctgtgagccactccagcaaatcaatcaaacccaaagagggggtcatgggaaccccaacttgaagctcaatcagaatttcccaaggcccagatttgcaactgatatctgggggtgagggtggtcttggggtctgagccctcaatctgtgggatctgatgctacctccagatagatagtgaaggaactgggtggaggtcctggcttgtgtctgcctcttggtggtggggagaagttcccacacatatggtcacaggagtcttctgtgttgatgattgctgttgtggtgtgagagcagaggaaaaacacagtttgagagagttttcccaaaataccatggtaagtggctcatcatggctgatttcaggttatcaacagcttaacaaccagctcaaaacatgctttgctgtttaacaatcaactctcagggaatcagtgaactggtgagcacaaagctactgttaacgaatccatggttcatatgcaaaagttaccaactgctctaataatgtccttaatagtcatgtttttttccaagttcatgattcggtctgtatcatcatttgtcacctctctttagtatcctttaacctggagtggttccagcctgtttttgtctactggggcattgctgttcttgaaagagtacaggtcaggtgttttgtagaatgcctttcaattagggtttacccagtgtcttctctggattagatttacattatgcgtttttggcaggaataccacatacatgatgtttacttggttcattggataagaagcccgtgatgtcggtttgtcctattattggtgataccaattttggccacttggttaagtggcatgtgtgaggttttttcattgtaaaactgttatttcctttttgtaattaatatgagacactttgagactacgcggatatcctctccctcatcaaacttttctccaccaactttagcatctggttgccaccctccaaaatggccccagtgatcccatctcctaataagtacatgtctgtgtggtcctctcccacactgcataggaatggcttacgtaaccaataggtagttgaggatgtgatgcagtctgacttttgaggctaagttgtaaagaaagacactgtgtcttcctccttgttgtcttggagcgcttgctctggagaagccagaggtcatgtcgtgaggatactcaagttgccatttggagaggtgcacatggtgaagaaatgaggcctactgccaatgaccatgaattctttggctattcttaggccttttctcatccagataagatactgaatcagcttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaagaaaaaaagagaataaaacataatttctttagaaaataaattatgacagaaagccatggcttcaaaacagatgaaaactaaaatattttaaaataagttaataaacatctaaaatgacattagatatgaaaaaatgacgtgtcagatttagaaatatacagaaaggagatgacaaactcagaaaagaagtaaaaattttaaaaacatttcagaaatgaagagagaaagaaacacgagcaaataaacagaactgataatgcattaaaagaaaagatgaaaaaatatgaggctataaaagagacgtgtggtacaggataacggtcacccaaagatgtccccatcctaatctccagaacctgtgcctgtgtcacctgacatggcaaagtgacagcaaatgtgactaccttatggatctcaagagagaagcctgatcctggatcatctggctgagtccagcctaattgcatgggtccttaacagtggagagtcgactgcagtggtatgaaggaaatgcagctatggaagaaacggtctgagaaatggtacattgctggctttgtggatggaggaaagtggtcatgagccaagggatgtgtactacctctagaagctggaaaagggaagaaaacagatttgccctaaagcctccagaatgaaatccagacctactgacaccctggttttagctcagtgagacccatggtgggcttctgaaggcaaaattgtaagataataaatgtgttaagacactaaatttatggtgatatgctacacagtggtagaaaattagtacaagatgaaaaagatttaaaaggaaatgacagatatacatatataggaaacaggcaaggaagaccctgtacacatgggtacacgtgcatgcgcacacacacacagatatattagttcctaaagaaataaaatcagccaggcgcggtggctcacgcctgtaatcccagcactttgggaggctgagacaggtggatcacctgaggtcaggagttcaagaccagcctcaacatggagaaaccctgtctctactaaaaacacaaaattagctgggcgtggtggtgcaggcctgtaatcccagctactcaggaggctgaggcaggagacttgcttgaacctgggaggcggaggttgcagtgagccgagatcgtgccattgcactccatcctgggcaacaagagtgaaactccgtctcaaaaaaaaaaaaaaaaaaaagaaaatcaaaaggaatagatccaaacaaacaagatgtataattcaggaaaggtttcctgaaataagcatatacttgaaacgacatattgaaagattatctaaacaccttggaaaatggagtccaaatatccaataccaagacattctagtaaaattattggaagagaaaggaaagaaggaagaaggggaaagaaggaagaaggggaaagagggaagaaataaaatttcttggggttcctttccccaccaaaagaagatgcactgacattttgaaagaaaattagtttgacatcagatttttcaacagcaatgccttatgtcagaacaaaatggagttacatattcaggccaagtgtggtggcgcacacctgtaatcccagcactttgggaggctgaggcgggtgaatcgcttgagcccaggagttcaagagcatccagggcaatgtggcaaaaccccgtctcttcaaaaaattagccaggcatggtggcatgcacctgtagttccagctattgaggaggctgagctgaaaggatcgtttgagcccaggaggttgaggctgcagggagctatgatctgcactccagcctgagtaacaaagtgagactctgtctcaaaaaaaataaaaaaaataaaataaaatgaaaaaagatactcgaggaaagtaaagataagccaaaataattttcaagtataaaagcagcaaagtgttaccaaaatgcaaagactcaggaaatacagttaccataagctattcctaaggaatctactagtgaacaagtttcaaacagtcacaatgactgcagagacattgacgtaaagacagatggcaaatattaagtgggtgggtaggtagatacagctgtagatatggccagctgtttgctggaggcaatttggacaagcttatgagagccaatgaacttttcaagaattttatgagttggttattaaacatagacattatgaacagttaaagtatatacatgtacgtacatttaaataaattaaaaacagtaaacactaaaaacacatcgcttcataattatgttactacattttacaattatctatgcttttgaggttatttacattgattgtatcaaatggtggagatagggtcagcttctgcacatcttttcccgaactccacatttaatgatgtcaccttgatagctcaccaatggtgaaagtatttactccatggaaagctgcaaaatgctatgaatcagggctttttccccctttttctggagagtctcttgttaaacatttcctagcacatcaatggattcaaaaaagagaagctagtatgcaacagatccatgacttgacaatgtagatacaccaccactctgaagacatatgaggagggcactgggagagcgtatgaaaaatgtctttttagcctttcagtaatcattttgggtgatagtgatgtcatcgttattctgagaatggagtgtgtgcaatgtcaattaaagcaaataaataatcatatgatatatttaattgtgttatcctctctgttttgaaaaccaggatttggccgtggatggtggctcacacttgtagtcccagcactttgggaggctgaggcaggtggatcacttgaggtcaggagtttgagatcagctggccaacatggagaaaaccccgtgtctactaaaaaatacaaaaattaggccgggcacggtggctcacgcctgtaatcccagcactttgggaggccgagg

SEQ ID NO: 4517 - DNA, 1066 bp, Homo sapiens
tttgtcacttattcaccttatctcagttatgccattttggcgtccacagtgacagtcccctggaagctggggtcagcccccacccacccaccgtgaccatcacccacagggcgtgagtgtgggccttgcagggcccagccgatggttacaggctgcaggcgggactatggggctcctcctgaggcctggtgccttccagccccctgcccaccagcttgggtacagctgcctgcctgccagaggccaagcattcctaagcgtgggctgggggaggccctgcccctctgtagcagcagagcagacagggcagtgggagaaccatgtgggtaggagggcatcaggtctcaagagcctctcccctgctcaggactgggtctagacaaggccacgtgtgatagggtggtaagccctgggccatatggaggagcctggggcccatcttggttctgctgctgagttgctgggtggctttaggcaagtcccttcttgtcccttggtcactctgtttcctggctagcactgccagagagagggtgctcatctccaggacctaggccacctgtcagcacaaacagaacttattccagacataaacatgagtcttcttatttcaaacactggagcaactgatcaacaccaccacagcccatgcaccccgaacctgacttcactaccaaccttgagcctgtgctgtcctctctctgctgacgacactggtgacgcagaaaggaagtcggtggtgtctgctcacttgcgtgcagtcctaagcacagtaagaaaattctgaacacagctgggtgatcttcagcccagaaggtgtaggggcttgtgagcactaagtcagtttctgtccatgtctgatagctaccacaatgtctccccttgctagggcagctgcgaggagacgtgtccagtgatgactggcagaatctggacaaacggacatcactgcaagggtctgtccacctagcttggccaggctcagcttggcagagctgatgacccaagtggactaaacacggagctagcagaaacaggcagactctaagcccaaccagaagagtca

SEQ ID NO: 4518 - DNA, 1048 bp, Homo sapiens
tccagcttgggaaatagcaggaccctgtctctaaaaacaaagaaaaaagacaaggagatggaatcaaagcccagaggtcctccccttctcagagccaccactagttctctgtgaccatggaaaactacccccagccccactgccttttgcctccggtcagtgggttttgcggggctctgaggtgtctccccactcacccagctctgggcagagcagctgggctgggctggggctgagctaaccagaacctggaagtagggctcggggttctggctgtggccccatccctggcttggcccagcctcgtcagctttggtccaggttcctgaatggtgcctccctgcccaccttgtgttgggagcgtgagcattagaggggaagagggcggacaggaagggagggtcagttattttacaagtttttaaaaagttacaggtaggttaactttgagtaaaaaaaaaaaaaaaaaaaatgtcacaaaacaaggatcaaacagagggcacgtttccctctccccttcccttctaggggcataagtggtggtgagaacactcatatgatggtgcaggactgcaaggcgccccccttccggctaccttgcgtgggcacaggtttgcctttcccgtagtaccccgtgaagatggccctgacctccatgttcttggccagggtcagcatccagcgcccattgcccaaggaatagagcttgccccggcttagctcgcccacctcctcgcctcggctgccccccttctcctgccgcagaatctctaagaggtcaaggcccgtctgcacggcctctacgtcagctgcacagccgagggtgatgtgggtgccttcccaagcggggcagtgctggaccttctttccctttcggtccgggagcacctttccgcttctggtcgtggaggaggaagagggaagcttgtctgaagctctcctaagcgtgcgctttccccattcctgccacttcggaaaggtaaacgtgctggaggcatgcggggcgcgccaggagcctgcggttctgggactggcctcactcttatat

SEQ ID NO: 4519 - DNA, 695 bp, Homo sapiens
aagcttgtaatgaccagcctgcagtcaattcttgaaaatgtggatacaccagaattgctttgcaaatgtgttaagtgcattcttttggtggctcgatgttaccctcatattttcagcactaattttagggatacagttggtatattagttggatggcatagagatcatactcagaaaccttcgctcacgcagcaggtatctgggtggttgcagagtttggagccattttgggtagctgatcttgcattttctacgcctctacttggtcagtttctagaagacatggaagcatatgctgaggacctcagccatgtggcctctggggaatcagtggatgaagacgtccctcctccatcagtgtcattaccaaagctggctgcgcttctccgggtatttagtactgtggtgaggagcactggggaaagcctcagcccaattcgggccctccaattactgaggcatacgtaacagatgttctgtacagagtaatgagatgtgtgacggctgcaaaccaggtgtttttttctgaggctgtgttgacagctgctaatgagcgtgttggtgttttgctcggcagcttggatcctagcatgactatacattgtgacatggtcattacatatggattagaccaactggagaattgccagacttgtggtaccgattatatcatctcagtcttgaatttactcacg

SEQ ID NO: 4520 - DNA, 1808 bp, Homo sapiens
agcgaagcccgcgcctgtgccaaggcttgcgagcagaatgccttcgcgatggacgcccgcattccacccccttgaccgctgggacccctagtggcgggtgggtggagcgcgctccatttacctgctggttacctcgtgaggcgcctcaggtgagaagccaaatggaaaaccagtgaagtgaccatgggtgccaaaggcctaaagagcaggcagggaaatgagactcgggaccactggagccccatgctgcctctgacaagccctggagctctgggtctcaaaggctggctggcaacaggctgcaccgggcatgggaatccgccggctgcgagattgggggtaaagagctcagacatggtcagaagcctctgcctaacacacggctccagtagccactcctcaggcctcctgcgccctcgggggtgcgtgacacaggaggatgagttgagctggctggtggccccagtgtgccgtactactgtcccttggggagagtgggacagggtgggcgcctgacacacaccacgcgccccagaaacattcagtgtggacgtttcctttttcagcaaggacggcgcccaggtaaacgccacgtaacccaaaccatcaacactgcagcgtcctgcccaaggctcacgtggggaaccggacaggtgctagatgatgataggaacggtgggctctgagggaggacagacaggctcaccccacggggacctcagaacagcctgcctcatactcagagtccaaaaaagaaaaggaacgtacacatctcctcccaagttaaacacgagaggtttgtcctcaacctcagggctggaaaccaccacaggtaggaggctgggcacgggggctcggcctgtcatcccagcactgtgggaggtcgggtgctagaatcccagcactgtgggaggccaggcacgggggctcacgcctgtaatcccagcactatgggaagctgggcgtgggggctcagcctgtaatcccagcactgtaggaggccgggcgccgtggcgcatgcctgtaatcccagcactgtggatggccgaggcaggcggatcacgaggttaggagttcgagaccatcctggctaacacggtgaaatcccatctctgttaaaaatacaaataactagctgggtgtggtggcgggtgcctgtaatcccagctacttggaaggctgaggcaggacaatagcttgaacgcgggaggaggaggctgcagtgagctgagatctcaccactcactgcactccagtttgggtgacagagcgagactctgtctcaaaaaaaaaaaaaaaaacaagaacatctcccacacactcacagtgcctttgtagccccagggaaagcaatcccttaagatcatttgttgggtgaaaagggtaccaagtacacagtgttaggaccgtgcaaaaaaagggtgacaggaagtaccctttgcaaactttccataatgtgtacttaattcactgctcttataaaatgaaattaaataaaacaaaaaaatactactgaaaaataattgggcaacatgcggtggctcacgcctgtaatcccagcactttgggaggccaaggcagacggatcacctgaggtcgggagttcgagaccagcctggccaagatgatgaaaccctgtctccactaaaaatacaaaaattagctgggcatggtggcaggcacctgtaatcccagcttctcgggagactgaggcaggaaaatgtcttgaacctgggaggtggggttgcagtgagccgagatcgcgccactgcactccagcctgggcaacagcgtgagactctggctcc

SEQ ID NO: 4521 - DNA, 3699 bp, Homo sapiens
acgtcacttccggaagcgactcgctctgacgccgtccgccctcgttgccatggagacgcttgcgctttcccgggccgcacttcccacccgggtcttcagaagcccgtggccgctgggtgagcccctgcgtgaacgcacacgcacgcacacggcttcaggttgccccgcggcgccgcgcgcgatatcggctcggatcccgggaggccgtccgcccctttttcagcggatagctgaggccagatcacacctggctgtaggcccaaagcgaacctatcactggcacagaagcttggacctggaaggggactcatggaggagtccgctgtcttttagagatgggaaaactgggcccaaataaccaagtcactggtttcttaggctttcaggcaggaggtctgagagtctgtcttaaagagaccctctgtctggggcccagagcacccctccttcctcaatacacggccacatccaagataatcaaggttagtctcatgggtgacagaaaaataaccatggcagtgaatatactgctgggtcctggttttgctgttaccattcttcaaacagcaggactgggaaaatcccgcctgtcccctgcctgctctgcacgtcattttaacttcatgactgaaaacagcagccctttctagggttatcaacatgaatgtcggtaaatgttctactctaagaacagatgttttactttttttaagtttttagtatgaaaaactgtaaacacgaaattagaggaagagtccagcacctgccatttggccactgtccagacctactgtgtgcttcttggggaaaaactttacagctttgaatggctgagaggtttggaaagaaacagctcagtccccatggcccggatggagagaggatccctgcaggcaggtccccatgctgccaccagattggagccactccttgcttcctttagtcacagtacctgaatgtgcccgcctcctggagagcgtcctggttgcaggcttcccttgccaaccactccagagggtgaaactggctctcttcttgcttctttaaaaagacactgaggcgcatcttggatacccgcaagaaagaggctgtacaaaggcagaaacagacgttcagcatggccgtggctgagctgttggctccggagtgcttctgtcccacctcccccaggaagggaagtccgttggccaggccaattctagagcaaaatctgagagatgctcttagattcccactgtgtcactgcttctgctgagccatggaaacctgagagggtgtcccccaacacacagtgaaatgatgcccactcctcaggaagagcccacgtgggggcaggggcaagaggggtggggaggctcataccgtggcacgcgtcatcctcattcaagaggcccaggaggagcaccaccctccgcatattgcgcgtgcagctctcgttctggtctctgagcatgcccacggcgctctgcacacagcttctcagcagcctggtggtgtccaggatcgacacctgttggtggagacggttgggtcatccgtttctgccactgacacagtgggcaaaagccaaaccgcccgtatgcgatgagggtctcaatgcagcaaacagcacagggcggcggtcctcacggacaaagaagagacgccgacctccgccctgcaccccccaaactgccggtgcagatgcccttgacccccagtaaccagcaacaagaccgtcactgtgtgaggaaagtggggcgccatcctcacccctgcacagcggcggcgactcctctagctcccaatgcaaaagcgtttaaagatgcagctcagaagcatcaccagcagcacaaggggaggtcccaagaaccagaacttacatcactgcctccgagttcagaggtttcctttcccaccttctcagaactttctgtttccatggcctcctctgccacctctgccacctcccctgatgtgctggcctccgtctccatcgcctcctcatggccgtcttccgcccggtgttccaagcccactgcagtcgaagcaaacgtgattgcgttaccactcagaaggtggcacagggactggcagcggtgccatctgggagtctgtgtgctcagcctccgagtgcaggcttccccggcccctgctgtggtgctaggtccccagatgagagatcacggtcatgaagatcagcccccaaggcagccccttccttccagcctgggctctggcgtgttctaggtgctcacttccatggctggcctgctcacagagctctacctcagcctgtggtaagcgcacctgctcggccctggtgctctatgatgagccaccagtcagttctgcagatgtgtccccgagctcctgccgagggacgaaacacggtggccctgctcctagtgccatgtgcacgccacgctccacacctgccatctgcccttccaccacctgctcccccaggggctccgcctcgtgactcacgctcaggcaagtctccgggcgcgaacagctggctgatggtgacatgctgcagcctggtcacatcagaaaccatgagggtggatctccggaggtcatcgatgtggacagactgccacagccctgtgaagagtgaagccacccacaactgtctttgtgtctttcccggctgctgctcagccctaagcagggacattgcacaccctggcttgtcattatcttgctgcgcaatgaatgactggcaccctgaagccgaaaccctggaatgggcctgcgcagaaaccacccaacccgatactatacacgacccgattctatgcccatcgacagcttcaccataagcagcaacggtaagacctgcaatggccagcgtgggaaggacgcatggataaggcctgtggttctttcacccatgcattgttgtatttgctgtatcacagttagtgaggggtgggggacactggcaaggtctgccttccattctccacgaaattattcaagtaaacttactttcctgtttctggaataccaacttttctatgtcataaatagctggtgaccattccttggaaaaaaagagatctgaagatagtccgacccccgccactctccctccccgccaaacaggcgtatcggtgcgttcctgacagtgtctgtcgggagtcgggagtctccacgccgtgtgacctacatgctaagaggtgaggagcttgcctagagtcagtccaggagaggtgcacgcagcctcccatcccaggattcatgttttcatggtaatcagtggtaagaaatctaattgcatctggaaagaatcctcttgaggttaacaataatattctaatttcagactgtacaacacagaaccaaatgagaaacagttccaacatgacttaaataaatacactgactgggctgggtgcggtggctcacacctgtaatcccagcactttgggaggctggggcgagcggatcatgaggtcaacggattgagaccatctaggccaacgtggtgaaaccccgtcactactaaacatacaaaaattagctgggcatggtggcgcacgcctgtaatgccagctacttgggaggctgaggcaggagaatcgcttgaacccaggagattgaggttgtagtgagctgagatcgcgccactgcactccagcctggtgacagagcaagactccatctcaaaaaataaatagatacaaataaataaataaatacataaataaa

SEQ ID NO: 4522 - DNA, 1173 bp, Homo sapiens
gtctggaagtgcgtggcaccgccccaccccttcctccggccatgtaagacctgcccgcttccgcttccaccaagatgctcgtactccccggggctggctggactgggcctctgctccaagtccccaccctccaccctcagccaaccacacagtggtgctgcccaccctgaagcccggggagccagggcctgtgctttcactgggatgcaaatcttcctgctacctcgagctcagattcccgactccagcccagccgcagcccgggaggcgcagcccgtgggctgggtgaacaaacgacacaaacaacacaggacaagctgtggggaaaaggctccgcagccgcctgtgctcagggctgagtcggctcagggacagctgggccaaggctctagactctgccagggatgggagcggctcacacagctgcagggaggaggtgtccaggaggccctggaaggcccggggaaaagccaaggcataggccacaaaggctgcccgctcgcctggatgcggctcctgcacccccagccccaggtgggcacacacctgctccagccacacctgggctttggccgccaggtccaccccagggccctcaccagctgctggcgccaacatctgtggaacagagtcggtgaagaatgggggccaggaatgcaggatgaggcctgggagcagccagggacaccctagtttgagagcaaaggtaatgcagcccgtgccagcttcctgggacagcactggggtgacctgcctgggtggcacacctctcgccagggcaagggctggcttggggcctgtcgcctggagacagcagggtttagaggagggactgaccgggtcagggggcacctcgctgcctgaaaaggaagtgacgaaggagtgggccagggtcccggccaccggcacacctcgcagctggcccgctagcacgttgctgctgctgtcgaagcctggggaggaaggcggtgggattgggggacctcgggccaagatggggctcctccttcccggcccttgccttgccccgcaccagacactcaccgcccaggtagctgtaggtggaggctgtcaggcccccatcggggccctgagcccgcctcaggcccatctctagcagccgcttctctggccctgcgatcaagcgaagccgcgctgcgttggtggccacca

SEQ ID NO: 4523 - DNA, 421 bp, Homo sapiens
gtcagcaagctactcagtatctgacgtggtttctaaggtggagttgcatggggagcactctcccgtggctgctgagtgaaggcaacagtgatgtccaaaacaagcccgtccggctctgaaccaccagttggcaggccaggatgactccagtctttagcaaagagctttccattctaactcccgaaatcccagaccagatggatgtctcctcccaactaggcgcagagggtagcacagacttccaaaaggaaacaccttcattaaatgcagcaggcagtcctatatgctgacccttgggtcaaaccacagcttaagcgggggaagaagtggttctgatccatgtacagccagatctgctgaggagtctggggttcccaggaaccagatttgcagatcctggacgatggtgcttcccttgctg

SEQ ID NO: 4524 - DNA, 11835 bp, Homo sapiens
atgctggcacccagagaaagacagagtcagagctgtctgtctttgcagacggccatgcagctgcaggtgtgggggctgctgaataaagccatgtctcatctacctgctgtctctctagtgttcttccagtttcctgccccacatccacccactcccctcagccctcagctggggctggaacctaaccctgagcatacttggtgtagtcagcaggatgaggtgagtaggtcttcagcccctgaggctcccgggttggctatgtggccacagcatgggctgtggtaccccgtggcagagatgctgctcgggtaggccccagtggaaacgtgggaggcagtgaatgggtctcccatgagtgtggagaagcatctggaagctcacagcaccaagaaggaatgacctttgccggcagagtcggatgggcgtttctgattcagtcagaaactgagtttcatgctcagtccctgcaggacacagcacagcagctgcagctgtgtggacagttagcacaagggcaggatgaccacacgttaatcgagtggctaatggcagccatatggactgtttggaatgacgccagaaagataccagaaactgtgagtaaatggcagtcatatactaatttggtgcagatactctgagagctgggtatgcagcaggctgtttgatctaaacacccggggaccagatgatgaacactttacctcgcacatgaggagtcttgtgctgggctcattgcccccgagtgcttttgactctctagctgctgttctcaccccatatgtggggtgccacatacatgaagtgactactgttatggcagtcctgggggaggcagaaggcatcagctggaccggggaacccgtgccagaaagaaggggaaggtgccccctccgcagataaccatcccatgtgataaaaagcagcctggcaggtgacctgcatgcagatgtggattgatttacttgcagctggggttgctccggagaaaactaacaggcaacccaatggaatgctcttggctctttggaggcaactgtccccagagcagcaattccggagaatgcttaaatggggggtgaagcaatgttgttcaacccactcccgcctggacaccgcaactcaaggactgtttgcagacaggcggagatatggagcctttcttgtttgattagggaactggctgagatatgcagctcggtgtggggaaccagacaaccagaggctgtatgtggtgctagtaatccgctggtccccgactaatgtacagtgggtcacagcgggtcctagcactggtagatactggtgcagactgcagcctagtttatgggaacccggataagttttctggcagagctgcatttattaccagctatgaaagctggtcagtgaaagtgaaacctgtgtctctttatcttggcatcagccacttggctctccgcctatacactgtgtatgtctctctcatacctgaatatattctggcagtggacattttgcatggtctggacttgcacaccatggctggagaattcaggctctgagttagtgcagtaaagctgatactgcagggacaatacacatcaccagcccaagctctgccacaaccccaacaggatacctccactcatcaatactgtttgtcaggggggcatacagccataactgagactattcagaagttagaggaggtgcaaatagtgcatggcacccatagcccctacaattccctggtatggccagtcagaaagcctgatggaactgggcgaataccagtggattatcgggaactgaataaagtaacaccctctcagcatgcagctgtaccctccatcatggatttgatgaaccgcttgacaacggaactgggacagtactactctgtgatgaatgtgaataatgcattcttctccactgacattgctccagagagccacgaacagcttgccttcatgggaggatgacaatggactttcacagtgttgctgcagggctagatgcatagccccaccatgtgtcatcgttttattgataatgtcatattaacctccgattatcttgcagatttgaaagcgacaatgcccctcttgcctgggattggatggtgaggttgagacagctgtcctggctatctcaagcaggctatttagcaggcacaagccctatgggtagttgatcagaggtgcccatttaggctagatgtgcatgtgaccacagatagtttcagttagggcctatagcagtgcacggagtgcttgagtatgccagtaggcttttggccccaactatggagctgagcttgtctttattgatagagaagcagttagtaatagcaggatgggtatgttcatggataatgaccccctggactgggaagcagttagtaactgcatatgctgcccttcagactcataagagcatggcagaacaggctacagtcatcatgcagatgacttacccaatagcaggatggctgctacgttcatgggtagcgacccttccagactgggacagcacagactgggacagcactttatcaaagtggggcacctacttagagcagtgaagtacactgaatacaagtcccttagcagcagagttacaagaggtcttagggcctgtagtcctcatgcaagataaggccatggagcctgaggcacccccggccccattcctgatgaggcataatatatagacaggtctagccagagtactgctgctgcctggattgctgctgcagtccagcctactactgacattatatggtttgataccaagagtgggcaaagtagctaataagttgagctcagggcaacacggatgaggatcaccaaggaggtgacacccatggtaatctacaccaatgctgggcagtttatcaacgcttaacattgtggttaattacctgaaagttacagaattagttagtcaccagcccatgtagggccaggccatgtggccagatctatgagaggaaggatgaccctctccaaccaggtatggggacaaacggcaatctgttattgcctgccccaatgcccctaaaggtagggaaacaaacaaacaaacaaaacctggtgttagccatggaccctccaagcccctcactgcagatggttggctatcatagcccccttgggggagggtctgcagtatgacttatatgttattccctgggtatttaatgtgtggcctccatgattgactgttcgtaggggaatagccaggaaaggaaccctcctctggtggggggaacatatgtactgtctgtgtggcctattatgagctcccttgtgactttggcatggatacaggacccaaaagaaccacaagcagctgataaggtgtggtaccatcacccagggcagaagcccttggcagctacattgttatctagagataaaagttggcttgcatttggcctaagggacatgatttacccttgttagtatctgtgcctactttgtcattctggccgtaggttggcatgctccaactgcattgtggactgggcccacacctacgctgaggtgaccaatgtctccaactgttggatctgtactacccttccagcagcagctgtggatggcttgccctggcacatgcacccagcttctgtgaaaaactggacacgactagaaacttgtggttccacagacaattggtgggatgcaacacggcaggctttggacagggggtgtcgcaaaacccatggcaagcctgccccctggctgactcgtagtgtctatgatgggtggggctggctaatgggagaacacgtggtgcccccatcgcaggtaccacgatgcatagagcagcactggggtgaagtcactgtgggatggtggcctgctgaggtttgtgcaaacataacatgtcaccacaccaagggtgttgtggaacaagcggccttaccaaggctgggctccaatggactttgtgccccctgagagtttatgggtctgtggggcccataaaccaaatggcgatatctaccagccaattggactggatgttttacttgggggtggttttctgtgcctgccactgtgcttcccacattgcctagttgcccgaataactgggaggcactgcgttcccagtttttgccaccctctggtggctccaccccttagcaataactatccctggagcaggtgtcgttactatagaaatgcaagttacagcccttgcagagcacacagctcgggccctgaattacacccgagttgctctccttttgctaactgatgaggttgatcagatcaggaaggtggtgctgcaaaatcggatggccttaaacatagtcacagttgctcagggtggcacctgtgcccttggagggacacaattttgtacatttatccctgacatccactagaacataatggtagctttacaaggggtgtcacaggagattaaggctattgagcaccttactgatgaccctctgcagagacagtgggtgcctctgggcactaccctatgctgggctctaataatcataggtaacgtaacaggaatatttatagtaggttgttgttctctgtattgttgttgtgacctatgagttcagggtgctgccctatgtgcatggatccccactaaaagaactccctcattccagggggtggaatgtaaggcctgtgtgccaagcctgtttatcaaactcgtgtgcccaaaacttatgtataaggccttgtgtgtgtatatcaagcctatgtacccaaagcttatgcatataacctgtatccaaggcctatgtctcccttggcctagggggtggagtgtaaggaacatggctgtgctttggttaaggataggccgaggtaggatgtttacatcctgtgtgactcagcaggtttagagcgcaggcatataactccacttgttatcacagccatgtagccatacatgggaaggccatcagttggctctatgccactattgtctgtaaaatgtatgattgccctgttgacgttgtgctggtgcactgggagagagagtcagagccgtcctttgcagacagacggtgggggagccaggacacagcttggctcacttgtgcccagagaaacagttaagctactgaccctgaagccaagggagagctggccatgcagctgcaggtgtgggggctgctgaataaggccatgtctcatctacctggtgtctctcgagtgttcttccagctccctgccccacatccacccactccctcagccctcagttgggctggaacctgacactgaacacgacaaaggctgacccccaaatggttttaaattacagtaaaacaaaaacctccttctaaaggccttaaaaattggataatgacttagtttcattcaaaggatagattttaaaagccccttatagccatagccagacctagagaccactcaaatccataatgatactggaattatagaattttagaactggaaagtatttagggggataaaaatccattaatctagtcattttacagaaaataaaatgagttccagaaaagtgaaattatttacaaaagtcacacagctaattagctattagagctaggactagaatttagttatcttgactcaagataacctgcttttgaagtatccttttattacttagttctgtgaccttgctgagattttcttatataaaagattggaaatatgtaaatatttaaattttattcttaaatactatttattaatacagagaaatactcctgctataattttaagtgacacaatagtacaacaattgttaagaacaatccacctgtgtcaaagagacacatacacaaacacacatccatatacacatacaagcttggagaaaattctgaaaggatctcattgtcctagatggtggcattatgggcaattattttgcaaatgtcacccagtgaagaagcaatggtgcctttggaaagtatgtagctcttagttaagcttttatctggaaggtgctggagaaggtctgggcacagagctggttggctccatggttttgtgacctgtgccatcacataggaccccatgttcagaaggaccccactcttggtttaatgctctgctgccgtgtcttgaaattcttaataatttttttgaacaagggatgctgcattttcactgtgttctgggcctaatgattatgtagtcaatcttgtctggcagctcttctctggcccattcactggtagatgattgtggggtggttatttctttaaatttttcatttaaaaaaaatcatattcatattattaaaaattaaaaaatagatttgcagaaaaattagatcacccttagaactctcaagggcagatacattttaactagcatctcttcacacatcacaatgatgcttggtgtttagtctgaaggataaaaaacaattcagtattttatagtataaattgctaaacacataattacaaaaaaagtatgcctgtgaaattaggctatctattccttgagagatggaattagatattagttttctattgccacaaatgtagcaatttaaagcaagagtttattatctcccagtttctgtaggtcataagtaaggccataatgtgactgggctctctgctcaaaggtctcaccaagctataatcaaggtgtcagcctggactgtgtttctcatctgaggcttgaggtcctcttccaagatcaagtggttgttggcagaattcatttccttgcaggactgaggtcccagtttccttgctggctgtcatccaggaactgctctcagctcctagaggttgcccacattccttactacatacctgcgtccatctttaagccagcaatggcctatatgcttcaactctctgactttctcttctgcaaccagccaagaaaattctttgcttttaaaaggctcatctgattagggcaggtccacctggataattaggtcaactgtgccataaaacgtaacctagtcaaggtagtagatacatcaaatttacagtaacagggtgtgtacagtgggggtaagtcttggggaccattttagaattctgcctactacaactgtcctaaagagactcatgtgacaaacaagaggtttctatactctacttctctatccaaccctatcatgactttaatagtcttttcagccaggcacagtgatgcccacctgtaatcccagcactttgggaggctgaggcaggaggattgcttgagattagcagtttgagactagcctgagcaatatagcgagaactttgtctctgctaaataaataaataaataaataaattgggcatggtggtgtgtccctgtattcccccagctacttgggagcagatactctagccccagtcaagctttcatatggcttcagccttagttaacatcttgacccattcttgatcctgagccagaactactgagctaaatgctcctgaattcctgacccacagaaactgagataactgtttatttttccaagctgttaagttttgcaataatttattgtgtagcaatagataattaacacaatcaaactaccaaagcttgctcaagaaaagcttcacaatgtcctatatccgtaaaagaaatggaattcgtggttaaaacctttcaacagagaaaactccaggtctggatagtttcactgttgtattctatcaagcatttaagaaagaaagaaaaaatgccagctattagcttaattgttgctcctttcaaagtaatatttcttttggcttctttatactttttccatctttggttatcagcagttttacaatggtgtaatttcatgtggttttcattttatttatcctgtttggggtttataagcgttcttgaatctgaagtttgatgtctttcaatttttttacaaagtttttaaatatattttttgtatttttttgtttgtttgttttacccaagtcctgcctcaggatctatctttcaattttgtaaagtttttaataattatcttttttttttcttttttttgagacagagtctcaatctgtcccccaggctgaagtgcagtggtgcaatctcggctcactgcaagcaagctccacctcccgggttcacaccattctcctgcctcagcctcccgagtagctgggaccacaggcgcccaccaccatacctggctaatttttttgtatttttagtagaggtggtgtttcaccatgttagccaggatggtctcgatctcctgaccttgtgatccacctgcctaggcctcccaaagtgctgagattacaggcatgagccaccacgcccagccaataattatctcttaaactattgcttatgtttcattttctctctcctctcttgggacataaatttcctctgttagatcttttactaaatctatgtctcaacttttgtatttttattattttgtctctctgcatcattctggatttttttttctaatttgtgttcattcaccaattctttcttcagctatgcctgttctgtcaattctatccatcagtctcctaatttcaagcatgctaattttcagttctagtgtttcctttaaaattttttttaaattgacacaaaataattgtacatatttatggcatatatggtgatatgttgatacatttactgcacagtgattagatcagggaaatcagcatattcttcaactcaaaacatttctcatttgtgttgggaacattcaatatcctctatttggaaatatatattattaactatagtcatcctacagtgcagaagaatgctagaacttatcccccccatctagctgtttcattttgtttttaatataattttcagttctttgccaaaattcttgtaagtttaattttctttttctttttttttttaagcttgtctctgaaaactccaatatctggaggtccctacagatgtttaaatagaagctcctgctggtattcactcatgtctctttctgtggctactttttattgtgtgttctacagtgtacctgcaaaactgtttatagatttattttgaggcctagtttgttagttttctacactgtgtaacaatattaccacaaatctggtgtgttaagaacaagacacatttattatctcacaggttctgtgggtcaggagtccaagcacagattagctggcttctttctgtttcctggtctcaaaagactgcaatcaaggtgttagccagagctaaggtctcagctagggctccactgaaccaggattcacttccaaaataacaaggttgttggcaatcttcagttcctggcacactactagaacaaggatctgttttcttgctgactactggctagaggccacccttagtttcttgccatgaggccctctccaaaggctggtttacatcatggcagcttgcttcttcaaagtcaacaagagtctcttaataagatgaacattagaatttgctgtaatcatgtccatctcatcatcttcgtggtagtctatggattagaatcaagtcatgggagtctccctccacacaaggaataccaggggacagggatcatagtggccaccttagagtctgtctgccacacctaggatgttaatttcttcctgaaaagcaaatgtagatttgcttctgccatgcatctgagagctctaaaaaccttagataacctcaatctaatttcagaaactgagggtatttgaagctgagctgccatccctttgaaggcctgcttacttctggaccactgttactcctaatgagtagccatttgggatcctcactccaagtaagggaaagggtttaccagtgcaggccccttcttccttgtcccataaggttgtcaaaatggccattcaacagctcagcaatcacttaccactcacagaattggccaacacaagggaaaacagctcccctaacaaagtttctgtttccttaggaattcttcattgttgccagctcgctgatgtcttcaaccaggtgtttttaattaatttatttttagtttatctttttttttttaagagatggggtctccctatgttgctgaggctgttctcaaactcctgagctcaagtgatcccctagccttgcctcccaaagtgctgggattaaaggtgtgagccaccgtgcccagcccagatgtttttaaaattttgttcagctgccagcttttctagatgttctcagtgaagatctaggacaaatttcttggtctaccatcattgtaaatgaaagcttttatttttatttattgtagagatgggggtctccctatattgcccaggctagttttgaactcctggcctcaagcgatcctcctactttggcttcccaaactgctgggattacaggtgtgcgccattgtgctcagcctacttttttatgtccagcatttggagagggccacatggcaagaaattcactcagcaagaaaacagattcttgttccagtagtttgctacgaactgaatattggcaacaactctgttattttggaagtgaatcctgcttcagtggagcctcagctgagacctcagctctgaacacatctgaaacacagatgtgtttcaacataatctaacctaaagcaaaacaaagatttttcaacctagaaaaaagattagagagtactaattatattgaatatttctatttctgaagctttccataatttggaaaataaaatattattaaatactgcatttttatggctaaaacatcaatctagaaattagcatggacttataaaacattttagatcagttgatattttgctaatatccctatatgaaagtcttaaatactgagtattcctgcaaattacatacagtattgaattgctcaaaactgcattgccaaatataaacaacacaccgattaaactagctactgtagttgtctatggtgctatgatatgaagttagaatatctgaaggacattaatatgtacttcacttcaaacggaaagcctgaaattgatgaaaacttcaacaatagatactgcatccctatctttaaaatacactggtttgggaggatattatataaatttggtagccttttattcttatgtgaataaagcatcagactttattttttaagatctgtaactactggatatacttttaaaataaatatctggctggccacagtggctcatgcctgtaatcccagaactttgggaaaccaaggcaggaggatcacttgaatctaagattttgagatctgtgcaaagtagtgagacctcatctctaacaaaaaataacaaaacattagctggcatgatggcacgagcctgtagtcctagctcctcaggaggctgaggtgcgagcatcacttgagcccaggcggttggggctgcaatgtgcggagatcaagtcactgcaatccaggctgggtgacagagaccttgtctcaaaaaaggaggaatatctaagagaataaaatatgcttacttgctccaggaataaattaaaaaatataaactatcaaccacctttagtggagaccactagctgtacctaactcaattctgtacttttttccccaacttttcctgggcacatgactacctggaatgaaagctatattttccatccttccttgctatttacaagtaaggcattatgactaagtttggccagtgacatttaaatagaagtgttgggtacaacttctgggaaatttctttagacaggggatgtaactttctcactgccctctttcttgctggccagagtgctgctgtgagggctagagcttcaccagcaaccttggatcatgggttgaatgccaagtgctgaggttggtagactaacacagcaaccctgaaatacttacctctggaattctttcatgtgagaggaaaaaaaaa

SEQ ID NO: 4525 - DNA, 2385 bp, Homo sapiens
actgtgcatccaggcacggaggatgttgcattcctgccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggtgcgtgtgctggccgggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgaggtacgttaacaaaaagttcatttgaggaaacagccattcacgaatgagaaacacccggtcctggcttgtggtttgtcaacggaaaaaaaacagactatgtaaaatacagaagtgtattcagagccgagtaggagagaccttggccgagggaaacacaaccccaagcagcctggagtaagtggtccggaggcggctcaggacagtttggttttattcatttcagagagacaggaattgcagggaaaatgatggatcaaggctggaaggtgtaaattccattggcagaaagggtgggacctgtggaaggggggttaggaggcacaggtggttgagggattctgtaggtggcagctggttgagagtgtgaagctttgtctaaagtttggaggaggtaggaaggaatgctgaaggaagggggtctgttatctgccacttcattccatcccagccaaaaaacagtcctgtttctctagattttatgaattctaagacgtaactttacctttgccttgcgtggccttaggtcttgtttgtaatttggtatcttgttgccacaaggagtctgtttttccagtcagagaatgtctgtttttacatgaatgtgcgtcagttgctgcatgtaaactcctaaagggagagggtataaggagacctgtctcacctcccatcctgtcatacagaggcactcaattttcagggtgttttgggggttcccttggccaagagccagtcacttcacttagctgggaaggtactttgtttgtttttgtttttgtttgagacggagtctccttctgtcgcccaggctggtgtgcaatggctcgatctcggctcactgcaacctctgccttctgggttcaagggattctcctgcctcagcctcctgagtagctgggattacaggcacgcaccaccacccccagctaattgttgtatttttagtagagatggggtttcaccatgttggccaggctgttctcaaactcctgacctcaagtgatccacccccctcggcctcccaaagtgctgggattacagatgtgagccacatcgccatgccagaagatatgtttttatttttgttttacatgtttaaggctaggcttttataaggtacatgaggagacaaaccagataaatgcttgattggttgcagagatgcagtcgccttatttggacttgtcaaccggaaataatcaaaaggttcagatttcagttggaagagtttattcaagcagaaagatagcaatgaccaaaacacagactccagaaaaatggactcagtactccaaaattggaagttatgttcttgcttatattactgaaaaaagaggtcctgatcagaccccaagagagttcttggatctcacacaggaaggaattcaagacgagtcacaaagtgcagtgcgaagagagtttattgaaagctactctgggccagcatgatggcttaggcctgtaatccaagcactttgggaggcccaggcgagaggatcacttgagctcaggagttcgagaccagcctgggcaacttagcgaaaccccgtctcttccaaaaataagaaaaattagccggatgtggtggcctgtgcctgtagtctcagttactcaggaggctgaggtgggacaatcacttgaacctgggaggcagaggttgcagcccagccgaggatgcgccactgcactccagcctgggtaacagagtgagaccccatctcaaaaaacaaaaacaaaacaaacaaacaaaaaagagttgaagaccaacctggccaacacagcgagaccctgtctctattt

SEQ ID NO: 4526 - DNA, 2814 bp, Homo sapiens
ctcacatgaatgtactaaatgtatccccaatgaaaaaaataaagcaatatttattgataaaatgctgtgtgccaaatactcttttaaaggttttatcttttattagcatttcatcctcacaaaaatactattaggtggtactgttattaccattttaaaaaccaaggcacaggggcatgttttgccaaacaccacataggcagaggtggaattatgagaattatattatttatatatatcataaagataggccaaggctggtctttcccatgttcattacattaacagaatcattttccgttacagtgctatataaagtgtggtccatgtgttgacactggcccacaaattgtttgcttctggtctctgcaaaagttatagataccaagagcaagtatttagaaatgtttgcagcaatctgacagagttaactcagttaaataccataataaaaaactggggcttttattttgtatgtctgtttttttcttttcatttttctggtaatctatttatttatttatttaagagacagagtcttgctctgttgcccaagctagagtgcagtggtgcgatctcagctcactgcaacctctgccacttaggttcatgcaattttcctgcctcagcctcctgagtagctgggattacaggcaccccccacaatgcctagctaatttgtgtattttagtagagaaggggtttcaccatgttggccaggctggtcttgaactcctgacctcaggtgatctgctcacctgggcctcccatagtgctgggattacaggtgtgagccactgtgcctggcccgcattttatttatttatttagagacaggatctcactctgtcaccaagctggagtgcagtggcacaatcatggctcactaaagccatgaggcagggtctcactatgttgcccaggctggtttcgaactcctgtctttccacagtgctgggattacaggtgtgagccacttcacctggcccattattattgcattttagagaagcactgttcaacaacagtttgtaggggaaaaggcccttgatggtttgggatgcagtgcatcagtatcaatcttctaaagtctaacagggactgagtgatgctatagtctttcgactctttaacatacgaaataatttctgataaattgtgagcatgaagtaaaagggattcccacatgttccgtaacaaacagaaaatttcttaaattacaaattctctgctaaagggcattttctaaaggccatcgtattctctttacattatgcataggacttcctcactaatatgatttctctgatgtaaagtaagttgatcactacgaataaaggcttttccacattctttacattgatagggtttttcaccagtatgaattctgtgatgtcgagtaagttctgaattaacactgaaggctttcccacattctttacatttatagggtttctcacccgtgtgaactatgtgatgtcgagtaagttctgcttgaagacgaaaggcattcccacattctttacagctataaggtttctcaccagtatgaagtctaaaatgttgagtaagatgataccgacgactaaaggtctttccacattccttacattcatatggaagctcaccagtgtgaattctttgatgtaatgtaagtcgataactgcaaataaaagcattcccacattcattacatatgtagggcttctcaccagtatggcctctgtgatgttgagtaagatgatagtgccgactaaacgtcttcccacattccgtacattcgtagggtttctcaccagtatgaattctgtgatgttgcgtgagatgagtgctacgaataaaggccttcccacattccttacattcatagggaatctcaccggtgtgagttctcagatgtaaagtaagttgataaccacaaataaaggccttcccacattccttacattcatagggtttctcaccagtatgagttctatgatgccgagtaagttccgtttgaagacgaaaggcttttccacattctctacattcatagggtttctcaccagtatgaattctacgatgtcgagcaagttctgcatgaaaactaaaggacttaccacattctttacattcgtagggtttttcaccagtatgaattttctgatgttgaacaaggtatgagccatgactaaaggccttcccacattcattacatttatagggtttgacaccagtatgaattttctgatgttgactaatatgtcgttgtaccctaaaggtcttgccacaaaccttacattcataaggcctctcaccagtatgaattctttgatgttcagttagttgataatgaagtctaaaggccttcccacattctttacattcataaggtctctctccagcatgaattgtctgatgtactctaaggtctctaacacgactaaaggctttcccacattccttacactcgtagggtttcacaccagaatgtattctctgatgttcagtaaggtgataatgaagtctaaaggccttcccacattctttacattcatagggtctctccccagcatggattgtgtgatgtactctaaggtctcccactcgacaaaaggcctttccacattccatacatttatagggtctctcaccagtgtgaattctcagatgttgaataaggtatgactgttgtctaaaggcctttctacattccttacattcatatgatttctctctagcatgaatttttggatgtagaggatgagatatttgtttttggattagcatttgactaacgcatcccatctgatgtctctcttgtctctcaaa

SEQ ID NO: 4527 - DNA, 550 bp, Homo sapiens
tcaggttcttacctattaacaagatcttacttaaaattacaggtcatgggcatcatcaacctagtccttgacttgcagctaaaaaaggcaaaaggtctgtgtgaagtgacagaagagcacaccctactcatgtcatgagcaaggaatcaaagtcgaagaacagtaacagtcttgacatcagcactgtaagaattactctgcagtaaactccaacccagaatggggaagaatactgaattagctgagcacattctggacacaattctgaccaatttcagtctcatgatctctgttggagcaggtttcattctccaattctcttttacagaacagcagaactcgagccttcataaaagtgattaacggcctttccgcttcttcatttttcctccagccaccttgttcctgacaccaatagcaccctctgtgtcatcattatctccagcatcctctcgcgagcgtttcttcttttctccatgctcccttaactcctgcaagaaaaaaagagaggatgggattgaaaatgaattactggcactgaaggttactc

SEQ ID NO: 4528 - DNA, 3912 bp, Homo sapiens
ccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaattagccgggcgtggcgatgcatgcctgtaatcccagctactcgggaggctgagccaggagaattgcttgaacccgggaggcggaggttgcagtgagccaagatcgcgccactacactccagtccgggcgacagagcaagagtccattcccccaccaccaaaaaaaaaaaaaaaagaaagaaagatgatgtgatacatatcacatatttcctaacacccccaaccaaacacatttatgcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaagccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtggcgcaatatgggctcactgcaacctccacctcctgggctcaagtgatcctcccatctcagaccctcaaggagctggggctacaggcacgtgccaccgtgtccggctaatttttgtattttttgtagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttcttttttttttttttt

SEQ ID NO: 4529 - DNA, 2165 bp, Homo sapiens
acaggagctgaatgtgacctacagctgggccacatgtggcatcacccccgacacaaggagtgagagccccagagacctcatctgacatgtggcaggctgtgatggctgccgatataaatgaggctgtgtgtgtccaggtcctattaattcatgttaaaaaattaaggagggctgggcatgatggctcacgcctataattccagcactttgggaggccgaggcaggaggataacttgagcccaggagtttgagaccagccctggcaacatagcaagatccctgcctctaaaaaaattaaaaaaaaaaaaaaatagcgcttggtggcatgcacttatagtcccagctgcttgggaggctgaggtgggaggatcacttgaacctaggaggttgaggctgcagtgagctcactgcactccagcctgggctacagagcaagactctgtctcagaaacaaaacaaaatgaaaaaattaaggaggcagctggccatgtagttgtgtagacaacacattcttcatgtctcaggaaccgggcagcagaatttttgctgttgcaggaatcttcccacctgttcttctgtggtcatttctgctccattctccattgccctctggcacactgagaaaccctttgacatggagacattcagaggcaaagtttggaaaataggactctaggacctccatacaagggtgagagaatttaattcaggttagaaatgtcgggatttgaggtccactggatttctatagctgcccatatgtcccccaacctctctgagtctatgcatttccatctataagcaggtggggtgacgatggccagataatctccaagagcccctctctgatgttctacaccatcttggaaacttttctttttcttttgagacagggtcttgctgtgtttcccagttttgccttgaactcctgggctcaagccatactcttaccttggcctcccgaagtgctgggattacaggcatgagccaccatcttggaatctaagaggatgggagctgctaacccaggaatggcagggaactcatcctcatccagactgagacatcagaccctccaaacttcaagtttccacagcactgaagctctgattaggaaaagccatggctttctggccaggataaccatgtcgtgtcacctgggtagcttattcaattgtgagtgtttaaagagcagtacaggcatgactcatcttcgtctccctcacagcaccagttgtgtggtgagcctgtaggagaattcgtgctgtctcctttgtagtgaaaacaaaaccaaagacaatctataagataccagcaagggaggagttaatgtaaatcatgatccagctgtaagcattagccattccattcatggtggagatctatccttaataacacagagagatgtctaccacatatttccaaagggatacattaatttcaggaccacacgaatggtcctgtgaggccatgtgtacctacaaacaatccacaaataagtaaggccatagttggtgacacatgttatgcaagggtaggttcacaaacccaacctcacttattcttgagcaacactaaggtatttatggcagagaatggttaccatcctcgccccctttttttttttttgagacagggtcttggtctgttgcccaggctggagtgcaatggtgtgatcttggttcaccgcaatctccacctcccagattctggtgatcctcctattcagtctcttaagtagctgagaccacaggcatgtgccaccacacgtggctaatttttgtattttttatagagacagggtttcgctatgttgcccaggctgatctccaactcctgagatgaagcaatcctcccaccttggcttcccaaagaccatcccccttctaaagctcgtctagaacttatccctggcaagtgaaatgattgtagcctacttccagaagacgtgtttaagaagtggtgtgccttctctcctgtccttcatctccgctgccagttggagtaacttcaaggtcccagggatggcagaacaacaacatggaagagacctgggtctctagatcacagaatgaagaaaagccacctaatgaccaggaaaacccttctcaaacctttttttttttttttttttgagacaaagtcttgctcagtcaccaggctgg

SEQ ID NO: 4530 - DNA, 18536 bp, Homo sapiens
acaaacgtattgtattttagacacattacaaccaggagaacaaactggaagctctataggtatgttctgaccattaaaatatctggacagtgttaaaaaaaaaatcaggagtttaacataaagctagttttccgccttgccctgaaaacctggatgatctggactctttgggtctctgttcccagatggtccccagcaggcagagccaggagggtggcccatcaggagtggcacggtccttccactgggcacatcccctccccaggccactgtactccttcattacctgcatggcccctgaagacactggagttgatgacttcctggagtggataaaatgggcttttgtgagctagcctgggaaccaagcagtatgtttgatattatttcattgcaaaagtggatctcagcttttaaagtaagcagatgttttaaatatcagcaatgcaaatttgggaatacttagcctcagctggaatgtgtgtgttctccatgatggactgtttctgatgcttttcctgtgctgtatcttggcttagcacttagtaggtacttaataaatgatttacctcaggtggtaaccaagcgcctgttgtccaccagctcccagggagtgaacagaaatgccatcttgctgtggactgggcctgtcagttccacctgagaccagatcgctgccagatttatctagaacatccactctagctctagataacagagattggaatgtgtcctctgcacagcttccctgtctggagagcgaggtaaagacctagaccccgtcgagttggccctaaagaggaaacaggacagggaggccggcatgaagccggcatgaagactgcttttctggctgttgcctgccgaactggagtttgtggccggtacacagtgcttgcattccacaccctgaacaagggcgggtcaaagttcagctcattcccctttaaagaaaaaaattctttgtctttggcatttcgaagttttgacccagatcagtcggaggccacggaatgctcatgaagtctggagagtttgtttagttcctgagtccggtagctgccgaggagccaaagagagccggcaacctgttgggcttgagctgaagccttgccttttcaagtttgtgctggcctggcctccccaagcctctgaggaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtaagtattcatctgcattcttttacattcctttatttcttcgaacatcagaaatgggtagatgtttattgagcccagccacctgctatgccttctccattcttctcccacacaccccacccttagtcctccagaagagaggactagattgattttctcatgctactggatagctgcagagaagctagaatttgctgttcagcccccacacatccccctcacatttgggagaagttgattttccctaaaatggagccaacagcctgtgtccctcagtgtggagtgttaatgggctgcctggaaggaccctgtgtgccctcacggcccccagccgggaagtgaggctccccattggctggcagtgggaggatggtccttgccagcacctagcatggttctctgccaagttctagctccacatctccaggctggtaggaacctagactatatatagcattgtgctaagcaattcttatcagacgtgtctgccctcccctgtgggagtggagcacttctatcagagaaccagaacctagagagcatgagccatctccaagggccttttattctgggaaggggtgtgtgtgtgtgtgtgtgtgtgtgtgtgtgtgtgtgtgtgtgtgtctgtctgtctggttcagggctgcttactttcctcctgtattgcagatgctgatagattgaaaggtcgtgctagatgaaggtgctgatgtgggatgagggccaggaagggctaatagctctgcgatggatattgagcttagagggagagaagctaggggcatgtgacatggctgagggtacagttgagccctgcctccgctttctcttcctggtttcctgtttgccatgctttgcctaaggatgtcttttgacctctctcttccttctttcggacctcttgcattccctgccttcctccaccacttcctcctccctttgattttctttaggatatatgagggcaaacacagtgactggcatcctgggtctgtgtctactcttcatccttacccatttggggtttctggagatctggctccagttgggcagagagggctcagctgtcctctggaggagttttggtggtgggtgagcatgttgtgttggctggttcagggcagggtgggttggatattcccctctttcctctcataggtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatcatgtctgtgtttttcatctattatttcccattcataattctgtgatgataagaagtgggtcctgaaaaattaattggctgtgcagatcttgcctacttcataaagaatttgaagtaggttacagccagccagacattaaaaatgaagcccattaagagaagaatgaaattctatgagccaagaaataaaatgagagaaaagattagggaagagaagaaatgttgaagatcaaggctgagggatgctccctactgaatgggaaaactccttagttccacatgggctgtagacacagcccttctgccagcaactgttcctgcaaggaactggtgctcaactaaacatactgtcacatggttccttgaaggggcacagcactgatttcacttgcattataaaagattgagtggtgcttttgactattagtttatgtcaacacttcaaaacaagatgagccagtttttttttgttttttttttttgtttgtttgtttgttttagacggagtctcaccctgtcacccaggctggagtgcaatggcactgtccccgctcactgcaacctccgcctcccgggttcaagcaattctgcctcagccttccgagtagctgggattacaggcgtggcacctccacgcccagctaatttctgtattttgtagtagagacggggtttcatcatgttggccaggcttgtctcgaactgctgaccccgtgatccacccacctcagcctcccaaagtgctgggattacaggcgtgaaccacctcgcctggcccagtgagccagttttgtaaagctattcagagattagccagatttgatttgataggggatcaagcttgtaggatcttcaggaaggcgggctgtggccccttgatcaggctttttgcacaggaggtgcatgactatgaactaccctcagtagaactcttttaagccagtggcttgcaataaatgatggcaaatcagccacctaggaagccatttctaagcccaaccccctgccacagtcttcctctagatggctgccctgcccagtgggctgagagtggggggcggaagtagcatttgctgggaagacttgccagtacatatgttgcaccccctcactgcagctgcagtgctatttcaggctgttgatggaagaacccatgttctaatccccaggatgtggtgggaagaccctaagtggtggtgttagttaagaccctaagttatattgttttgttcacttcccactgagataggctacaatagtattaaatacctataggtcagacatttttggggtctgttgtactacctaccaattaaacagtttttgatccgcccaccacgctcaaagctccagcctaggtgttgcaaatacagacgacagatttttgctctcaggaggccctgattccagtcctcaaacgaggctgtccgtctcccagatgctgctcttcagggctcctggcgccagtgctgaggtgacagagc

SEQ ID NO: 4531 - DNA, 787 bp, Homo sapiens
ctgagctgttccccagggtgacatcctcatgataaaatcggtacaggatcgggggagagcctctcagggactcacagtgaagctccagcaggtcccccaccacagtgtgggccctgggagccctgaaggagaccttagtggctgacagagaacctaaaccctggcttgcaactcgaggctgtgtgaaaggaatcggaacttacttctcacggtgactcgaatccacgtgctgaggatggggctgtgaacgttatcagctgcacagtagtatctccctgcatcactctccttcacggtgagaacatgcagctctgccaacagggaacgctgggtctttctacccaggcttcttactcttccttctttgtgccaggagaatgtgacagtccctgaaccctgggctactgagcaaataaggaccatattttctccttcaatcagctgccctccggtgggccggatctctagattcacattagacacagggactcctgggggaacacaagatggcatgtgaaggtcctgatggcagggacatcaaggtcaaggggaaggctggagctaccatgaataggccaatagcagcaggtgcagcaggcagaagcccaaagtaggaaataagaaattaattgtgtatacgattataaaggaagcaacatccctctcactcccacaacattcccatccttgagaaatgtgggcaccaagtccataatctccataaatccaatgttttctggtcacattttatatgcatttatctctaaggaatctttgatgcatcaat

SEQ ID NO: 4532 - DNA, 5578 bp, Homo sapiens
atcgcggggggcggggcgtcgcgggcacagcgtgagggccgccgttgctggagttcagcttagggaaggaggactctgaggaggccccgagcggcggagcgcttcgggggaggcgcccgcgcagacgcgaggcccatagccaggaccaccacctagctgttctacagtctggggacgacggtttaaaaatttatgccttgcatgcgatgtgcagtgggtgatggaagaacgtctacatggctttaaaattggatttaaaaggcaaatattttaaatgaaggaaaacccaagaagtttacttgattccttatcttccaggatgcgacttttgtttatttatttattttattttgatggagtctcgctgccgtcgcgcaggctggagtgcagtgacgcgatcttgacccgggaacctccacctcccgggttcaagcgattctccttcctcaaccacccgagtagctgggattacaggcgtgtgccaccatgcccggctaatttttgtgtttttagtagagaccggggaaggtatgggccctcttttgagaaaaatgcagagtgacactgaattttgtaactacatcaggaggctcttgaaccttctgcagctcactcgtggagtttgtagagatgcgtaataatccgaagtgttaaggaagaaggttctgttgagaaaaagttggagggctgaaagggatgcctttcgctatttcgacatgtgtggctgtaccccagagtgccctggctaacacgcaaaaccatgaattaggcggcttggcgaggctcagtggaggctggggccgagagtcatgtcaaagtttgtggggttaacctgcacccagtgacagtcatggcgaagtttgtgaggttaactcgcacccagtaacgctgttccaatgcaaggtgtgtatttggtgtcatccacgggaagaggaaacagcaaattttctcatggccttggcagttccacatgatggacatttcatatctgcagttttcttcgcatgagatggcttttttgcacaaaaacactggaatccagtgagcaagaatgatagaatgcaagatggatttccacatgaggaagtgtcacgaacaagcgttttgcatctctgtcagctggattcccccatgtgtacgtatgtgagaacatgccgtgtttcctgtctgtaatggtagaggcagccctgatactggattttcacctgaggatggatagatcttcagggttcaagtgggtttgcatctggactttagggtggccctgtaggccctgtgtgagaagcccccttcccagtgaactttcccttgtgtgcccgcgtggacagccaacagggggagcagtgcgagcgtgaaggcagacagtggcctggcccagtctgatggtaagtgggccagaggcagtgagtaccatttcttgatctgactactcaagacaggcgcttccctaggtactttcacacctcattgcgaggtacgtgttgttcccattttacaggtgcagaagctgagctgcagaggcgttaggtacctgcctcataagtggtagagactccagtgtcaccctgcccctcacgttcggagcccccgagggagggtctgccgggcagctcagcccagcactctgtaaggaaatcttcagtgccactgcccaggatgtcttcccggggattgggcctgaatgtcttgaccatgccgtgctggaggtaggaggggtgtcttcatatggaagaactgtacatatttctttggcagatggctgaactctgtgaccccggggcctgtttcagcctcctgctgtcagaaagcagctgtttgggaagaggctgtgattcggccttgtttgagggccgatactctgaatgggtgaggcttggaatcctccctttggaacaaagaaacataatgattttgctgaaggtagaattgggggactaggcagagtggcctcctgccctccctggggtggttctgtcttttgcaaaggtggctgcatccttaggggaaggtgaggggagaagcagggagcatggagagaagtggctttcgattttctctctccttttggggagttcctccttatgtggctggtctggtgcatagtgtgatgtattcctgtacgcaacgttgccctgacagccagtccaagctgagtctagagctggcaaggtgagctcccagtagtaagagggtgtgggcggcaagccacccaggcaccgaggcaagagacagaggacacgagctgttccagtataataaaatataaaacaagaatagttataccagatatagatcttagatatgattatatatgaatatcattaatcatgagtttgcagcaattactttttattccaatattatgataatcctcgctctataatcatagcctaggaaaaaccaggccatacagaggagctgaggggacatagtgaggtgtgaccagaagacaagagtgcgaggcttctgttatgcccggacagggccacaagagggctccttggtctagcggtgacgccagcgtctgggaagacgcccgttacccggcggatcgtggcccagtggtagcaaaaggtgtcaaggaacaacactcactacttagcagaccgggaaaggggcggggggggggtctccctttccccgggggagtttagaaaagactctgctcctccacctcttgtggagggcctgacatcagtcaggcttgcccgtagttatccggaggcctaactgtctccctgtgatgctgtgcttcagtggtcacactccttgtctgccttcatgttccatcctgtacacctggctctgccttctagatagcagtagtaaattagtgaaaatactaatagtccctgatatgcagaaataatggtataagctgtctttctctctgtctcctctccctctctgcctcggctgccaggcagggaagggccccctgtccagtggacacgtgacccacgtgaccttacctatcattggaggtgactcacattctttaccctgccccttctgtcttgtatccgataaataacagcgcagtcagacattcggggccactaccggtctccgcgcattggtggtagtggtcccccgggcccagctgccttttctcttatctctctgtcttgtgtctttatttctacactctctcatcgccacacacagggagagacccaccgaccctgtggggctggtccctacatctggcgctctgacgtggggctctccctcgctgtgtgaagttgcaccctgagtgcgggatcagcggaggagttcaacgagagattcctgaggattgcagtctataaacttggtggaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcggtaagtataccaccggtcggggcaactcaaaattatacttattgggcatatgttccttttccccttctaattcggtctgtctcctggagggactctccagtagaagtttacactaataatagtgcattcatgccgatccctaatgatgatcggtttccagctcaaccggaagaagaaggtatgcactttaatctgtcaattggctataaatatccaccattatgtattgggaagtcgcctggttgtttagcttattcttaacagaattggatgtggactgtaccgtcctttacaaatgattcttatcaagtatataatgtgttcagtactaactcttttcaacttctcactgtcaaacgtaccccacatgaggcatggagagttcctctcactaccaaaactaataaaacaaaaggactgccggactgtccaaagaaacctacaaatgggccttttatagtgacttcaattttatgggataattgtaatgctcccaaggctgttgtactccaaactctagccatgggtattgttattgattgggctccaaaaggacattattggcaagattgctccagcaaaaataccttatgctcggagtttatttattccttagattatatagagcatgggtggcagtcttacacgatgagacaacgggtgtctccttacccatttaaatggatggacacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataattatgatgcctgatgcacaaactatagaatgtcataactgtaagctgttcacttgcattgatgcaacttttaatcccactacaagtattctcttggtaagggctagggagggggtatggataccagtttctctacatcgtccatgggagtcttccccctctattcacatagtcaatgaagttcttaaagacatcctcaaaagaacaaagagatttatttttactcttattgcagtccttgcaggactacttgcggttactgcaacagcagcaactgctggagttgccatccgcagttctgttcaaactgctcactatgttgaagcatgccagaaaaattcctccagactttggaattctcaggcgcaaattgatcaaaaattagctaatcagattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcatga

SEQ ID NO: 4533 - DNA, 8849 bp, Homo sapiens
attgcagacccggaggccgtggctgtggttcgcggcggtgctgtcgcgggcgccctggcgcagcccacgcaggggctcctgagggtccgcgaggccgggaggtccgggggtcgggaggtcccggggtcgggaagtcggtggaccctgcaggccagtggggagggtacgcgagactgggggccgggagggctgacggctggtggcgcggggcgggtccgtggggaggaggcccggggctggtaggggcgggagggctggacggcgggggcggggcggaggagggggtccgtagacggggtcggcgccgggtgctctcgcccctctggagctggggtcggggcgggagccgcgcatgagagcctgggtttctagtcggggggcgccgtcgagctccacacctgcggcctcctgggtgcccccaaccctggagccccggcgagggggcacccgggctgaggcctggccctccaaggagccctggagggactgtgctgctagggcgcggggctcgatggggtgatctggagacctggggggatccggggctgccgcccctgcgctgccaacctcccaccccgccccttctgcgaggcgttattaaaggtctggtttcgggagccaggtgcgtgcccgccgccgccgctccccgcagcctccaggcagctcccgctgttccccgagggcaccagcactggccgaccgacctggcttggggcgcggcgctggcaaacccggccttctgaggggacgccacgctgactctagtgcaggcagcccccaaaacggtataattggacgaatttcttgaaggatgccagttaccaaaaaagaaaatactaatgcttattatctgttaaatttgagatcaatttgttatcaaattttctcacacagaaaattccaggcccagagggccaagctggtgaatcctacttagagaagaaataataggaatccagccactcagacgatggacgaggaggggcacttccctgctcgatggagacataagacatcagtcagtacatgtgaggtgtgcattggattgatccagaaagtcaggacgactccaagtggaaaggcctccaggtaataggtggattcaaagatgtttctgattggcagttggttgaaagaagttactatctgaaggcttggaatcaatagaaaggagtgtctgggttaagagaaggggctgtggagaccgaggtccttattatgtggatgaaatctcataggtgtccgccctcagaggcaatacatggcaaatgtttcctattcagaccttcaaaaggcactagactctcagccagtctcctcaggatcagaaaaagagctggaaagggaaggggagtctacagaatatgaatttccccacaagacaccgctttgcggggccatttcaaaatttgtcaaagagatatattttggggtaaaatacattgatactttgagggcctgttgtcacgtgatgctataccagcgtcagattggaacttggtgtcttgctgctatggagtctgctgtcagtctggtcagctgcacctgaactccaaagggagagacaggagacagtaaaagaaatggcctctctcctctgtcagagtggagtcccgagctcccagaaatgccacatgatggacaaacgcttgggggaaaaaaaaaaaaaaggagacctcagtcggacacaaaagcaggagctttaaaagaaaaaataagagataagttgaacttcaccaaaaaataagcgtttctggtctttgaaagacacttaaaatgaaaaggcaagccatcgatggggaaaatactcagaataatggatctgacagagggctgtatctagaatatatgaagatattttaaaatccagtaatttgacataaagatggtagccagcctgacacacaaaggaacccgaatggccaatggacaggaagggaacccgtatggccgatggacagaaagggaagtgaacgtgaacatctcattggggatgccgttatcaccactggaatagtcaaaaacatggacaccaagtattggtgggtgagtggaatggcgggaacccacatacacggtcgatgggagctgcaccctttggaaatcatttcacagtttgtgctccatcctggccaaacccacagctggagtctttccaaaaacagtgacgggagtttccaccagggagtgcctcaaaccatcccgagatggggctggttgggattccagggagaggcactcgttgccagggtgatccgtccagagcacttcctaggggatctggcataaggagggctgcagtgtatcctcaggacagataggacagatagtgtatctttgggacagacggcaagatggggattccacccaggtctgtctgcagcgagttgatatgagagtttaaggaatttggaccagggctgctttgtttcagggttttgggcaatgacctaaacacctttatcagtgcctgggaatgctcaaggcccagcttgagttcaggcctgcagggaaaacctgcaactggccgggctgcagagtggtcagggcacggaaagccagaagctggggacacacctgctgtatgatccagccgttcgtctttacctgggagaaatggcaccacctggctgaacataacttcttacactcccatgagtcctcctggacaggtgctgtgacctcgtgcagccttggggaccctgacactcccacggacaggccaaggggtttgcctgggccctgtgggcacagagccccttgagatgggtttccctatgcagccccccaccccccaccggggacccatggcactgcagccctcaccccccctctagggacccacaacactgcagccctcgcccccctccggggtcccacagcactgcagccctcgccccccatcggggacccacagcactgcagccacgcccaggccaccgcctccaaacacagggccgctgctgtttctgtgaacagatacttcttgcagatgtcaatggttaatggatggggaggtgaccgcccaagcagaagccgaccctcttcatgaaggggccacaggtcaccccgaagcagaaatccatagaacagccaaggccacagcggaaccgagcaggccacgcctctgcctctgggccgctcagggccaggcctccctgaccccactggctctattgtgaggactcagggtggagctctgctgggctcagtggccttcacagccggggtccacagacccgggtcctacgggcagtactgtgctcacctagaggccacggtccatgccctgtctccagcaggcccaagtcacttgtccatggcgaaggcccggccttgcttcaggccccgggcgcgctccccctgctccccctgcccaccgtttcttcccaggtgacagaggcgggagagcaggcgagccacgtgccgggcgccgcagcagggggcactccaggctggcgcccctctgcctctccgtgggctctgacctttcttctccctgcctgggcagcctccttcaggttggggagtcttttgttgacccctggattaaagtcctaatcaggaatgacccggaagaggtcttatgaggctttcctcaagagaagaaaatctgtccctgagtatcaggaagtggcccctttccctgcaccgcagtcttctgtgaccagcggctcacacagcgaaggaggggctggcggcccccacaggccactgccccgaggccgccacgagagggcaggagagcccttcctgggagctctgtgccacggggaaacgcagccccgccaagcacagcatggatgtttccagcagggaatgaagagagaggccccagcacatgagagaagagcacactgggcggcccctgtcggagcctctcctgtccccagcgacccctgagagcaggccctgggcctctgcggcccctcccggagccactcttcaactgctgacctgctcccagctcttctgtgccccgcccagctccctgcaaaacctcacctgaggggaaggaggccctgtttgggctcagacgcagcaggtgcagcttgtggtcctggggccacacctgttagagcccatccttctacccctgctgggccctgagtgtcgtccgtccccacagaactcagcagggtcaggtctgggcactccaggccgccagccccctgagtgagccctgggccggaggtagttgtgggtcacaggcaccccagccagaacacccacagtgggtagatgtgtggggaccggatgtgggtcctctcctgagagacgtgcagatggggagaggctgggcagttctcagcacagctggagcatctacctgtcaccacctcggagcctcctggccccgtgggggcggccctgggagcagggtcggcagtgaagagcagagaaaggcagttggggatgttgccactgtcccccgagaccaccctgccatggagacgagggagctgtcccttcgcggaagggggctggccagcaagaaggacagagagtggactggccgaggaccgctgagctcaggacccaaggaggactcttctaggagacgagagagcgaacgccagggaccctgtgcaggcctgctcctccgtttgcaaggtgagttaccaggttcacgtgtttggagtttctggactcattgcggagttccacccctgcacgttgcggttccccagtaatcaaatcctggcttttgtgcctggaagtgcacagggaggggacaactttgtgagtcagtggcagggcagggagttctggttctccagagccagaggccgtgctcagaaggatttcttagcaggagccttggggcccccagtcaacacttccctacggacagcctggccagctctgtgcacggagcaggcgcccgagggtcccaggtcaccaagtgaccaagtcgtgaaggcgcccagggtttcctgggggtgcgctgatcccaaggaagccacgtgtggtcagcatgggggaggggaccagcgccccggggggcctgcagcacagcagggcctgccctcctgggtgagactggccggtgcctgtggggatctggggggctacagtcagggctctgtgctcccgagggccacgccagcccacctgccctggaacagaacccgaggcttctgcctaggggagtacctgggcacctgcctcctgtgctgccctggacacatcccagcggctgcacataggggaggcacagcctgggctcagggccagggtccactctgtggggatactagacccgggggtgacaatgccagctcagaacttccccccacacctgggctcctccagcctggcctttcctggggaagggagggcctgtccttcctcagcactgtgggagggaggcaaggcctgcggttgaagcgtccccaacacggggctccaggagagaaagcaccacatctcagggaatgaaaacagagacggggccgcccagtgcactcggtggctcggaaatcattaaagaatgttctgagcccccgattttggctgtaaaagggactggccggcttgtgaccgctcccctgtctgtgccttgagacgggagtgttcagcgttgggggcagctttccctccaagaggagcttcacaaacatccgctctctgcggggccgcctctccgtggcctggggccgctgtcggaggaaggctctccagctgccgtcatctgggaaacgtggggggcgagcaggggtcatggatggggctcactggggactgtgagaatctgtcccgcaggactttctgggatggaaacgctggcagaggtgaagcctgcgtcatgtgcttcactgaacccggctgcttatttatgttcggagggctggtttcaaggactcctcgtctccctctccagtgatagcgtcagcggaaatgcagacggggacggggctgctgggtttcctccctggaatgaagcacagccggaggttttgctgattcaccagcaggccctgaccgctgagttcagggtaacaaatccacatggatcctgagcccgcatagctccctgggcctcagcataaacatcgtaaacctccgggccctggcagtgtctgtttcatcccctccagagcaagtgcaagtgtgagatttagagattctaagaggggaagggccagaggtcttgaaaacgaccttcattcgttcattcattcgagaagtttgcgagggcctccgtgtcctgcgtttagtggggcctaggacgcagatgtgaagggcgctgctctcaggagcagacagaggtggggatgaatcagtacacgcccacctcgggcccacaggggaggatgcgcggagctgtgggtgtggggaggagacccctctgcgtcatgctgacggtgtcggcagagtcgccagcttctgcaggagcggtacctgtgggttcttctgtgacttgtttaaccgcatcttttgcccagtagttagtcttttcctgttgggacaccatgttggtagtttggaaatggtttcttccatccattgcctgccttttagctttgtcgatggtgttctgttgtaaattttggtgcacgtttaatgtgaacaatggttatgagacgagtgccatgagttcctgtgtgcctgtcacccagcccggccacaagaggtgctgggggcagtgtccacacccccctttcttaggacgcctgagtctcagatgtgacttatagggtatttcttatggcaagacggttaaaacaaacttcagcgtctcgtctgtccttctatggctgtggcttctgatgttctaatggcgttctcgtcagccggggctgagaacaaaataacatagactgtggggcttaaacagcagaaacttacttcccacggttctggaggttgggagtcttggatcaccgtgtagcatggtcaggttcctggtgagggtgggattcctggctaacgtaacgaaggctccctctcctgataccgtgtcactgggggtgaggcttcaacacaggaattttggggggacacatcagcattcactccatcacaggtggttagccctttaatccgcgggaattttgtttggggttgtgtgagatacgggtctaacgttttctttttcaaatacgtagccagttgtcacatcatttattgaaaaaggaatcttttctccaccgactgacatgaaatgctaccatcatcgtaaataaaattcccgtaaatacttgctgtctctgctgtctcagtcctgactcacgggctgagttctctttctgcacagtagcactggcattaactgtgacagctttacagcaggctccctccccgaggccgttcagaagcattcctcagcgggtcctacacgtttcctctcccatgtcaagtttagaagcagtgtcaagacccacagcagtcctgcgggagttttaagggatgcacggagtttatggggacagtttggaaaattgacattcatgtgacttagagtcctactacttgaaaatggattccagctctcaacgaatttagagctttggcaaaatttttaagatttctttgatgtccgatgtgctcatttcttggtttgttcttgagtattttgtggatttttatgaaatccacaaagtttttgttataatgaatgggacactttcccataaaatgttgtaattctgtattgctgttttagtaaacactgttgattgatgtatattgatgttacacttggtcacttgtaatagtttgtccgttcattattttgaactttttaggtaaacagtcatataattatgcaaataattatagttgtgtctctgcctttctaatatttatactttgtgtatattatcatgttggccaggactcaagcgtctttctcttgtttctgactaatgcgaatgattctaatgcaggggtttccaaactggtggccggggggccaaatccagccaatggtctcttcttgtaaataaagttttattggaacacagttacacacatttttctacatattgtctgatggctactgtcacgccacagcaatgctgttaaatagtccagacagaggcggtattgcccgaaaaacctagaatattcaccatctgagcttttacgggaaaatttgctaatatctgttctcatgcattaaatacaatgtttgttacaggttaaggaagtttctgactatttttagctttctgaatatcttgtggttgtgtgtgctttaaaattaggactaaatattaaatttaccagttgcttgttaggggcctatcttttgagatgcccaaagtttcccttttttagtctcttcatgtagtgagttgtactaacagattctctaatgttgaaccgtctttgctttccggagatagactttacttgctcctggtggattggattctgtttgttaatacttttatttttgggtaattacatccctattataaataatatgtcagcatcattgtgtgtagatgtgtgtgtgttattcttgccattagtttctcaggtttttggttaactattgatatggtttggatctgtgtccccacccaaatccgatgttgaattgtaatccccagtgttggaggtgtggcctggtgggaggtggttggatcatgggagtgaatttctcatgaatggtttagtaccttcctcttggtactgttctcgcaatagtgagttctcgcgagatctggtcgtttaaatgtgtgtggcacctccctgaccctcctgcttttgctctggccatgtaagacgcaccagctcccctttcaccttctgccacgattgaaggtttcctgaggccgccccgaaggttcccatacagcctgcagaaccatgagccaatttaacctcttttcctt

SEQ ID NO: 4534 - DNA, 1836 bp, Homo sapiens
attaatctgatgcagcctccatggctcacatgatccccaccatgtatgaaatgggctgggcacccagggacaggctattctcagaatggggttattgggtgtgtttcttattcctctctacctagtattcttggaagaaggtgaatgaaaatgctctagtaggggagggaaacatgattaatgggtgggggcttatgagtcagaaagacccaaccatcacttctgccctgactgcctgtgtgacttcagaaatgggggatatcaaagcctatctcataggattaaacagtttaatgtgtataaaatgcctaacacagtgcttgccacataagcattgctcattaaatgtcttctcttcttgtgctcctcattcagtgtatagtaaatgtgcagtccttatcttttaaatgaatgaaacatctcattaccaaatctattcaaggtaaacattgatattaatatgtatcctttttgtgtgtttctagaatcctgttacacctgggatttaggcactttcaatctgaaaaaatacatatcctttcagcactctggacggacttgagaactgtccttacgtgacctaaagctggagtattttgagattggagaattaaggtaagcgactttatcttcctgatccttgtgaaaccaaaaatagcttttggagttgacgacctcctgcagcacagcttgggttgtggttcttgacctctcggtgtgtcttcctgtgccgctccaatgtgttcgggaagctggctccccataacctctccccgacctggttctcagagtctagtccacttattcattgtgcctaggaagctctccctctgtccctagtggagggaggagcccaccatctcctagtgaatgcgccacttgtagcagaaggtgcaggatgctccagctgtcttgtgaaaacatgtggagacagccttggggaaaagaggaaaaggtgaggtgagggttatataatcagattgaaacacctttgggacatccagaacatgagctcttcctcctttcccagccaatccgtgcttcctcctttcacctccttgaattctatgctccttccacactaaggctgagggtgcaggaggtaaagggttagaggttaagactgagtgcttcaggtagacttgggttttcttggttttgctacttgcctcattttggacaagtcactcagcctctcaaagccttggtctcctcattagtaaaatagggatggtattagtgcctgcctcatgaagatgttgtttgtgttgagtgagatattggagcaaaacagcttagcaggctgccttgcactgaggaagaaatgctccaaaagggctgatgggacctcagtcatgtggcagagaatctgaaagccagaagcttggcaggtctgtctcggggtggggtgacggagagacatttccctagaattcagctgctgggagcagaaagacagagcaggggcaagtgctgggtttctgaggcccgcagtcctgagcatggcctcaggcagtctgttctatgacagaacctgaagaaaggcccaggcatttgcatctatgtgtgcagttctacttgtcctaaaggcacttctcacactgggagcctgcctgtctgtacctgtctagaaatcagcctggctgggacgcacaccaataggagggcatcctcacctttcccacccatgagtcgggactgttgcctgctgtgcagcaaaggcaccaggaacacggagtcagacacttagggtctaccccaggctccacttcccactgcctatttgactctgggcaagtcttttacagcttttcaaacttctctctttcttaaaac

SEQ ID NO: 4535 - DNA, 5458 bp, Homo sapiens
agactttcctctctgaagacaagtaaactgcatattaaagcggactgtgacctcatagactgatgaaatttgaaacacttaagctacatatgctgcttctgggttatgtgttctgtgtcatatcttagacaatacatctttgatgatcgaaaacaacaacaacctgatacagttccttgcagttctaaaagcccaatagtccagaatacaaagtctctattatgttcttctctggataaaagaacttgtggactttataacataatccaagaatgaagaaaaaaaaaacaaccaaaacctacctttaggaacaaagagggcacatagcaggaagctgaaatacagaacgtcttctgagaacacagagaacatttagcaaaaagtggaaaatctgacaacactgtacagtcgcagtcttcctctccataacaataattttttctcctctcactaaaatagagcaatttttattgtcacaagcccatgtgtattactggcaatagggatatagctgtataggacacctccttaaacatctcctttattttaagattcagttagggggaaatgactagtttcccagcactttctggttaccatggatacctgtcatccacatccagagcctgcaggttacactcagggactcttgccagctcatgaataatatcgctgaagcccgctgccgctgcgatatgtacacatgtcttcccactctcatcatcatagttgattatggacggcccctggtgatggctcagaatgatggagcacagaatcctatttccactctggaaaagagagtcaaagaaagcccattatgtacaatccagtgttcttctctgtctaggcatgttaagataaaaatacaaaggaaaaaaaggaaagaaagaaagaaagaaaaaagatgaaaagagaaaaggaaatggaaaaaaaagaataaaaatacactctatctaagctctccaacaagtgtccacttgtctcaagtcactgcagagatttttgtctcccacaggagctaaattgtcttccataactagtgaacgaaggatggattgaaattaaatacaggtgcaatggactgacgtcagagctagagtgatcggtgggccacctagacaacaacttgctcattaggtctgatcatttgtgtccccatttgctgtagaggctgaccaccaagaaactgacagagttcatcttaatgttaaagaagtgactatgatgagtactgattggtggcgcagtgatgcacttaaaaagcttgtttcggggtagggccaaggagcagggggctgagaatttgtcccagggagcctgggaagcagaactgtctgagcagaggctacagtcttgtatcagacttcgtttacaaaaacaattaaaagataaagtgagaatttccagatggggactacagaacattatgccttaagcacagggtcccatctgagtaccagaccctctgtggctgcactggttacatatccataaagcaatctctggctacaaactttttctttctcttcctatcatcttcccttttgcgtcttcttcctccatccatctttcctttgtctaacaatgattttaaataactttgacccattgtttatattctatggcatgcctgtccttagaagtcagctaaagtttaggtgagcacacctaagctttcatgcctttatcaacttttctatgtttgtttcacttcatgctagttagacatacatcgaaggagtctgaaatacattttagatagtcaagagacacttttctttaaaagcagtagccattcaataaggaaaatagaagcaaaaagagtgtcagcacaacaattcttttttgtttacaatttcctggaagagtaaaggaattcaagctgtcaaggtggttcaaaggccaaaacaccctgttcatagtttcccctcttggtagaagaagaagcattaagtgcagatggagaaaacaaaaccccacactcgtactctcttcctttcgcctccctcgcccctggggtggagtcattctggaagtggtaaactgaaatagaggctgctgcttctgggatcctgccagccagtcccaggcagcaggtctcttggtagctggggtactgttgacagcctctctggataagtaaagacagactccatacctttactcttttccttttgtcctaaattctccaaacaattcctttgtctctatacctgaatctcacttatagcaccattgtttgtattttacttttctttgtaagaagatcctcccaggaagaatggtgacaactgtatttactgtgtgatcgtctgggcctggcacctttctaagccatttcatgtactaactcatgaacaacaatcccacaaggttggtactattattgtcctcatattgtacaggagacaatgaaggcataagggattaagaaatttgccctctgtcacggctgagaatgagcagatccaggattgactgtggaggcattggacttcaccactatactattctgtctgtgattaaaaagaatggtctattaatttgatcctgcatgttcatactggaggaactaaagtgaaaactgtttagacctacatcagtaccagtgacgtgtgcctcaccaactgagacctcctttacagttaatctttgggtactttaagagtttctcctagtaaggtttccatggtgcaccctcaggagaatttcagggagccttagaaaacactagtttgtaagtcaaggccctggatcacttgcctcctggtgacagaattcccttcttaacaatctagactgtgtgtcagccaaaaatatgcttaggcctgggaggtagggaaagtcacagagaccaggagacactagacaagaagaaatgggactgtggtccaggtgggtccttaggaagaatcgagagtaggtttacattgggtagaaatgttattaaatagggaaagaaacagtattgtacatatcctattcttaaggagctctagaattctacactgagctgccagatgatgattgtgagtttgtttttgttgtatttatttgtttttgttcatgagtaatccataacattgccttcatgtattctgaaaatgattgggaactgagtcctagtcgttttctctttacctgtcatgagtggggagagttggggaagcctgactcataagaagacttgccaagaagaaagtcgagttaatgtgtaataattttgctacgggcagattgataaaacaacaacaacaacaataagatctcaatatcctaactgtagacattctaggtgaccttcaaaggagtctagtgggcgatttaagactagttgcttatttgctaacatatgtctaaggaatatgttctatggtggtttcttcttggcaggaactccaatctccttccttctcttgaacactgggatgtgtttgcattgcttgtcttgtgatggtgaccatataaagcagaggccagtgctttagcctctgtgttgcagccgcttatccctcctaaaaagctgggaggttttgtgatgtgagaagatgatcctggctcatcggttggagccagacatgttagactagaatggagacaaaaggaacatctagagtctattccatgtgaatgtttgagggttgagggtctggggctaactagagaaagaaacgtgcctaatatccctggcttagaatctggactgccttcatggttagcccctttggaccaagcttttagttggcctggactccagaggctgccaagcccaaaagcctggggctgcctcttctggagagagagcagaagatagaaatagtgggagggggaaaaggtacctttttttaatataccagagcactctgttcttcttaataaagtctgtcctccggagaaactagttaaccagagcctaatctactgaggttttatcagagcctaattgaccttagggaagaaaagtgttcaactccatctagctctagctttccacatgggagcagaacaatacccaactccagcccactctagctatcctgtcccacctaagaaggggaaaaaacatcctgagaatcacttggaatattcacattccagaggcataggttcactaaaagacagggaccaaatcataggacgatatagtacatttctcttccccccatacttcaccattacattactaaagcgctatttacaggagttcctcttacccactacatcatgtctggctatcgagaaaaaattataaagcatgccaaaaggtgaataacacaatatctacagagcaagcatcagttccagacatggcagggatatgggaattatcagataaataatttaaagcaactatgattaatgtgctaagggctgtaaatggataaagtggacaacatgtcagaacagatgggcgatgtaagcaggaagatggagatcctaagagagaacaaataataaatgctggagataaaaaacactgtaatggaaatgaagaatgcctttgatgagcttatcagtagattggacacagctgagggaagagtctctgcgcttgagaagatctcaatgtaaacctccaaaactggaaaacaaaaagaacaaagactgaaaaaaacagaacagaatattcacagactgtgagagaactacaaaaggtgtaacatacaggcaataggaataccagaaggagaagagaaaaaggaacaggataaatatttgaaacaataataacaactgagaattttaccaaaaaaattgttagacacaaaagctcagagaacaccaagcacgataaatgccaaaaacaacaaaaaaaaacaacaaaacaaacaaaaaaccctatgcctaggcatattattttccaattacagaaaaccaaagataaagaaaaagtccagaaggaagccagaggaaaagaacaccttacctatagaggagcaaagagaaggattacctctgatttctcagaaaccatacaagcaagaagagactggagtgaaatacttaaagagttgagaaaagcctcccatcaacaagaattctgtaccttatgaaactgtccttcaaaagtgaaggagcaataaatactttcttagataaacaaaaattgagggaatttgttactggtagacctgcattgtactagatgttaaaagtagtttcttgacgggtgcggtggctcatgcctgtaatcccagcattttgggaggctgaggcaggtggatcacctgagatcaggagttcgagaccagcctgatcaatatggagaaaccccgtctctgctaaaaatacaaaaattagccgggtgtggtggtgcgtgcctgtgatcccagctactcggaaggctgagacaggagaatcgcttgaacccgggaggcagaggttgcagtgagccgagatcgcgccattgcactccagcctgggcaacagagcaagactccgtctcaaaaaaaaa

SEQ ID NO: 4536 - DNA, 1133 bp, Homo sapiens
acctctagccagggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgta

SEQ ID NO: 4537 - DNA, 1133 bp, Homo sapiens; identical to SEQ ID NO: 4536

SEQ ID NO: 4538 - DNA, 2044 bp, Homo sapiens
caaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtc

SEQ ID NO: 4539 - DNA, 1074 bp, Homo sapiens
taatgaaaatacagtggggggtccttaaggcatcattcagggtctacctttaagcgactccagctcttgaacttaatgaactggacactttcaagttctgaacatggtaaataaaagccagcacctgctgccaaaataccttgtctcataatcaaaatcatttctagagccagcggaacatggattccctgagaaattcccactgactcagcaattttaggttgggattttattttagagtcacttaacgaaaagatttcacctagtggcatggccccaatatttatcaggtaactctggccccatctcagcagactgactgattcaatcatcttaccctttactggggatgaaacgaaatgcttactaactcactcctgaccccacctgccactccaagtcattccagcaaacaaatccgtaatagattgctgagagggggaagataggtgaaattggagaatacactaaaaatcaactagttttaaacggtacgggtgggagccatgccccctctgtactggtccactttataaatcccagagggaactcattctatgcttgaaggaaaactttgccttgttctttggttagattgtgctgaacagatcaattcatgtcaaagagcatcaacttttcttatttatgccatggcttccataccacatcacactttatttactcttagtggaaccttgaatcaatgatcaattttgttttgtccttcagtggagtatcagacaccaggacaacctggtcagcaaatattctgaagtcctcagcagttattactagacaggatattagcatatggcacatcatggaattaatttatgtaacacatacttagcatgcacctatcaaatatgtatcaggcacagtgccacggccttaggatggagaagaaaaaacatagttcttgctctcagagagcttagatctagaagttgatagatgctgttttccaagtttctccacttgtatttctgaaactgtgaacagccaactgacatgtagtaagcaatcatttttccagaaaaagtctgttggggtgaaataacatgataagggatc

SEQ ID NO: 4540 - DNA, 368 bp, Homo sapiens
cctcagccttatagtgtgtgtggggggtggacgaggggtcatgaggacagggatggggctgggcgtctctggtaaggaccagtaagtgccaggcaggacgtactctgaaggctcagccgtggcccatctgggacacagccctgctcccgaaggggctccaggggaactgctcagccaggtgattcaccagggcacgggcaggccaggctgaacccggggccccagtgtgcgatgtggggaggtgactgggtgagcgtgaacagggcgtggggtgcgcggggcgggtggccgtgtgaccgtgcccggccctcagaagacgaagcagcgctccgtggggtggcccacgtggtccaggttgggaaggcagg

SEQ ID NO: 4541 - DNA, 2098 bp, Homo sapiens
gctccgccgaggcgacgggccgcgcagaactctggcggcggccgtggggctgctggagccgggcctggctgggatgaccgtgaccgtggcccccacgcacgcctagaccggaccccgggcggacgccgcctcctgggaccagattccaccgcagcggcggcgcggccgggagtcgcgcgggaagaaactgactcagcggactccgctgagtccacaggcccggagccccgcagcggaggcgcgcagtgcgcagcccggccggccaccctccgcgacccgccagccggggatcctgcggccccacggaaggtctgggaactgggagcaggaaaaatgaaagccgcctatctccagatctaagaatagaaatcagggcgctgggaaaagaggacaccgcccagatggccccttttaggaatacattgtctttagagttccacctatagggagatgagcaattttcccccaaaggatggaaagaggggttagccatcaaaactgcccccgctactcttttttatgattttttgtgactgttagtgggagaggaaataaacattgtttccctgtgagttatctgaagctctggtcaccaaaaggccactaaattaacttttggaaatttgagttgcactaggcaggatcctgatacttgggacacccgaaaagtaatcagctctcagagctattagagctgagacaaaggacagggtacatgaaatgaaaggtgaaaagttgagagaagcaaacctaaatactcttctcttggtattcagaaatacttatgagtatgggtgtctataaccccaaagttttttggttttgtcttttgattgtttgtttgtttgttctgttaagtacctaagtaatgtgtttttaggaaaagaaacctagcaagaacattgtagacaaggctaggcaaagatgatctatccttcaggtgatgtgtctgtcctcaagatcacttacaaagaagaggattggactggaagttactacttcacaattttagttttgttttcacatctgttacttcaatcctgatgacaattctgaaatggatacaactactactatgtatccttctttcactagtgaggaaattgagatttggaattgagaagtgaagagctttgctggagtcacacaggtgggaagttgagagccaggacttcaacccagcaaatctcctaactccaggtagaaggttcttcatgctctaccactttaataagaatgctctagactttgttaatacattagattagtaagatagcaaactcctactcaacctggatattgggtctatgtcttgttgttatagagtctttaacttttacagagacatgctaaaatatttatagttgaaatggttaggatttctttcaaagtcatccagtggtggaggaaaagatgaaatgtgtggagatagagataacgataacaacttttgaattgataattgttgaagataatatgagatgggttcatgtggtctgttctactattgtatctatataaaattttccataatttaacaaaaaactcccaatcttacaatatttatcagacctacagtgtattattttctaagttgtttctaaacttgtttccatttctgatgacttaatcaatgtctcaaacatttctaggcattctccatctcatgcattccttctgttcctctgcattagtttctcccttcctgttctactgaattacaaccttgcaagaaattaaaacctacctcccttccaaagaaaaataaatctaaattaaaagatgtctcctaatttccacaattcattcatccatctattgcctatttattatctactctatattggccagactgtgagtagacagtgtgaaaatatgaattatttgttgggagcattctcccatgaactactgcagtgttaaggtaaagtattctcttagttttcaaaaatgtttaattgattgactgaaattccaagatttatcaactcttcaagtagttaacaagactgaaaatgaagattaaggcatgaatttatgatggaagcagggttcagtggagaataaaatggtgctagaacatttggctaatttcctg

SEQ ID NO: 4542 - DNA, 302 bp, Homo sapiens
ccaggctggagtgcagtggctattcacaggctggagtgcagtggctattcacaggcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcgg

SEQ ID NO: 4543 - DNA, 2318 bp, Homo sapiens
gtttgagatacttttatatcaattctgttacactgagcctttagtcatactaagagaatgcagaagaagttataggaaaacgaatcttcactgaaactagtattatataatcttgaattagatgtttaaaaaactttatagcttgatataaaatgagttgaaaattattatttaataggaagcagcattagatttttgtcacctgttttcagataatatttctagtctatgtatgttatttaatttttacactttggcccattgtttattttccttaaggaattcatcaaatgcaatgaaatttgaataaaattgatcatagcaataaataatttttaaattcagcacaaactcatcttgagtatattatcaatcaggcttcctttagcaataagaatggtgaatcaacatccagtactaaattcaataaatgatgaatactttaaatacaagaaaaagttgaattgcagaaaagaagaggggctaaaaaggaagaaagttttaattctcaacaagaaacactatttagatggaaagcttaaatgtattcttattaagggtatttgatgatgcattttatttgcaaaaataaccagtgggtaattttttctctgaaaatttagctttaataagtcgtaaaatttcctaaagattttggagacgatatttcgattataccagctcttgcttttattttgggagcctggagaaatgagagtgattgcacctgtcaaattttgtatctcatcacttttggatcatcacactgtgactaaaatgacttcagcattttgttggccaccacagtgaagaactattccctgaaagttaatcagttgcctgagagacttttctgctactgaggggaaagaaaggaaagctttatttacctctaatgagctccgttccaagtcagttaatcactgttcccttacacccaagagtttcatcagtatcagagtcaacttgtcaaaacactggttctcagacgtttttttcagagggacttcttttccccacatggccagatttctttacaattaagaaaataagagctacagcgtattcttggttaaaaaccagtttagatgatgttaccaaatgaaaacaagtctgtattagcaaatgccacattatatttagtcgtattctcactaaattctccgttattaaaatgatttctgcatcttgcctggaaaatgcacttacatatttacaagcgttgtatgtcaatgtgcatgttttgaatttcctaacagtgtctaatcttagtagtttcatagtagttatgtaaaatctctttaactgcaaaatactataaaatattacttgaaatattaaagtattagtgccatttctagctgtggcaaggcacaagtcttactatagcttacttatgtcttctcatagatttcagtacagcatctgagtagtggatctgtttactgacagtatacacaaactaggtcttgacctcacttctttcttcatttaaaaggagaagatttgaaatagagctagtgtaaataataaataaaattatttaaatagcatcagtggctcaataccatctgttgaggaataaaataatttggttaacatacagaacatcgataatatacaataatgactttttaaaaaatgagtctgatctttttggctcacctagcttcccttaataagaaaatttgagaaacttggatctgaaaagtgtagttgtacttcctaacattaaattcctggctgtaatagttaatactttggcagcattatggttagtcttgtttatgccattggcacttactaggctaaactttctgaaactgattggttttgacctatgagataaggaaacatgcctaagaaatggctagaaatgctatttattgccctatgataagtgaaatagcaaatcactcttgattcttaaaatttcatattaaaattagctagttcctacatgcatgcgtgcacaagtatatgcagacacacacacaaatcagtaatctatgtgaactagatactaatactaaattactatttaaattgggtccagaaagatgctgttttgaaaagaacactaaaaatatttcattagcgttttcttgataacaaataggaaaatatatgtttacaccctgaataaattcagctgtgggtggatttttgtttttcaaaatgattttgttagtttgaatgaaacctaaatataacattcaagtcaattcttttaacatttttctttataacagaatatgaaaaacgctgtcttaaagtgttgtaacttttctgaattttcaataaaatattttgcttgc

SEQ ID NO: 4544 - DNA, 3322 bp, Homo sapiens
gttgctggaacctctgtgaaagcagaggaagctggaaaggatgtaatacagtagctgctgatgatcatcttgccaccatagggctctttcagatcttcaagaatgtttaagcatacaaagaagccccgagaccacaagggtgagaactaccatcctccccgctctccggatgctcccacagcctgggctccccagtgcagctggatcaccttctcctgctctcagacaatggagctcttggttctcaggcttttggactctaaggcttatatcaatagcctcccacccccagattctcagaccttaggccttggagtgggagttacaccactggcttccctgattctcaggctctcagacttcaactgaattacatcaccatctttcctggttcttcagcttgtaaatagtatgtcatgggacttcttggcctctgtaattgcatgaaacaattcccataataaatcttctctatatgtattgcattggttctgtttctctggagaactctgactaatataattcctaagagtggaatttctgggtcatatgtaattctatgtttagctttttgaggagccaccaaattgttttccacagcaacttccaacagtgacaagggtttcttttttcttttataggttcagtattctttattataaacaatcagacaacagtgtaagtgtgcatttgatggataaccgaagccaagttattataatagaaagcatgacttcgctcaaatagagtttctttgttgttgttgatctgttttacattaatttgaatttaacatatgctaggatcacctaaatttgtcatacagttctgctattaaaattgtaacagggaaagacaaaatgtgaaatgcatgttatattttgctttatttgttgaatatctatctatctatctacactaaatatttgggacacattcagagttaagcaggtgcttaaagtctatcaagtgatatttataaaatgtttttgttgctgttatgggaacatccatatccttagaagccaataaaaaagaggattctaaatgctaggtggttggctaaatgttcctgatttatactgagtgtaaaacaaaataaaacaaaacataaggtatatgtgttaagtagtgacatctacatagttccaaagcactggcaactattaaaatatcatccagctaaaacaaacttttcacaattttttttaacagaaaaataataaaccaacaacaaaaactggtaaatgttctgggtcttgtgagcagaccaaaatgttactacagtgttctctattgtgtgatcccagtgtacaagtttctatttctccatatccttatcaacatttgctattttccatgtttttgattatagttatcctagcgggtgtgaagtggtttatctcttgcaggtgttaagtggtatcccactgtggttttcatttgcatttctttagtaacaaatgatgctgaacatgctttcatgtgcttattggccatttgtatgtcttctctggagatatgtctattcaggttctttgcctatttcttaatttttttttttttttttgtggttgagttttaagtgttctttatatattctggatacaagtccattatttgcaaatactttctctcattttgtgggctgtgtttctactttctagataatatattttattgtgcaaatggttttactttttatgaagtctaatttatccatttcttccttttgttgctcatgcttttggtgtcaaatctaagaatccattgccaagtctgaggttataaatatttactcctatgtttttctctaaatagtttacccctatgttttcctcttgtatttgggtcattgatccattttgagttaatttttgtgtatggagtgaggtacgggtccagcttcattcttttgcctgtgattatgcagttgccccggcactgtttgttgaagagactattctttccccattgagttgtgctgaacacttattgaaaatcaattagccatagatatttatttctaggctgtcaattatattccactggtgtatatgtctgtccttatgtcagtaccacactggtttgattatagaagtttggagcatgtttggaaatctggaagcatgagccctgaaactttgtgtttctttttctttcttttttggtgtgtttctttttcaatagtattttgactacttggggttcattccagttccacataaatttgaggattagtttttctatttccttaggaaatgccattggaattttgataggggttgcattgaatctgtggatcatttgcaattaatattccaatacatcaacatgtgttgtcttccatttatttaggtcttctttaatttctttcagcaatgttttgtagttttcagcatagaagtctttctccttggtttaagtattttactcttttggatgctgttataaatggaattgttacttaatttcattttcagactgttcattgctgatgcatagaaaatggactttcgtgcactgatcttgcaatctgcaactatgttgaatttgtttattggctctagtagttgtgtgcattttggtattgttatattttctatacatagaattatttcatcttcaaatagagataactttactgcttcctttccagtttggaggctgtttattgctttttcttgcctaactgctctggctaggacttccagtacaatatttaatagtagtggtaaaaatgggcattcttgtcttgttcctgctcagtggggaagcttctgctcttttaccattgagtataatgtgagttgtgggttttgtgtaagtgacctttatcatgttaaggaagttctctgtattctgatttgttggtgagtgtttgtatcctgaaagtgtttgaagtgttgaattttgttgcatgcatttaatgtatctattgtgatatcatttccctctttacagagttgtgttacattgatggatttttttttttcttatgttgagccacccttgcatttctgggagaaatcccacttggtcatgatctataatcctttgaatgtgctactggatttggtttgctattttgttgaggattttttgagtctatattcataagatataccggacagtcgttttgtctgcctttgatatcaaggtaacggtggactcatagaatcatacctttgatatcaaggtaacggtggactcatagatattctgcatttatatttttgtaatcacaatttgtaaagaattctcaaaatccaacagtaagaaaacaaataatccaataaacaaaaaggcaaggactcttttt

SEQ ID NO: 4545 - DNA, 1119 bp, Homo sapiens
aactttcagggcgccaagtacgggtagcgcttctgatggattcccgggtctgggaggatccgattatcccggggccgggtgacacgcacaaagctgaggttagagttggccaggaagggaggacctggtgagccggtggaacaaaagcgggaaggcctttccttctaggagcaaaaccagcgacgcgtcccggacgcccggggacccctgtgggtctcggtttccttcgctgtgaccctgacatgtttccctccaccggcccgaggaaaccgtcgcttccagcctccaggtaccgtcacctctgcggggctgcgagcggaggaccgggacagagaaggagccggcggtcctggccagccgcgcggctcaaaacccgacggcgcggggactccgggcctggggcctccatggctgtggcctccttatctcccgggccggctgctccctacgctgcggggctgagggcactggggacccaggggcttctctggcactagcgaggacctaaccttgagtgaagaacgatgtcaagtgaaagtgaagaataacgggggtgggcgcgaagagaatggtcttggggcgcgcttgcgcctctacccgaggaccgaggtggggattcgacagacgccagcggtggggatccggggcgagaagccccgactttctgagtcgtgagccgcctccagtcgccccaggacgtaaccccgaggagctttcagacactggccgcgcctaatatcgctgagaaccgcgaaaaccggagttccggccgcctcccggactggcgtcccgaggccaggggacccgcttggggctcccggccgagccccgacctcggacgtttttccgggagccgcgagaggcctgggggcctgggccaggcgccgcggcgggcatcgatcgccggctcccagagagtggccccgcgcaggtggaggtgaccccgtcacctccaggagcgcccccaagccccggtacccgcagcgtgcgccctctcctcctccccgaaggttaagttcgtctttttcggttctcggttacgcatccccttggcacgcatgcccagccacaccgtgggcgaaactagagggcccgcgtcccctgggggctgccgcgggg

SEQ ID NO: 4546 - DNA, 872 bp, Homo sapiens
tagggctggtgttctagtcagttctgactgacttcaagcccagactctaaggcaagacactcaactgcatttagacaatgccagtttggacaaagggtggtcttgcatctccctttttgtagcaattctctcacagaagtatttttataactctgagaaatctttatatacatttctttatatcctttatattttctctccaggttaagccagcacttaacaccacatgaaattgaagttcatggaattcaaagacgaggcccaagaggcagcagcaaaggtcagcatctccaccaccccatcaggtcttgcccatgttgacccaggtgctgggacaggaggcacacactgaacttactgctcccgttgacttctcatctggttccaggtctccactttccaccccttttcctccacagactaaaagctaagtcattctgggtgtgacgtgtgtctagaaagagtgtgtctggcttcttgtttttaccacaaagtgtgcctgagatataggtctgtgccgccattttggctctcaagccagggaacctcttggtgttctcattttggaattttattctggaaagttcggaggacccagggactccttactgtgatacccgattctctggctttaatcaattattcattattcactcaggtacttaatgaacaactctcaatatctaattttgttccaggctttgaagagggtcagaaggatggaagacttggcccctcctctctagtagtgtacaccatgcctgaggagaccacatatcaacatggaacagccccggttagggcacaagggcgctggggcctggacagtcatgccatgggagctcagtgggaggctggacttaggctgaggt

SEQ ID NO: 4547 - DNA, 1052 bp, Homo sapiens
agtgtgagatgacgggaccagagcacgttcctggctgcagaggccacaagtcacgctgtctctgagagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttggg

SEQ ID NO: 4548 - DNA, 490 bp, Homo sapiens
ggactagtggcaaatgactaagacctggaaaagctgaaccctaaaaaaggcagtaagaaaagcctagaagcaacctacactgcacctcagtaaggttgatggtttgcccacaaagaaattttggaattctacttctctaaggacaaatacacacagatgcatatacaaggatatttactggagcattgtttataacagaaaaataccaaaaacatcctgaaatgattgaatacaaggaattggttaaataatttatatctactcaaccagtagaataccataaaatggtgacatagaaatgaagacaggttacctgattgatggctcccaacatctcagccctactggccactcgtgctgcacactggctaagaaactttatactcttctccagcttcttaatgatttcctgtgcctggttgtcatcttcacacagaggtgttaaagactgtatagaaaacagcatattaaaagatatctaacacaagca

SEQ ID NO: 4549 - DNA, 1690 bp, Homo sapiens
agaaagcccaattccatctggcccctgcaggttggctcagcactggggaatcagagtcccctccatgaccaaggcaccactccactgacagggtcacatctcccaggaagatctcacttccccacagaagctcttggcctggcctcctgcagtgccacgctccgtgtatttgacaagctgagttggacactccatgtggtagagtgtcagtttgtcaaataccccaagtgcggcacatgcttaccagctctaggccagggcagatgggatatgacgaatggactgccagctggatacaaggatgctcaccaagcaccaagttctcacaagttattttatgtgactttgcaggaactgaggcattatatctgaggacaccaggggaaaagtgtggcatctcagggaaatacagccctgggctgtgtctacacacaccatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctccccttttccacatgtcttttcctgtaggaacactttctccatttattcctgcctatccaattcttccctatatttcctggaccagctaaagtccagtgtttccagagacttttgaaagtcaacttacactttttccttcttcattcacaaagctcttcttccctgggccctggtatgtatgcctttctctcctactgtctaatagcacctcgtaaattgtcaatgaacttttctaaggggtattcttgaattcccaactagattgtgagcttctggaagacaaggctatgtctttgattgttgtctcccctaccacagcccagtactttagttacagaaaataataaatatttactgattgattgactttcctcttgtccactagctttaggtttgggggccaaattctaccctggattttgaaaaattcaaactgtgaacaccacaatgttatagagcatatgaggtagtagccagcatgaaggatgttttcttcctgagaaacagtgtcaagggctggaggaagagggcaaaatagcagactcagagggcaaataaattttggtattacttggtcacacaaggttatacaggtgttttcttgtaggatttttcagagcctttaatagtctaatgttgcattgagaatctcaaagaggaaaccatagaatgaggcatttgccatacctatctgatcatgaattttcttttcccccacagccttctcctgtgtcaatgtccaatgaagcacgatttgggaaactgtcctagagaaactttataccttcccgctcttctggagatcttttcctcttttcattcatctactttccccaaccagccatctgcctaagaaaggtcacatgttatcatctcatttttgtttagcctctgcagctgtggactatctttattacataggaattctttactagcttgtcctgtatttaaaaatattctaagttttgaggcaaagaagatccagatgctgcaataaatatatgcactgaggagtt

SEQ ID NO: 4550 - DNA, 2469 bp, Homo sapiens
gcattgtcataagctgggttttatttcaaactcaattatacaatgtagcaatagtaaatattaaaatgtaatgctaactcaaaacttgtagaatgccttcactgaattttggtataaagagtaaacaaaacttattctgcaaaaggattaggaacctttttatgcaaaaatgagtattttattttgtcagcactaaaagaaaaaaaaaaacaaaaccactgtatttctacattgaggtgaaaacaatgtttaaactttcttatcaatcaaatacattccaaaagaaagtgtgttctatgaaggttccaaaacacactcaaaacacaatagtacaggaatctaatactgaaaatgactgttctgacagggtgtttaacaaacataacttttaaattattaaaccagtgaagcaatcccttcctaataagtgtgtcaagagagtgaaactgggtttgttccattaataccctaacaatttcatcgtaatactttttactgctatgacagttttaaataaattttgctgtacttaaaataggttttgaaagtggaaaagtgtacaaagtttcagataaaaagattaataaatgcaatttaaataaaatttcccctcttctctcatatcaacaataatcaattttagcagataacagattgagctttaaaaccctactcccaaaatgaaaccttcagttttaaatcttaatcagacataactggaaaagattactatgtatttggacaccttttacaagattttgtttttgtattaaagcagaaaccagttcctaaactcttttattcaattgtatgtcctgtttggacaaatatcaaaaatagaagactgtcgcttttgtaactgtgattttcactgcagtcttctataacttttacagagttcatggtccctaatatctccccaccctccattttttctaggtggggaaatggctaccacagtaaacttttcactgatagttagagtttctggaaacatgtattgtttgttattatttaagagtgactcaatttgggcactctgagtggatggtctacaggttttcttgtgatgcataccacagtctccagcatgaaagatcctaggaatttgaggaaccagcactttccagaattttggaagacaagatacagtcaagtattgaagagtccagtcccagttataatcatcataagtacagaaagtgtctgtgcactcgatcagcttctgataggcattccgggtcaaggctagacccatattgtgctctgtggatttccaagttttcacatctaccttgtcagccatgccatagaaactgcgactggcactataggtccccagggagagaacatcacattcagggcactcttgctgcttcagtttccacatctttttgaagacatggtaaaagtctggggctaagtagtgatcctcttctaggaaaagtataaggccagcataatctcgaagaattttcactctttcccacacaaaatgcagcttccaccaccagtgatgtttggtctgggagaatttggcctctctataatggccgaaggagtcgggatactcagcattgatgcaccccaatttcaaagcggcattcttcggcaggtctctgggacaatctctagggtcactacctggaaactcgttagggtacaactgaatgctgaaaggaaagaacacctgcagaaccggacagaaattcaccccggcgatcagctgattgatctcggtcgaccagaagtcatggctaaagatgacgaggacgttgtcaattccctgggcttttcgaagtgagtccagcagcagtctgaggtattcgggccggttatgcacctggaccaccagcaccagctcccggggggcccaggtgccagccttatctacattcctcagggtctgatcaaagttcagctggtacaccagggaccggtaccgcagcgtcaggttgtccgcctcgggctgggggaccgccgggaccagggaagccgccgacacgttggagaccctgcggatgcccacagccacagaggggtggtccccaccgcggccgccggcaccccgcgcgggttcggcgtccagcaacggtggggcgagggcctcgttcttcctttgtcgcccattgctgctccagaggacgaagccgcaggcggccaccacgagcgtcaggattagcaccttccgtttgtagatgcggaacctcatggtctccagggccgggagcgcagctacagctcgagcatcggcgccgccgctaggagccgcggctcggcttcgtctccgtcctctccattcagcaccacgggtcccggaaaaagctcagccgcggtcccaaccgcaccctagcttcgttacctgcgcctccagcggccctgcgtcctctgcgctctcatccttacaggggccctagacggccagaactgagcgacgcggcctcgcctcactccggcggggaccgttat

SEQ ID NO: 4551 - DNA, 37852 bp, Homo sapiens
gcagagcggaggagcagcagctgccaccggccggaagcctgctggctcggccgagaacaatggccgcctgtcactgtggacagctgtctcccaggctaaggcaaggctgcgctcccagggaatgcgggcagggagccagggcggagggcagaggacgagagcgaggaggagagcgcgggcacccactgatgctggcggcctcgggtattcgctttctctctcttctcccaccttgttccttttccccggatgcacgcatgcactagtaatgccgaatttagaacaacagggaaaggaaaggaaatggcaaaggaagggaaaggaaatggccgacaggaaatggcaaggaagggaaaatccactgcaactctgctgcctgctggcctgtccagggacaactattcagctgggtgggacgttgctacccccttgtggcacccctgctgcagcctgcgattcttacgccctgtatttctggtctaacatcaaccaacactttggcgaaatataataaaatgaaattactaggagaatgaaagaaagtcacatgaaataaaagccctgctttttaatgattatatcctctgtgaaatggatctgcagccctctccatttctgggttcccctggccacaccatgcttatggctgtcccaggagcaggctgacagacaagcttccaccagcatctaaccatggggctcatggacaccgtagagcgtctccacccaacagaatcctgacttgggggcagctgaggcagggggcccgagcgttgaggggaccacgctgctgccccgagacctgctggcatgccacctggccaaccctgacttcgcctgcccgggcgcatgttaactgagttacaacactgagggcacttgaacctggctgcatgaccagagatcgatcacctgtgagatcctctgtgaaacgggataagcatctttaatttcctgggctgttctggaacttcagtcagacaggacacaggagggtgtctgcaccacccacccctgcctcgtgggctgactgggaactatatgacctgtggagggctgtgaccgccaccctccacctcactggggccgcaagccttctctgctccttgattctgctgccgttgtgagcgagggccccagcacccttagggaccccaatcaatgggcttcccacaatgtcgtcaccctttgttgcctgctaagcagccctggggccacctcagaagaaacagaactcacaggtcacaggggccttttcctcctcgtcatcgtcctcctcctcttcttcttcctccctgggcaacttcctgaattcggaaaggtggggttttgctatgttgtccaggctggtcttgaactcctgccctcaagtgatcctcccatctcagcctcccaaagccctgggataatggcgtgagccgccacacctggccgcctttggtctgtttgaagagggacatggcatgatcagatggggcttttaggcctctctgaccctggtgtggagggtgggctggcaagaaggggacgactgtctaaaggagagagtctaagacctgggctgggcagggccatggtgacaaacaggagcagacagagtcgggcagtataaatggaggggcagggacagtgttgaagtttctattctgagcaactagaaggctcgtggtacagttaattaccctgatggggatggaagagtcaggcaggggatgggcaatgggctctgtttccacagcgacttgtgttccacggaggtcaagaggcctgagggcctgcaagaacatggtctgggcaggagatggagctgcggaatgaatgaggatagggggctgagtcccacagggccagagcatggctagcaaagtggggatgactccaggagtggccttctgggtgccacgaaggaaatgttttaagaagtgagattgggtcactgctttcaatgtcatagaacagagctgagcagttgaggaggcgtagtgggtagaaagggaggtcgcagcaggctgaaagcaaaccgacaggagggttagcgtcttttagcaggtaggcagggcagaagagagccacggggcagatcagggaaagaaacactgaagccatctgtggctgagaaggagggcagtggggaggagtgtctaaaattctgagccatccctggcttttctgggcagaaggggtcgctccctcagtggccctatggcctctaacatgcattttgacccctggaatctgccttctcacccagtgggggccctggaagctggacaacacacattcacccctgtgtgcctgtccctgagagtgggggtcaggggagcatgcctggggtggcgaggtgattctgcactgggccgacactcccggctttaactggaaggcgaggaccttccaacagcacaggctgacaggtcttgttccatgggggctgggcacccaaggtatctactgatggtctgaggaatctaccgggatggattcctgatttttttttttttttttctgagacggagtttcgctctagttgcccaggctggagtgcaatggcgtgatctcagctcaccacaacctccacctctcgggttcaagtgattctcctgcctcagcctcctgagtagctgggattacaggcatgagccaccatgctcagcagattcgtgatttttaaaatgaaagggtgactcatgggagaagcctctggaactgcctttgaaaaacaaccagccaagacatgagaaattagttcctctgccatttgggggtttcctgccaactgctgggttttccttttgcacagcagggaggaaggacgcctgtttcccttggtcccggtgaggccaggcctcagcttcctgcccacccgccactgctgctggggcagggaggcagtttccggctgtggggacccagacaatgcctggccaagggccaccatcgtcctcttcctggacacagctcccgcctcatcccagggtctggcctgggacacgccctagaggccctcagccctgagtcactgcaccatgcagatccaccctgattctggtccctgcagagcaggctcctacacaaggcaagaagatgctccagggacaagccaaggtgtatgcaaggcccaggtgcctgagaaacacgtctcaccgaccttggggcaggggctgttacaagaggcttatagtctagtggcagagacaaaaaccacactcaaatcattagtgtacggtatgcactgctcagggactcaaatatgtgacaggaggctccaaacaagagcggagacaaggcgtaaatagccccctgtggactggatgttctgactcctggatggcctccagaaggatgccttttacggtctgtgaaagagctcagggaccaagatgctcaaagcccttcatgcccaagagcccctcctcaggctgggacacgggaagcagagctcggaggtggaactcgtgactgtgtatgggcacatgtgagtgcgtgtgtgtggacagccaggcttagtgtagacaacgtgtgaggctcagaccccaagtgctgactacacctatgcacatccacacctgcgtgtgaaagaagatgctagaaaagaacaaaaataacttaaaaaataaatccaataagatggctggaacatataacaacttcaaatactccattttagttcaccatgtaaggtgggttcctgggggctgaggagactcgggagctctgcacccctcctgctcgcacccatcactaggtggctcacacagcagccgctcaacaagtctggctgctctcgcatcaaaaccaaaacccactgccctcccctgcgcccccagcactgaccccaacactttggttcggggccctcctgggcaggtcacctgcactgcctactcactcctcagccctccaggccctcccaccttggatccttccctgggaccctgctctgcgcccttctccccctgcccaggaactgaaggctgatgttgtcaccccggtgctgcggcctgtccgtcttcagcacctgtgccccacgcaggcccagcaaacccctgggctctgttgttccccgggatggcttttccatctgatccccagcttggggctggcaccgcttggctttgcccggtcacctcatgcttgggccaaagtgcaccaacccttctgtcccgggcctggctttttgcctcaaggcagcaatggccccatgccacctccacgaagacccagtggctgcagaactccctggtctggactcccctgctccctgcagagtgccacctgctcctctcaagaaggcagaacgtgaggcctttcctcacctcccgtgcattggcacccctgctgggcccactctgctccaccactgggggctgattcactttgtgccacatatctaaaatatttcctcaaaacaagccaataacaccctttgcgcatgccatgacctcatggagcgtggtcaccggacatttcctcctgagctctaggcagctgtgggggatgctgggtggcatagcccttgcatgtggctgacacttagcaatgtttgtgcccatgttgcacagggagagcacaagtcactgactctgctagggcctggggtcaaggaaaataggcccttggtgggtgtcaggaacagagttgattcgctgcaaggggcaaaggaagtgcacacttgggggatactgaggcagccaccgaggatggtggctctgtcagagggagctatggctgagggcctgtcatggcttcaggtgatatttcaggtgatttgggtgatgctgggactggggaccatgcgcacatcccctcagcaagggactaggttcacagaaacagcacgcggcccaccagcctgctcacctccatgagctgtcccctgtgccagacagacagcctaactccaagaccctgtctgagcagagagggttcgagaaaagaccttgtccttcaccatctttcatgggacaaatgcttccagaatgaatgaataaatgaaggggagggcaagggtcttccaaggaaaggacctctgagttcagcctaggcgacagctacacactgtctgccggtggacacccaactctctatcttccccgaaatctgctcggctagttgtgctacctctctgtgcctcagcttcctcacctgtggaagggggacagtgccagctatctctcagatcgtggtggctggggtgccatgtggctctgccactccttgactgtaaggcctcaggccagcctcttcatctacccacctctgcctcctcgtccatcacacggatcggaaacaggacgtactgcttatcagctgctatgcaataaattgtgttccctaaaaggtatgttgaagccccagccccctgtggctcagaatatgatcttatttggagttaaagtctttgcaaatgtaattagttatgttcacatgaggtcacattggctggagtggctcatgcctgtaatcccagcatttagggaggcaaaaacatgaggatccatggagcccagaaattcgagaccagcctgggcagcatagcgagaccccattctccacaaaaagaaagatgagatcacactgtaggagggcagcccctggtccaaaatgcccatgtccttacaagaggaggagtcacagacacacagcaggcagggtggggaggtgtgaaggcacagacacacacatggggagatgccgtgtgcaacaaggccagctaggaggaatgagtctacaagccaaggacctccaggaagtcaaggccaggcactaacagaaaggcagactcttccctgcagcctttgagagagcatggcgcagctgccaccttgatcttggactctggcctccagccctgtgaaagaatgagctttggctgtgttgagtgcccagtgtgtggtgctttgccatagcagccacgggagttccacatggtgctgcatagggatccggggctgcagatccccgtgtggggctggacgtgtaggggagcagcagccacatcccttgtcggccctggtgccgtgcccttactccccgtcccctttgggggtgcacaggcctacctgctgcccagaaagcccatggccagctcagccagctcgccctccacctcctcctggctgagcaccgtccctggggccttccatggcagagggtcctctgggttcagcagggctgggaagtcttgcaggagcgtgtccaggaagcctggggtctcctcagctccactggccattgggctgctcttctgtggggctccagaggacatgcccaaagcatcccgggggcctgcagctaggccagggcaagagggtctccaggcttcaccctggggagaaatgtcagagtcagcagaatcagggggccatggcaccagcaatgcaggtgcccacctgcaagcaccatgtggcaggtgcatggcctcatggttcagggccactagagggtggagggacaaccctggccactgttttgacatgagtccaggtggggacttgtgggcatccagagatccggtctcaggagatggtgccaggagcagcagctgggtggacattgtcaagaagtgacagaggaggaagactgttcctggcagagggtggccagcgtggccagagacgagcaggacagggatgccgaggccaggcactgaggtaggtgagggggttcaacctgatcacgggtcccgagcagccaggagggctctgaggtgagggagtgaagccaccaggtctgtgagcctggacgtggtgaccagatggcaggagggacacctgttggggctctagtggtgttcaggggaggaaagagaagggccaagatgcgggaggccggcccagggctgttttggagataggccagagtgggagcaggaagggatccccagaggctgctggggccacccaaggggtggccaggagagaagcagaggtttaatctgggacagacaggaggtgctgtgggacaccatcgagcctattcaatgctctctaataggaggagggaattgtgagcctagaatggctcaggcctgctaagccctggctggaagaggggcactgtggacagttccaggcgctgaccccactgtgcggcatgtgggctcttcctccctaagtccttagggatgaccagagctgaccagccctgggagttgcccctaacaccccaggagccaggacaagcccccatttcacagatgagaatcccaaggtttggagagggttagtccctcgcctgaggtgtcagaaggaagacagggccaaagagggatcgcaaagcctgtgccttcactccctcaccggcttctctctcactggaaagaggcacatggtgcctcacagcctcctcccagggtggctctggctcctcttctctcctaactccgaatctccatagtcgcctccccagcctgcctgccttgcctatacccaaacagctctccagcgcccccccttccatgttctttgcgtcgccccggggattcacctccaggccccacacctgggcctccctgccagcacccactcagcatggacccttctctctcctgcccccttcctctcgggtgcctgacccctccaaaccctccccacagcggggactccaccttgggctttgtctaacactcaggctgggaaactttattcagcgagtcctacgcagtagtggatgagattggatccagaaaaaaataaaaaagaaatcctacacagttactaagccagggagaaaaactgcattcttttatggtgacaaacggacatgagactctgaggaacaccccgagttctagggtggagaatttggggaacagtttcacagcccatcaccttcatgaggacttccaggttctgaaaactgaacgaagaaggcaaggagaatcttctagaatcatcagtcttagaatagccacagactctgcctacaaactttgctaaaagggcggctgtggcaggggcctgaggtgcaggatgaagagagtgggaagtaagagatgcagggagctcacagcccacaagagggctgtccttatcaggaattgctaacttggaacaagccttctggaagcctaaagataaaaaacacaaaagagaatggggtgggcagagggaaaggtcccagcaccaagttaaatgtctgatcagtgagggatttggaatgcaaggggtgaagggtggtaaattaacaaaacacaaaacccttctcttcttttagaggcagaattgaaaggtaatttatttaaagtggacacatacaaataacgtaggaataggggtgcttgctactgaaggttctggggatagactaaatttattgctatggttcacatttactcacaagtaggagtaaatttaatgcaacccaggttacagaaggcaagcaggtaaaaggataaagaacataaaacaactggcaaggcgctgtggctcaggtctatatctcagcgcttggggagggtgaggcaggaggagtgcttgaggccaggagttcaagaccagcctgggcagtgagatcgccaccccccccccaccccccatctctaccaaaaaagaaaaaaaaagaacataaagcaaaaaaggaaaaatcactttgagagcaggagggacactgacattcaaacgacaaagggaagactgtgagctggagaaatgagcagaggctgggagccctagtaggtcaatgaggaggcggcacgtcctgccagccatgccccagcagagctgtaaggcattcgaagatggcgtgaatttcccagcaagcttggctgccctcaagcagtgcaagcggccaagggcccctcttctgcctgggactgccctggcccctggagcttctgggagaatgtgaacgatgcagagctgcccccagcaactgccagtgcctggggcctcctcccactcccttgcaattccaagtgatctggaggctctactgtctcaccacaaaatgtgctcatgtgaatttatgattaggatccaagtgagaggacagcatgctccccgctagagcacacagagggcccccctggagaaacccctgcccacagtgtaaagccccactgtcaagggcagaattcaagacccttcacttccaccccatttgctggtgacgtctgctggaccttttgggatgcaggtgcctccttcttgcctcctgaccttggggtactctttcctgtgccgtgagcccctccccacaatcggcctgttccctcagggagggtggctcctcctgtctgcactacagaccctgattcactgtggccacctgcctgctctctctgtgccttgtgcccactatctgcacatgcctcaatggtgtctgtgccatgtgtactaagtaaggtctggggggtgtgatgatgtgtgtgtgtgaagctctgtctgcatctgtagaggggacaggctggcttactctcagggcctgtgccaactgcctgctcttgttacaaaggcagggtgcccagggccatcttacttgctggggaccaagcacccttgtttctgcatcaccaacctaaggcaaggggtgaggagagaaaccaggacacagctttctctccctggagcccagatgtcgaaagggacaggaatcatttccttccttttcccaataagctcctgaatctgacgtacaccatggcacacccggcaggaaggagaaattcctcaccaagggaaaccagaggcagccctgggagtgcctggaggggcaggggacagtgctgtggttctttgagggatcaactggaagagacagcatcaggaatggcatggaggccagcggcaagccgcagggagtagggagagctgggagagcaccagaggcagcggagcctggtgctgggctttcctgagcagggcacaccagtgaaaaactccgaataagagggacgtgtgcatgagcctgtgcaaatcaccaagagcccggggtgggcatgggagggacattggactcctgcatcccagcaccgcctgcctggaccagtctgaccaaatgcgactggcagctggttcctcctggatcagggccccactgcacaccaaatgggtgctcaccctcctagaacctatttaaggtcccacataggtgagaaatggcaaagcaaactcatcggggggcagctgcaggggtgtggctgacggtgctgccagctgccatccgcccctgctctgagcactcttcctgggatggcttttagcctcccaacaacctcttgtggttatccccacttcacagggcaggctgtagcagaagagctaaggaacttgcccaaagtcccagggtggggttcatgctggggaacctgggccttaactgtgatgacacctgggaagtcattctgactccttctatccctgacctgtccctcattggccaccagctctgggctttggctctctcatggctcctccttccatttctgtgtaccccccaccctagggcagcccctcccctccttgttttgtggtgccctccttccattttgcctcccgagatctctcagatcctttgaggctttgctgaaatctccccatctttggatccagcatgctctctttcatgtctctatggcacttttgctcacatctgacttgtaaaaagtttttttttttttaatttaaaatatttattttcctctagtgcattagttttgactcctaagcttaacgaatgcagggtttaacaactgcagttttttaggggacatagaaaaaatacttgttgagtcttgcttaactgcagaaccaaggtaatgaaaaaaacccagcaatccttagaaaagggaactgcaccactatagtgtaacaaaagcatcattcatgttaactgtttttttttgtttttgttttttttgagacagagtcttgctctgtcacccaggccggagtgcagtggcgcaatcttggctcacggcaacctccgcctctcaggttcaagtgattctcctgcctaagcctccctagtagctgggattacaggcacccacaaccacgcctggctaatttttttgtatttttagtagagatggggtttcaccatgttggccaggctggtctcgaactcctgacctcaggtgatctgcccgcctcagcctcccaaagtgctgtgattacaggtatgagacaccacgcctggccaacctttttctaccaaaagagattcttatttctttattcataactactaatactaataatagttagatgtaaatcctagattttttttctacatatataaattttttttattgttgtaaaatatacacactatgtatccttttaaccatttctaagcgtacagttccatggcattaagcatagtcacattgctgtgcaatgaccatttctttctacaggcctgactttcttgatagactgtaagctccctgtagtcagggagcccacgatggccctttgtgtacagcaggtggtaagtgtgatggcagagggaagagtgactggcgggtggcatgggctgaggaagctacaccactctgaagggtgcagtgggcagcagcgccaggtcttaaaagactcggttggcttcaggtcagatggtatcctttttttttttttttttttttttgagagggagtttcgctcttgttgcccaggctggagtgcaatggtgggatctcagctcactgcaaccttcgcctcccaggttcaagcaattctcctgcctcagcctcctgagtagctaggattacaggcacctgccaccacgcgcggctaatttttgtatttttagtagagatgggattttgccatgctggtctggaactcttgacctcaggtgatatgcctgcctcggcctcccaaagtgctgggattacaggtatgagccaccgcgcccggccttcagggggtatcttaaaggaattccacaaatgaacttgtgtagaggttcatggctttcagaaatgcattcgttttgtttacctctcacaactacgctgagaagtacatactgtcaggctacactgcagatgaagaaataggttataggagggcaagcacccatttaaggtctcacacaggtgaaagggcaaagcgaactcaatcaaggtctctggatgcccaatgcctttggtatttccacctcgcgtgcaggaggaaaagagcgaaatttgacaacagaagagactggagatggcctcagagtgctggccggccccactttctatcccccgtggtgagagctcagctgggcccagagaacttgtcccggggaatgccaccacgacatgtgtgactctgtcccgcagggtggaaggcttcgaaggagcccgccaccatgcagtgggcctcactgtgtgtcaagcgctgtgccgaaatccctgcagccggagccagttcttcctgttgtacagacaggttcaggggcttgcctgaccgaacccagcggcaatgtgcccggcctccgcgcctgaggctctggctcacagacctgtggctgaagcagctgcagcccgagcacttgtgcagctgacgctcgcttcacggacgcttgggaggccgcggagccgggggccatcaggcagactgggcccctgaaggtgcagggactggggggatatggggcaacgtgccggcccagaggctcctggggggtggggagaggccaaatctcggaaaatggggcgcgtccccctcagcacccgattctgcctcatagccctcggtccctaccaggccctcggctcggccacacccccgcctgccccccagttctgcccccttggctccccagccccccaactcccagcctcgggttcctcatgtccgcagcggcccctcttgctcctcggccccccgcactgcacccccgcaccctttcggtgcacccatgtgagcctcgtctcggcctccttgcctccccagccctctgattccacccctccggttcctcggtcccatttcacccctgtgcgccttgggcgctcgcctgaccctcgtcccagccccgtcagccctctaatcccgtcccccccggcctcctcacccctggtctccgcgggcctcagctgtctcctcgcggctccgtgtcccgcaagctgctgccggccggccccgcccacttcccgtccctggccgccgcgggcgccgcgggcgccgcgcaggcgcagtcgggcctccaggctggcggggccggacctctgctgccccctggcggctacgtggacggtgactgcggccctttagtggtaggcgaactgcggctccacctgggctccggagccgccccagtcaccagcctcttgcttctcttctgcagctttgggtgggcggctggatggggaaagcaatccctaggtcacagcgcccagaaattaagcaacttctgccgtcaatagctggtaagtgacagagcagggatgcaaacccagactgcccaggcaggctcatccgtccgggaaggaggcacagtcccaggctcattatgagttgtttgtttccacaaacgttgaggcttttgttatctttccgttctggaggtcagaagtccacttagcctcagtgggcgaagatccagggatcgccagaatgcgttcctttctgaggattctaggggagaaactgttcccctgccttttccagctcctaagggctccctgcataccttggctcgtggccccttcctacagcctcgaagccagcaatggccagttgagcctttctcacactgccacctctggttccctcctctgcttccttctgctacttctaaagaccctcctgatgccattgggcccacccagatagtccagcatcatctctctaaatcagttgattagcaaccttaattcccctttgccccttattattattattatttttttttgacacggagtctcaccctgtcacccaggctgtactgcagtggcatgacctcgactcactgcaacctctgcctccctggttcaagcgattttcctgcctcagcctcccgagtagctgggactgcaggcacgcaccaccatgcccggctaattttttttgtatttttagtagagatggggtttcaccatgttggtcaggctggtctcaaactcctgacctcaaatgatctgcctgcctcggcctcccaaagtgctgggattacagtacaggcgtgagccactatgccgggtctgccatgtaatctaacacaggcacaggtataggacatgaacatctctgaagggccatttttctgccaacacagaggctcttgaaaatattctttttctctctttttagagacaagctccttctctggtgcccacactggagtgcagtggcatgatcacagctcactgcagcctcaaactcctgggctcaagtgaccctcccctcctgcctcagccttcctagtgtctgggaacacaggcaagcaccaccacgcccagctgattaaaaaaaatttgtagagacagggtctctatgttgcccaggctggtcttgaactcttgggctcaagtgatcctcctgcctcagccttcccaagtgctgggattataggtgtgaaccattacacctggccaaaatattttattttaaaggcagaagaaagaaacctttatgtcaaagaaaatgttttaatatatgatattaatatattcacctttataccaatgccgttggaaagtataattttttaaatggaggatggggcaccagatcttatgtggctctgcccacctgaccttcaggtccgcaggcctgtgtccttgccaggaatgaatgtctctgggatgcttctctaacaggaggaacctggagtgagaccaggaacctggagaactagcagctgggtgactggaaaggaaaccatctggggtggggttgggtctgcaaggcaggaggtgtctgggcagagaaagcagggctggggcggagggtcctgcctcatcccattctcctgctcactctttcctagatccctgtcagggcagtaaccatgagcaaggcttgaggctacttcttataaacagtggccctgggcacattccttagctcacctgagcctcagtttcttgatgagaaaaaatcgggacaatagcaaccaacctatctcagagggctgctgtgagaccctgagccactgtttctcaaactgcccctgagatcacctacaacagaatggctgtagggtgaagtttgagaaccgcagtacaggtgaggtggtgcgtggggcaggccctcccacactgtaaagtgcagtgtggtgcggtaaaagctgatattcccgcaggcatcctcagagtgggcccaattagactcttgagcactgattccattcaaggtctgcggcttagagaggatggcaaagtgaggcaccaccaggagcttgtccctatgggctccaggccaaggacgtgcctggagatgactcctgccttgtggcgctgtcactgcctcactgtccacattccatcacgcctcagatcctggcttccaccctggtgaaaggaatctttcaatatcacccacccagccacagacgcttctctgcttctctggcaaggctgcacccctggctaggtgggcagggccaggggctccttgagacagtctgcagccactgacctctccagcctccagggcagaggtacagtcccatggagcgtggctgatctgaaggcagttctggcctaaaaggggtcttgtcccttccttgtcctcattgctcccaaggccaggttggcagcagtagcagcggggttggatgctattggatgggagaaggtgaatggactcggagtgcagaatcaagctgcggaagccaagggccttgaaggagggtcacacacaagggacaactgcagaggaaaataaaggaacactttgtgattagccctgcctgtggctgaaagcgcagtgcagaagcatagtaaggaaggactgggtggtctgggtttaagacctaggaaccgtctctgctcctccaagcctgaatgagccctataacctaagggtcctggaggtcttgaaaccttctgcggagaaggctccaggtccactgggccctgtgggtggaagagcagagtcacagccccgcactggggacctaacaggtgtggccttgctagggccccagaatgggaccagagtgggtgggagggggcagaagctctgagagcaccccctccttcctgaagcctgtgcttctgagacacatcccaggaccctctatgtggttccccatgtctctgtattttcattcagcttcgagtagctctccaaactgtgttccagggaacccccgtgttaacctgtgagggcctccaggaagggggtccagggggggtatgcttggtgggctctgggtttccttacaggagctctcatataagtcctggtgcagcctgggaatctactactgagttggggcgggggcgggtctgagtccgaaacattcctgacctgcccctcaaagaaaggtcccactgaacagtctggaaagctgttttgctgagctcccgtcatcactcaatgaggcacgggcggagtgtggagggagtttccaacacacagtggatcccgcacaggtgtctctcctcgggtggctggggaggggagcacaagaaggcactgaggtcagagggcagctgccaccagcacctggcaccacacggcagtctggcctacagggtattttctaaacctggcatgtgaatgggttccatggggcacccagctgcctctaagaccataagggcttgttgtgagaatgggaattgcagcaggtcctgggaagctgccagacgcacacgggcaccatgtacagggcttctcagagatgggagcagggagcaggggacggagaagtgtggggtcaagagcgtggccctgagcagggggctgcagcgaagaccaaggggattcataagccagatccggggagggggtctcccagccccacctgctccactagactcctctcctgccggagccacagctgtcaaggccgccttccttaaggcatcagggccactgcttgtgcacacagctaccatcagcagcacggattgagatggggtgtgagtgcaaactgggtctattccccagggcttcagggttggggcatccctgcccgtactgccagggtgtagggatagcagggagcactctgggcacgtgtatgcaggctgaagggagacgtattgggtttcggagagggagagagggccccacaggtgcccagggacacggtaacgctctgacatcgctgcaccagcaaaggggccccagctctggataagataaaatgcattttaatagtttgaagtgccatgaggtgtctgcatggcactgcagcctgggtgagggaggacagggtcatcatacaaagtaggcggccagggctgacatcttgtccttgggccgtctggggttgggcttcccagggggcctcctggcccggccccgccctcgaccctgccttctccctggtccaccgcggtgcatggggtggcaggaggccgcatgcttcagctccaccagctcctggaagacggggtcacaaaagacgcagcccatgtgctgcgtctcatcgcccgggagtggggacttggccttgttgaagtccacatcaagcaaggcggcctcacagacactgcaggtgtcggcggacacccgcacgcggtgggcgttctcgaagcagtgcgctaccacgttgcacttgttgcaggccaccttccacttggggcccgaggtggggtccagcaccagcaccccgctctcacattccacgcactggccgatgcccagcatgctcagcgagtgctggcaggaggggtgcgtacactcgttgcagcccatgcctggcgggagaagggagccctgtaaaggcacgcccactgtgcccacctgccctctgctgcctgctcccaatgcctcaagctcctggatccctcgtcccagcagaaggaactcttcttggccttgctcttggggacagccttgctcatgtttcggctcctggctgccattacccctgttttctgcttacctgaaacctcctcaactttcaaggcccctcgctggcaccatcccagtgggtttcagctgactccatcccccctttgctttgctgccagcttgttactggtaatgccacatgaccctcatgtcactgggccacatggaaccaccctgtcagctactctggcggcagcaggagggcagggatggggtctcactcccggggcagcctgggtgcagactgaggcctgagggagctttctgcagagcacacggtgaatgtgggcagatgcctcactcccgctgattcctggtctggctcggtgctctgtcctgcctgcctggacatgcgctccctcctccagtaatgaggacgaggatgaggatggaggacggtggtggacgctgactgggggtgcccgctcaccgggtgggtcccccgactgctgcatcctcttgctcactcagctccagagggagcactgcacacctgtgcccaggtcctgagggtggactagggttgcctgctcgattctgacacagagagagggtggcaccactggctgaggcctaagcagtgccccagctacatccagggtctctcgtctcagtgccaatgagtgcaggaaaggccagggtgaggggtcccctcagagtccagcctggtgcaaggcaggggttggcactgaaaagagactgcagctacctgtggacaggagggagtggctgcactcacctttcttcatgtctcggaagggtgggtggttgtagcagtaggggcacagcgggtagctcttgccccgagagcctgatgaccacaggaccagctcgaagtcatccagagggcagcggagctccttgtagagcttgatggtgccgttctgggggagcgtgtaggtctcatcgcagtgggagcagtgcaggcggcttggcttggcctgcggcaatgccaggcaggtggcgtgagggtcactggggccaccgacttggcacccacccccactcctctcataatacaaagtatgtaatctgtcatgcagaacctgtgacacactgccaggcaaggagcatgagtctctggctcttgctccacgcgtgcagaaaaggcagttctaaaatctctgtgtgtacattaatgcccatgatggcaagtggcatggtgttagggaaaaatgcaccatgtgtgtttgcgtggcctaatggctgtgtattctaggggacgtggggacactgggtattttttggcaaggcctctttatgttccatcattcttttgtgacaaccaggacaaagaacatgattcctgctgatcaacgataaagctgaggcctacaggggtgaggcagcttgcctgagctagtgttccctgcacctacctggatgtacttcatgaagcggtggcacttcccacagcgtgagaggggcttgcctgtggccgccaggggcgagaaagacacctccatcaactcatccatgcctgcgggcaagcagagtgcaggagtcatctccctcccagtccccagcaaaaggctccgcaacacgtggtcaagggtctgagtgtgaaagggtccctataggcggtggtttctactgtcctggcagcacggcagggcagcagccctgtgcgtcagaggcacgtgttcctggccatgtgtggtgttaatgcacctgctctttcaacccagccaggaggtgtcactgacctggcctacggaggcctgaagcccagatctgggagctggtcccacgtggggacctgggtccccaggtactggccttgctgacagagagacacccctctggtgaggggcaggccagaggcagactctaccagcaatggagtcgacaaagtagtggaacttcctcttgaacacgtccagggtgtggcccaggacctggcggtagtcggccttgccctgggcgatcaggttcagctgcttctccactgcactgcggatggtggggagcaccagctctgcatctgcaagtgggcagggggcagatattgccctgagcactcgcacccagggccatgccaccccttcccaggcagggatactgccctgttcacccctcccgctctggcccgtcctcctggcctctgccctacccaccagtccacagcctcagatggtaccaggctggctcttatgaccccagacctttcctgatttcccacctggaaatgtcaggcagagtggccagggatgtcctgtggctagaaccacatcacacatgagctccaggccgcccttgggccagttttgtgctcctccctctccccttggcccctggggaacctccagggaacagggctgaggcaacttcgcctccctttttggttccctcacacatctgttcagccttcaaacacactgagctcctgctctgggcaggtcctgggggtcctggggcagcaccccttcagcgggtgttgagggagtgtgtgtggggctgggggatcactgtagggcaggggcctgtctggagcgggcagcagagccaacatccagggagaagccagggagcctcggtgggccctgggggcaggactgaggaactcaccaatcttatagtagccgtgcaccaggacgatgccgaggttggtgggcttgagccggcgcccgctctccaccgtgacatagttgcgctggcagatgttgttgatatgcacagggatgctggcatccgtgcctgcaatgtacaaggccccagggttcctggcctgccttggacatgccccactgaaccatgtgctgtatcacctgtcacggggcccctggtgctcaggccctctcactgctcccggtcacaggagggagggctgtgccctgagctccccctgcactgtgctgggcaccaactgcatgcatttcatgttctgccttgagaacacaagggcagccctccctgtacagggcgcctactcctgctttatggcagagacaacaggctcggaggttaaggaactctccaaggtcacagtgcttattctgcgcctggaaaatgtgacttctatggcttctcctgcctgggtcctgtggcacccacctgctcccggagccagagccccactccaccagaacacggaggtgcttacaagctcactgcagagctgccctcccctaaacctggacaattctgtccacttcctgtctcccacctcctccctctctgcaaggcccgtcacgatccccaggggaggctcccagtccccaggattccactctcccacccagaggaagtttcctggcagaggggcgcagcggaggctgaggcgttttgactatggcgggtgccagtcagaggggcagaaaggaggctggggctccctgcatgctcaccagcatggacaggtgacacacaccttcccaaagtagctcggagagaatctcacatgggaagaaactggcctctgggggctaaggagcctgccgagggcccatggctcttggcacgaggccagctctgcacccggtgtggcaggctgtgggtggcgtgtgccactaccaccccgagtctgccgggcgccatgacgcgtggtgtgggctcctctgtggcggctctggtcaggcccttttgacacactcctgggggctcagtcacagggccaccctgaccactctcctgttcagaaggtaacaccagagccctcttcactgtcacaaacttgtattggtgattgggtctggctcactggctagcatagggctgccaggagccagtgtcccatcaatgcgagagggcagaggacacgggggagcagagcccacactccacagtgggctgagggctatttcaggaccctggcaggtgccctggacccctgagaggagcaagcccagagctctgctctcctgccaagatcgccatggtcaccaggaccccagcctgggaagagacactccctgagagtccacctatatgaccactgctggagcagagcctggacacagtggctgtgacatcccacaggtctccagagcctgtcagccaggggtagtgccccagggaacaggcagtgcccagcggcgcgagtgccacctggggagaaggctccggcagtgaggctggcccccaacatgtgagacatctcacagctccaggcctggggacttgtgaggccaccactcctgtgaggagtgtgcactggtgactacacttttgctttgataaactccctgggctgcccatttttgcgtggaaacttcctggtcaccctttggggagccctgtgcctgggacaggcatttctgttctctcccagggaagcagctcctgtgagatctcatttccctgtcacctgatttcaggacagcccaggctggctgtgtggactcaggggactgccaatatgatttctatgagtcacctggcatctgggccaatcttcagccttgtgggcgttagtcggtgtgtgcacaccccacagtgcacgagggcacatctgggccttcacagggaaggccaggtcctgaatggaggcctcaggaggggatgcccgctgtggacctgcctggctggccacacactgggtcaccagtttccagataccagcccatggaggggtgctgggctgggcacacagggctggcggggcagctttgtgagtagactcgaagcctgagtactggagacggagccggctctggggcctgggcaggcgcacccaccgatgccatgcttctccatgagcgtgatgagctcggcctccgtcaggtagtcgggtgggttcgtctgcttctccagcatcttcacctcgcccacagggaaggcatcaccccgctggcaagtgggcaggctctcctccaggggcacgctctgccagggcatgacctccgtgaagcctggagagatatgcgccgccactcagggtccccagcctgggtggccggggcctcagaccctgggcctcccatccccagacacgatgtagaatgtttgtctgcccatgaaggcacagaggaggaaggctgggcccgtggtgtgacctggtgagaggacggtcttcccggagcaggtgaagagctcgggcccaattctgaaggagatggtgctctgcaggtacttgcagtcatggctgaccgtggcgatgaagtgtctggtgatgtactcatagagccgccacgcgtcaccccctgcaacaggccagggctagtcagttgggagccagctgggggctctggccgtgaggagcccccagtactctcgctcgagcagcaagctcctgcttacagagccgctgtgcaggacacactgcaaatcctggggaaggaggaaagaaaatgtgcaggaaggccgggcgtggtggctcatgcctgtaatcctagcactctgggaggctaaggtggatggatcacttgaggtcaggagtttgagaccagcctggccaacatggtgaaaccccgtctctactaaaaatacaaagaaattagctgggtgtggtggtgggagcctgtaatcccagctactcggggggctgaggcagggtgaactgcttgaacctgggaggcagaggttgcagtgagccgagatcgggccactgcactccagcctgggtgacagaacaagactctgtctcaaaaaaagaaaaaaaaaaagcaaatgcggaggaagggaacacaagcctccatgcctcagtggtttctttctggctgcggctcccaccatcctgcacaacctcctgtccctgcttctggcgggactgctcttcaggcattggcctgtctttccattgtctcgtgacatgacaccattgcttcaaactcagactgtccacaggtggctcctgtctctacctgcactgctctcccttcctcatttgccttctcctggcactcggaccactggtaccaccttaggccagctgggaggtaggaggtgtgctgccccctcccccacaccgccactctctaccctggtttcattcatgtcccctgtggcgtctgcccccttgcctccctgcaacagcacctgctgctacctcttcactcctgtcctggtcccatagcaatggagctcatcttccaggtggccccccatccccacagccagggcaggcagaggctgaaggagcccccacattgccaacagggcctgcaaccttcactgtcgcagctcgcccttccctccctggaagcacaccgggtatgggatgagagcggtacctaattcggcctctgtggcagacttcatgggggtgatggggggatggtcgccggcgtcatggcctttccgcgggcggttgataccttctgctaacaaccgcttcacctgagggagagaagacagagcagagtctgtggctgggctcggctgcctgcctgggtttggctgacgtaccagacctggtcccaaggcctcagtgacacacacacatgctgaggccggcccggctccactcaccgtgtcggcccagtaggggtggttggcctgctgccgcagagagcccttcaggtcaaagttctcagggtagtgggtggtctctgtccgtgggtagctgatgtagccttgcgtgtagagccgctcagccgtctgcatggcgtgctgcggccccatgcctgcgagagacaggaggttctcagagggccaggtacgtggggatggccagctgcctgccctggcctatgcactcaggctcccccattgtggccggcccctcctggagggtgacggtggctctgagcaggcacagctggagtgcaaagctgctggccgggtgggcacctatgccacacagtcttgtatgaggctgaatcccgcacccgtaaggctgaatcctacacccaggatgggcctgatgggaaacgccactcactctaccccacggtgcatcctcatggggctcatggccatggggatgacacatggccttcagagcaccactccccatgcattgtccatggagccataaccatacctcggggttggctgacgacagagttagcacgcagccccattttgagcccttgggtgtttctgtcctcacagcactttggggccactcaggggggctcgtcctgctactccctgaccagcagaggcaggcgcttagctagcaaccactcccagcattgctgccctctgaggacgctggagccaccactcagtgtccactgagaggacactgcccatagttccctgcgggggtggggggcaccaatgcctaggggctgacagctgccagagaccaccagctttccagcccaaccccctcctcgttactaaggagaaaagactgaggagatgaggctgaggggcgacgttcacactggttccctgaaggtgacatctggctggggcctctcccctcaccagggatagctgctcagggactctaacatcaggaggtcccctcaggtggtgaccaactttaccacctttacaacctaaggataagtgaaatcctcctgaggctcagatccccttgaagccttgggcaccatcctgcaaccctgggcactcgctgctccaggctgaacctgcctcaggaagccttctggtgacttgagagaaatgtccctacatacccagagaagagctggccacacgcagcatctccacagtgttcagggccaggggcctctgcttggccttttctttcctgcttgtggcctccacctggaagacaggacagtcaatgatttggggaaggaggaagacaccaccatagagggaatcaagatgtgtggacgaagggtctggtttcattcatctggtctccctgtttctccaattcattcttcccaacagtctaaagacttgattgaatatttattcaggaccaggaaaggaaaaagaatgaaaattcttttttaaaaaaaaattttggctgggtgtggtggctcacgcctgtaatcccagtactttgggaggctgaggcgggtggatcacctgaggtcaggagttcgagaccagcttgaccaagatggtgaaaccccgtctctactaaaaatacaaacattagctgggcatggtggaacgtgcctgtaatccaagctactcgtgacgctgaggcagaattgcttgaacctgggaggtgaaggttgcagtgagctgagaccacgccattgtaatccagcctgggtgacagagcaagactccatctcaaaacaaacaaacaaacaaacaaaaaaccaaattttgttttttttaagagacagggtcctgctctgtcgcccaggctggagtgcagtggcaccatcagagcttactgtagccctgaactcctgggacaagtgatcctcctgcctcagcctcctgtgtagctgaaaccacaggcacacaccatcatgtctgaccaattttttttttcaatttcttgtacagacagggtcttgctatgttgcccaggctagtcttaaatgaactcctggcctcaagtaatcctctcgcctcagcttctcaaagtgctaggattacaggcacgtgccaccatgcccgtctactttttaaattatttttttcagagacagggtctccctgtgttgtccaggctggtctcaaactcctggcctcaagtgattgaatattcttttctggagaattttctagggaaagagaaaacctggaagattgaggaggagtcagaagggctgcagatggaaatcctacagaagccagcatcagccaagctacagggatggcaagtggggcccgtcccaggggaagtaccactccttgttgtggggagggctgctgcctgcacctgctagtattgctacctcttctgatttttcaagagaagctagaaggcagaattttagtatgaaatctcgtaatttttaagtgctggtaactattctggaatttgtgtaaacaccatgcaggttagtggagtgcatctatgagctgtgctttgttggggtcctgccactctctacctctgctgaacacttgtcggaagagacaactctttgttttgcctatggcaaaaacaatccaaacaactcaaccccaggccctggcccttgccaatcccacgtaggctggtcagggcagtgccttctgcattccagacagacagatgtgggtgctaacagaggccagttgttatgtgaagctgggctccccagcgtgaggcctggaggtggcaacagtgtctctgcaggaatgtgatcaatgctgacagcctggagcagctttagaagtttcagatgcctgagacgatagcatggcgggcaacagggcactcaaggaaggccagagaaggacaaggagaaggcggctaaggaggccaggctgtgtctcgacggatctggtagctgtcatgcctgtagcatgtttacttcaatagccacagatgtgtccccaacccatgcagccaggtcacctcaccgttttcctaacagccaagcagcatgtcctttcaattcatagaagccctgagtaagaaacataatcccataaaagcacgcaagctgattgcaattggaatctcaagactttcccctgctagctgtgaccttgggcaagttcatcagtgtgcaccaaggtccctctacagttgttagtttgaatctctgtgtgaaatggagtcctgccacacggaggtaatgcctagcgggtcacgtggaaaggggagagtggaaggggtccgacaaggtcacaggtgtggacagtgcctggtatggagcgggcatgcagtacactgtgactattgcactgggcagaaatatcttaggagtatatgagggagtaaccattcagctttccaaaaagatgtctgtgtttcagaaagggggagaaagacgtggactaggatcacaggctgttcctccagcgggaggcatccaagggccaccctcacccaaggcaactgtgatagatgtgggtggagcaggcacacctgggcttccttctccagctttgtcatgtttaaaaacatctgtgcgatctcccggtcaaacactcttactcggtcccagtccaaaaggagagatctgtctttgtcagtgttaacctgcaggaaaaaggataaagggtgaacgcacaagaaaaagtctccaggtgagcccaacgccaggaagaaccaggacagatgaagctggtccttgtctgggagccaaatagccctggctgtaatggctcacagctgtacctgttcaggtgggcagatacgcaagctgacatctggccctctccaccacttgccccaaaaccaggcagccagtctcaggaaggtggcccaaagctgaggctgatgtgtccctaagaagcacctgagcccctacttctcacaccacccctgcctatccccagtgcctggccagtggtaggtatggccaccgccagggtcccaagccccgtgtcagccacagcagctccaagacagtgtctcactgtgttgctaggctggagtgcagtggcacgatcgtagctcactgtagccttggactcctggcctcaagcaatcctcttgcctcagcctcccaggttgttgggattacagacatcagtcactgtgcctagctgtattaagtcttacagtgagcttctgtggaggcttttatttgaagaaagggttctaggaattttaaaaagtttgaaagccaatggtctcagtccagtgcttggacctgaccactgaagccactgattcctgtggggtgacctcaccctgcactgccagagctgaactcattcccacttatccagattcagcatatacaggcccagtctcttcccactgcccccatgaaggctggggtccctcagccctaggcaccacagaccacttccaggtacagccgtccacacttctgccctcagcccggggcctgccggctgatgatgatggaagactctcagaatccatgccccaaacccagaaagccccagcatgaatagagaaaggcaaggaaccttggcctgcagcacccagtaggtctctggtttgaaggactggattttatcatgtctctccacacagaatcccagggttggagtctgacacggcccaaaggagatgagagagctgtctaaatcaccgtatttcccctggaaatatttagtctgaaacctggagggagtggaaagatattttggtcactgattcactcaagacactattatggccacccatgtgagtccagcccaaggccaggggtggtgcatgaaggaggtggcatcaggtggtgtccccacttagaagccagtgggagcagagtgggcatagccttagggaggattcatgtgtgtacatgggtgacagagccagtgagagaggagacagaggtttctactgtctcaggccagggagccttctattctattccatctactgcacactctcctcaggacccccagagcacagacaaacacactttatcaagcagggcatatgtgatctctgtcagctaaataaacaattttctttaggtctcttttgtttttgtagagacagggtcttgctgtattgcccagcaggagtgcattaatggggattcacagatcattgcagccttgaactcctgggctcaagtgatcctcccacctcagcctcccaagtaactgggactacaggctcacaccaccacacccagctaattaaaacaaaatgtttggacaggcacagtggctcatacctgtaatcccagcattttgggaagctgaggtgggcggatcacctgaggtcaggagttcgagaccagcctggccaacatggtgaaaccccgtctctactaaaagtataaaaattagccgggagtggtggcaggagcctgtaatcccagctagttgggaggctgaggcatgagaatcacttgaacccaggaggcagaggttgcagtgagctgagattgtgccactgcactccagcctggatgacagagtaagactctgtctcaaaaaacaaacaaacaaaaaaataaataaatttttgtttagcctgggcgcagtggctcacatgtgtaatcccagcactttgggaagccaaggtgggcagattgcttgagctcaggagtttgagaccagcctgggcaatacagtaaaaccctgtctctacaaaatgcataaaaattagccaggcatagtggtgcacacctgtagcacctgtagtggaaggctcaggtaggaggatctcttgagcctgggaggcagaggttgcagtgagctgagattgtaccactgcattccagcctaggcaacagaacaagactctgtctcaaaaaaataattttttttttttttttttttgtagagatggggtcttgttatgctgcccaggctggtctcaaactgccaacctcaagcaatcctcctatcctggtctcccaaagtgcagggattacaggtgttagccactgtgcctggccttcttcagggttggtgaaatcccctgttgctcatcctggctcgaggaggcctaggggccccggagggggaccagtagaggcaggtctctggctgagggagagtgagggtgtgcccaggactctgcgggtgtggccagcacctggtgaatgcacagccgattcgcaggtccagctcctggcgagcatccactgagagcgcctcgttgtggtcaggctcgcctaggcaggccatggcattacagatgtctgtgtccgtgatggagctaaacctggcccggaacacggtcttctcgccaccatgggccttgttcatgacgggcagaacagcatcaagaacctgggggtggggagtggccagctgtgacccacctcccagatccctgccacagctccccaccccactgtgaagcctggttccttccaggaaagaacacgtgtgctcggctccctctcctgcccctgccagaccctcctctatcccctttcctgcacctgccagaccctcctctatccccctgcctttccagaagccctgagcactccacaacaccccaccacatggcttcctttactcccatctagaaacatactcgaacactcccttcttactcccgccctctcttctaatcctctgctttcatccccaccaaatcaggaaatgctactgccaagtacatgagggacctcttagtccccaaacccatcccatgtgacacgattccctgccttctaggagggagggtttggaggggtgggtggaaattttaagaggctgaagaaaagacagggaaggaaaaaagaatgaaggggaaaggaaatgggcaagagcaggaaggccacgggtggtcctagcttgtggtgggggcagctcgggctaaagcacagcaggggtcctggagccgagactcactaggaaggccgtgcagtgggactagggtcgccgccggagcctggccacgcagcttccttactgggaataagtggcttcatttctgaagggagaaagccccatgagctgcccccattctccattcccagatgcaaaggcccccagggaggagccgccctgcaggggaggagagggtatctgggaagagacagagtgtgatcgcatttgctgagggtgctgtactgcaacgccaggtgcctcagctctgtctcactgaccagctcttgagccacgggtgagagctgggggtacaggagcacgggggcgacccatagaacaacagtctgaagggcaccaagtgagaccagcagtcatggccactgtgagggcaccatggccggggcaagcatggggcatggggtgtgcacagggagcagctgccacctgcttctctgcagggctcccagggttggctggaggcaggaggcatcctggatgaggcaggagatgagcagagcgaggcctgcaaaaggagctcagtgctgaggtcgggaatcaaccagcatcaacccaaggtccctgagaagtcacgctgggcacaagatgctgaacaccaagctgccccaagacaatcccattctgaaacctgcatccacccagacaatttggcccctcctatgttcactcataccgttgaggcctcagcaagcggaggaacaactgaccacctttaatagagcctatgcagttaaaagtatctgtggagtttcagaataaagggaggggagaggtgtttttaaaccggtacagtttactccctcctttggccccaggagtgatgtgactgactgctggtgtcagtttggggctggtgtcagaaaggccaaaagtgaggaacaaagtgagcctcacactcacctcaaagcagatgttctccccctccttgtcgcagtccagccacagcacgatgtagtcgcagcctctgccctccacctgccacacagcacaggttcacacgtacctgctgcagacccggtctgtgccacccgcccccagtgctcccatccaggacagggcttggtcccaggccctgaacctcagttaggaggactggtacctgggctgggtaaggagctggctgtgttgaggctggctcagccaacagaaaagaattgagtttataattgatgttttttggaccaaaaaaaaaagtataaatgcaacatgatcttataccccaaaactgcccagaagaagggttaaaatgaaataaccctaaatgataacagcagtcgtcttgggtaatatgattatgcataatttttctgtctttctacttatctgcactttctaattttccataatctgtatgcatttgttttaaaattaaggagaaaaaccccccgaccaaacaagctattttaaaagcagaaggcctgctctccaggactgagggttggcaatggcaactgccttgtgtgttgggggtgcctgcaggtgcctcgtgggccagcagggggcactcacagaaaaagctagcaaaggcccccctgtccaagggggattaggactcaagcaagggtgggcaaagacatggcagctgtggagggtggggagccccggtgtgctcatgcccaggccagccccacgcacctgcaggaacttcaccatgttcagcttggggttagcttctttcttctccgtgggagcttggctgaacagttctgcggggtccactttgtcccatttgttgtattttcctacaaaccagtcacagtgacattgagtcacaggagctcagcctccgagaccatcataaccccaggaggatgttggcctcatcccacaaatgaggaggggaaagcttggagaacaatttgcccagggtcatcctgatgatcagaggcagagccaggatgtgggttcaggcctttggtaaccccctcccatccagcctcctttctgctcggctgctgagcggacccaccacaccccggccaaccacaggagccaagcaagctctcggggggctgccactctggcctcacttccgggactttccctgtggctgggagcaccattcctgggctgggtctctttgcctgagcactggaccccacaatggtgccttcattgacacttccaacctgagtttctggaactttgtccttccacccagcactctgtgggggcacacatgtgtgcagtcgttcctgttaaaggaccatctttttgagcctcatgcccagcacattcacctactcatctacagagacccggttcttgcatgctcagctgtctggctttcttttaggccccatttctttttttttctgagacaggggtctcgctctatcacccaggatgaagtacagtgatacgatcacggctaactgcagtctcgacctcccagcctcagtccatcttcccacctcagcctcccaagactacaggtgcgcaccaccatgccagctgatttaaaaagaattttgtttttttttttttttgtagagacaggggtctcactatgttgtccagactagtcttgaactcctgggctcaagcgatcctccccaggccccatttcttgcatcctgggagaatggggtcagacagagccaaattcaaatcccggctccccacctgccagttggagataaaacttggggtccaaatgctcagccacacaactcagtcaccatcattgtcatcactgtcatcaatgagcagcaagaacaagggctgaggctttgctgtgtgtcgggccctgtgctgagtgctttgccctcactgtcacactgaatccttagccttgggaagcagatggcattgctgtgagacccatttcactatgagaagtgtaaactcagaggccgtcattgcccacatccccagccagtgagccggcagagcagggggaaaagcctggatcagactcttgccaaccacatggccccaaacctacacccagcaggtcactaatactggcgcttccaaggtaattgataacagtaacaatataggaatgacaacgacagccaccaaatgaccgacagatgacggtcaacttggcaacagcagcagccttctcttaaatgcctgcacaggtcaagcccttcctaagataggtgctgccactttgtctacataggaaggcacacagggaatgcagcgactaaggggtgccgctatgatggggacccagggctgagttccagagcctgggttctgggcaccgcaccagggaccctctcattgctacttcatgatctgctggccttatgactcatggagttgggacaaacttccctgcctagaggcatctcctggcttcaactggaccctggccagtgccatgcagaactcccttcagtaggatggagggtagaggggcttacccaggaaatccagggtcatcacgtgaccacagacagacgtcatcttgaagcgcactggctggccagcaaaggtcccagtgtactcgtggactgagcaggccccgttcagccctttgtgtgaggacaggctccctggggatgaggaagcacaaagtgactggctgcttcagctgagctgaagaccctgtggagaccccagcccggatgccacctcccagagggccagagtcctccttccccagagtggtgagtgacgacattccgcagactggtgcgggtagttgggcactgagaggtgggacggcgctcagggaaaacagcatctgccaacaacctagcacagagcactctcgatgcagagccccaggctgccgggagccaggagcaggcaggggtgggctctttctctgtatttatgttttcactcttcaattccatttttgcctcacttcattgaaacgttattcatcgtttactaaaacagactccagatctactctcggttaccagggaccttctaattatcgaattctcaccctctccactgaccatactcagctgtactttctcagcttctgggcaccgggcaccacttttggggcaccgtcccctgcggaccatgccttctcagctgaacgagggtctcttcccctctcaactgctggaccaaggggaggccaggtaggtgcctgtcatttctgggtacccagcatctaaaactcttcctatttggagggaattcaaagatagggggaaacagcaccctaccaaccaccccagtggccagagttgggggtgagtggcagacattccctctcgagctccctggtgtctcagtagtgcctgtggccatagctcagtccattggctactctggagtgacgtgaggtccacaggacagtgggagtatccaggggtgacaatgcctggggcatagcctcatcagaccttgactggggtgtagtcctggctgcgtctccttccttccagggctggtttctactacctgtacctaatagccccaccaggcccagcatatggataatgactgtccttcaatttcattgtaaattgtgccttgtgccttatgggaaccccagctttggcacattgccaggagtggaagcaaatgcaccccactgtgacatactgagatgcttcattaccacctgccgacccgaaccaaatctaccccagccagggtggaatcacattaggaaaaaatgtcctgtaacacataaacgaccgtgcttacagaccaaagcagggctggtctctcctacctctagagaggattttggcaattgactgtgccaaggacggcttttcagcaaccatgagcacagtcttcattttgtctcggtccttcacactccagtttcggggcactggcaatgaaaaagtttagactccactcttccgcagcacagcactattaccaatgctgactcctaaagagaagaaaagacactcaggatagcaatgctgtcaatagaacctacaccactacaaggaaaatcactttaacaaagaaaaaacaagaccaacctgaggcaagaagaagaaaaattagggaattagggaaacttgaagacatctgagattaaaaacaagaaaaaactaccaggtcagctgaagtggctgagatgatcctgggaatgtggctccatttgggggaaggtgaagtggccccagtgatctcaggtcaattttattcctaaatccatgctaggaagatgctggggcctggggatctggagtgatgggtcaggccaggtggatgcctggccctcctctctggactggctcttccacctacaggtggactcacctggaaagaggaactatcgtggccgagagcagcacctcccgctcagcaaagcacttggacgccccaggacactttacaaaatgcagatgcccaggctgggccccccaggtccttctgatccatgatgggcctgagaccctctggctagtcggtccagccccaagcagacatcaggactctgtcacatctatctcccacctattccactccaccttttgctttgcaggtcatgctctggccaaattaaatcaaatatcatcatcgaagcaaacacgcacttgaagcctctgtgcctgcgcttccctgcctgagagaaagctccgccaggcctggaggatgcagctggatggcccacaggcccagctcaagtctcccaacaccactggcagggtaagtcagccctcctgtgcccacagctcttgggctaggtctccattccaacccactcacatcatgccatcatcagcgactacttcacccccaaaataggacacgatgggctttgtgtctgaatcactgttggtctttgcaacagctttctgtgcctgacacatgacattcaatacctgctagccaagtaaaagaaaaccacatgaaccctttttgttttttcagtcattataaatgtagcactgatgtttataaacatagcaccgtattaaaaaagaaaaaaaagactcgtattgagacaactgggaaatctgctgtgaaaaaaaataaagttagactcctgcttcctaaatcccactaaaaccgattccagatctagcaaaggtttgagtagaaacaatgaaaccagaaaatattaggaaaaacatgtgcttttaaaataaatctcacaagccaggtgtggtagcacatgcctatagtgtcagccactcaggaggctgaggcaagaggatcgcttgcttgaggccaggaattcaaggctgttgtgtgccatgactgcacctgtggatagaacagccacttcactccagcctaggtgacagcaagaccctgtctcaaaaaaagtaaaagcaaaataaaataatctcagcataaagaaaaactaccacctagatgggcacagtggctcacgcctgtatcccagcactttgggaggctgaggtgggtggaccacttgaggtcaggagttcaagaccagcctggccaacatggcaaaaccccatctctaataaaaatacaaaaattagctgggtgtggtggtgggtgcctataatcccagctgcttgggaggctgaggcatgagaatcgctcgaactcaggaagtggaggttgcagtgagccgagatcatgctattgcactccagcttgtacaacagagtgagactccatctcaaacaaaaaaaaaaaaaaaaaaaaaagggaaaaccaccacgtaagtacctttgtggtatcacatcatgtccaacaacactcgcagaagaaactcagaactacaa

SEQ ID NO: 4552 - DNA, 7459 bp, Homo sapiens
gcatttgcagcagcctctgacgcctgagaggcgctctgttcctctaggaggagggtgcgagggccatctttgacctctgttaagcgccctaaggaggtaccgacggttgtgaccgcagtctctgacgtcttcagatgtcagtcctacaaagtcgggggtggaggtttccctccaggctgatcggacatgctcaaccgtttatttacctttgaatttggggagcagaactagccagggtgacactagtttctcccaataagcagtgttacagttttctaaatctgtggggtcagttttgcttccacacttaaaagtggccgagccattacttagtcagtcctaaattacaccgcctgttttggtttctttggatacctgggaatccctgctgcctgctctggatgaagagcagtggtcttgatcaccgattggaagcaccgagcatgtgcgtggatgagacttgtcaactcggagctttccaacggcctcctcaggttgtttttggggatgaggtgcttaggccttttctctgggactatgcagagtcccagaaggaaaaaaaaacaaaaactttcaccctccaccatgtggggagagcactggggcgttaagggcttcttcagtagttgttccccaggcagctttgatataggtctcccgtctctgggctgctggttctcagccttctgcggttctggagtcagcctggtgggaactctctcctcttcgccaagtcgccacgtagtattttgccttccctaacttagtgacagctctcacccacttctagcttaggaatgccattgctcctgactcctctgtcaccatcctcatacttgtgggttatgtgttttaaatactcccctctgtggtttcagtggatttctgagcccagtgagatgcatgtgttcagtctgaccttttgacatagaagcccagggatacttttacagtcactacctattcaaaattaagagcagagggggaggttggagggaggtcagccgaggggccaagacctgcatggaggtgggagcctaggttgggggccactgatcagtcatgggtttggggaggggaagattggaggagggtggacaaactgagggacaacaggggcacaagcagacgtggaaaggaacttgatggagggaggcggctggtgggaagacaaggtagggtactgagcccagcctaaggggtcaggcgggctcagggcagaaacttcgctcaagaagcgtctgtcagaggcatagaaatgatttcacgtgactctctgggtatctacttgtttgacagatgcttttgctcctgactcccatgggctccccagaaaagtgctctttcaggcagggaagggttattgtctgcatttcacagctctgcagacttactgggggacaatggttcagggacctactgggattctggtggcccaagtcttgcaggctccaggggagctaggttctgtgtgtctccactccctgcaggaacctgtgaggtttcacaggtggaagagtctggccccaatatcaagtgtgtggggcctggatctgggctctttgtgtatagggcaggatagctgcaggattttggaagccatgggatggagtgcccactggttggagtcaaccttgcagggtcatcacacatggccacaccctctatctcagcagcagaaggaacacagccctgccttggtttctccacctaccatcctcccattgccaggatccaccaggactcatctagcagggctgctgctccagacagccccactctatcccagttcatccagctcctggctaccccaacccacctctgaccctgaaaaggatacaggtatcccactccctccctgggctgcagacaggctgtatctctactctgtggcctcttgagggtacccaggttgaagccaagtccaggaacttctgtgatgatgacaaacgctgatggcatgtcagggtatgttcaataccatctgcattgtatgagggtgaaataggtgtcaggttgctaccgttcacacaaatgtttaaaaagaaacctttatcagagaagctcttgaactgctattaagactgaaccatgctctggagtagggacaagaggctgtgctctggaggtccaaactgctgtacaggaaactgcaacacctactctgagttgcagatggtagtctttttttttttttttccattaaggagaacatgaatttccttggaggtgaggctccaggtagggacagggcctggtctgctgaaggccacaggaagcaaatggcccccagtccacctttctgtccctgccatgaagggccattacactggggtggggaggtcctcaggagggtgtcacacatagccttaggcaatagcaagtctttcctattcagctctgtccagcctccaattgaggagggataatgggggtgagacagggttgggggtgaagtggccaccaaacccggcaaaagtgagcagctccatcttgtctgaagttaacatcatcccctcaggtataaagcctcctcctcacatcgactttggtaaaccagtcagtgacaggccttggccaagctgagacttgggcaaaaacctgaacgagtgccaccggaaagccatcatcctagctctgtccttccaatgctgagagtcacatgttcccccatgggcatccctctcctgagtcggctatgtgtgtgaagccaggccaggccgtgtgcctcagtttcctcatcttccaagtcgggataccagccacagagccatctcacagggcttcaggagaaacttcccagtactcaggacaggagctggcagtgagcatgtgttggctctcattaggaccccacctgtcagcgtctacaaacatgatgttcagtggacccaaaccttttctctttcccagaggtggcggctgacagagcccagaccctgatccccagtcccttgtggtctcttgtctgctaggctggcccctaggaagtcttggatgaacagaggcagtgggttgaggggagaataccctcagcgggcatctctccagcggccagtttgtgtacagctgtcataagtttctctgggccacccccaacccatgcctgcatccctctcaccttagcatccactgtcatatcacatgaagccgcaccacagtgcagtgctgtgactgtcggcctcctactggctctgaatagtctcggccccactagagttcagccaccacgtcctccccctgatgttgctgcagtgctacctctttggggatggaggtgtgatctgtgggtgaactggcaaatcctgtccccacgtgcaaatgaaatcacagccaaagggcctcccttgtccctgactagcaagcacgggactttttctctgctgtggatctgcagaggacatatgccctttagctgtggaagggattcacagaaggccagggctgcaacctgtgacctcagacctccgctggctgcgagacggcggctgggcccgaggcgggagtgggctcggtttccttcgctggcgcaccttctgatgatgccccggcaacagacctggcctgggggtgcaggctggccctggatcgccggacggtcttctcgccggtatggatcctctggtggtggaagagggccgggcgctcacggaaggcgcggccacactgcgtacacacgaagggcttctcgcccgtgtgaatgcgccggtggctgagcagcacggcgcccttggcgaaggccttgccacagtccacgcagcggaagggccgctcgcccgtgtgcaggagctggtgctgggtgaggttggagctgtggctaaaggcgcggccgcactgtgggcaggcgaagggcttctcgcctgtgtgcacgcgctggtgcttaaagagcgaggagccctggctgaaggcagcaccgcagagcgcgcacacgaagggcttctcgcctgtgtgcgtacgctcgtgctggatcaggtgcgagttgcggcagaagcggcggccacactgtgcgcaagcataaggacgcccacccgcgtggatcttgcggtgctggctgaggttggagccgtggctgaaggccttgccgcactcggagcagcggaaggacttctcggccgtgtggatgcgctggtgccgcaccagcgaggagctatgccggaaggccttgccgcacacggggcacgcgtagggcgtctcgccgctgtggatgcgctggtgctgcgtcaagtgcgacgtctggctgaaggccttgccgcactgggcgcactcgtagggccgctccccggtgtgggtgcgtaggtgcttgaggaggtcggagctcttcacgaacactttgctgcacgccctgcattcgaaggacttctccccagcgtgaagagcctcgcccagctcgtcccaggtcgagggctcctggccaccgaggagtctatgaggctcctgccaaactgcacccattcggtgatgtccccgaccgccggcagcctccaggtcctgggcgctcccaaaggttctcccagggacctcctgtgcacatggtttctgccgctcaggcgtcctgggctgcctccccagcaacgcatgctctgtgagtgtcttttctctaagccggacgccctcgggaggcctaagcggggaggtcagtcgcaggctgacgctggcttgcccactgcctgagcctagcaggagcctctcccagtagatcaccgacacccccgtgggttttctctcccgagatggggaggcaccccgttgtctctgcaggctttttacactgtggcaggcaccggcaacagggaagacgctagtagtcatcccaggtggggtatctgggaaagctcgtggccattctccagaaacatctctatcctctgtcaaactccaggaacctaaaggcagagaaacagtggttgcctggggcatcctggttaggagaggaccagggcaggctgagtggacaggcaagaaggaaccccggagctggcacaaaagcttaggggaaaagtagaggtgaggctggccctgcaggaggggctggggtttggaggaacaatctgccctgataggtatggcactgactacactgggcactcccatgatcaaggtggcagccccccgacacccaggatgtgaagctgaggaaaactagcggctgctgtatgctgcatacatctccacactggctattccacccacactctttccattgcttacccccttccccccgcccctgtcccccttctcaggcacccactccccaacctgctcctgcaatgacctccatccagtgctctagactatactcctgaatcctgcttaccgactgcctctcccaccacaccatgagccccagaaaagcaggaccagggtcgtcctgattgaggctgtgtctacattgcctggactgggcctgaccactgtgagcactcaggaaatgtttgctgaacacaaagatgaagggtgaaaaaaatgacccatcaattatggcagtgactagccatggagggtttgaggccagcccagctgatagcaggactctgagatggtctcaccatagcctgagtgcccttctgtgtcaaccccgctcctgtgcccttggagctccaccttcaagggcagctaaggctgcagcctccaggaggggctgatgatggaagggaagggaatcgggtgggagggaggggaggagggtgcttctggggagtctgggaaccagggacagaggcatgaccacaggttggtcctgaattcaccccaccctgagctccctctcaccagggttgcgcctcctgtaggtggtcctggacagggttgtgtccgttccactgggaacccagggctcctcgccacgctccagttggatgaccacacgaggtcgagaggtggagagtcctgtgaggaggaggtgcaggttagagtccagccccagctcaagataacccacctccaaacagagggcaggagtcagggcttcacggaaacagaaaatgtcatctgtgcaactgcagaatctaaagatggcacagggcaaggggctcacaggaatagctcattcatccccagggcagcaactgtgcccagggcaccaaaggaaggggactgagccaaggctcggagaggccacagccggacagcgccacagggagtggttgagccaaccagactgcatgtctataggaccagacccctattccacatggctcctggctgcaaggtataggcctgctcgtcagccaccagggaggtgagggggcagccctggccagtcagcttgttatcagttgcccatttcatggagtatctaggaccttacccagcgaggccacaagtgcgaagttgtctagcatcacgcggcggtacagggccctctgggctgtgtccaggagcccccactcctcctgggagaagtacacagccacatcctcaaaggccatctggtcctaaaagagcagggaggaagagacagccatggtctaaggctgggttatccaatcttttggcttccctgggccacattggaagaagaattgtcttgggcaacacataaaatacattaacactaataacagctgatgagctaaaaaaaataaaaattgcataaacatctcatgttttaagaaagttcacgaacttgttttgggctgcattcaaagccatcctgggcagtgggttggacaagcttagtttaaggtatggctgtgagccaggaccaagctccccatcccaacagccaccttccatgatgtccctcagacactcaccctccttccctgggttctgcccccaccatcttcagatggcacttccctcacatgtctgggacccctcccctctgccctccctgaccagaccccagatgccttcttggcctccccactggcaacgccatacacaagcaagctagaacaagtcctggctgggccctcagctgccacaccaagagcagccccaggtgtccactcgtgactcagcatgaccactcatgaccctccccagatgcacccttcctgctcttgtagcaagaaactgtgagtcccagcaggggcttcccaggcatacccatcactgggaccctcccctgctgagcctgcttgcctgacatttccaggctgctcatccagcctgagggactggatgattctcaccagtcgccacaggggagcagcctcaacaacctgtgaacacagaggaactcaatcccttcctcctttcacccggtgtcccctttcttcccctctctgttgccaccctcccctcctcagttaggtgctaggctcttcccaatagccccaggcatcccagctggtcttctttaccctcaagccataactgcccacacctggctgagtccctgcccattcctcagtccaattcataggccctgtccacagcccaggacgccaacaacgtcaggtccagtgacatgaccaacctgggacatcccagactcttgatctttcccctg

SEQ ID NO: 4553 - DNA, 4646 bp, Homo sapiens
gctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggcccgttacattattgacctccccagctggacccagttccgccaggacaccggcaccatgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtatcaggccgctaccgccactccatgaccaacctccctgcataccccgccccccagcaccccccccacaggaccgcttctgtgtttgggacccaccaggcctttgcaccatacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataagggccctgagcaccccaatcccggaaagccgttcactgccagagggtttccccgccagtgctaccttccagacaacgcccagggccgcaagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagcccttctgcaacgcgcccctccctggccctggaccctatcgggtgaagtgataccctgtcttgaacgaacaggccaggcgcagtgactcacacctgtaatcccaggactttgggaggctgagtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagcttcttgagggctccccagccatgcttcctgtacagcctgcaaaactgactcctagaagtaccccaccccacccctgctccttggaggacaacgtgatcactgtattcagctccatcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgcttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaac

SEQ ID NO: 4554 - DNA, 2514 bp, Homo sapiens
acacattaaaaaaataggtttaatgcaggtgggtcatggcatgacgaatttcacaggcaccggggacagcaggcggccaggtgctcagagggcaccaaggtgccacaactccctgcagcgttgacaccgcacgagcggcaccaccagccccctcccgcctcccgtcccaccttcaccctcagccaagaggcttgggtgactctgagtaatacgttaacaaaaaacaaagcttctttgaggaaacagcatgacttagtgcaaaagattctctgcagcaagaaatgaggcccacgcagggaagctcccgcctacctgcccagggcgtggacgcagcccgggctcatcagaggtcatccacagaagctgccgataaattagagagcacggtttacggccagagattttttgctttctctacctgatttagggtttttcaaaaagtttctcttccagtggcacacaactgtcctcatggctcctgggccactggtccgcctgacagggtagggtcacaagtcccacccatgcccagagtgtggggacatggatttgaggtgacactagggttgtcagtaccacaccctgtgtcctgctctagggtagcctctgcctgttgtccttgcaatcattattcagggcgccctcccacttgcccccaaagtcacacggccatgggcagtccaccatagtgctgccgtgactgcaaggctgaggagcagagcaaggggtcctgggtgagacctcggcccatggtggccaccctccctgaacacaggcatctgcgcccctccagcccacctgcccctgtgccatcatttgggccccccagacactggaggacagcgtgagataagatctcagcatatacctggggctctaagatgctgctggtgccacacaggctctggggctgtgtttgccgcactgaggcctctgccgcctgctccggacacttgggacacgcgtttccatcctggctcactgaagcctcgatctcccaggctttctttgacggtgttccctcaaagaaagaggcccaaagccctcccccgcaaaaaaagccagaaaggaatggaggtgcctccgcagaaatccagagcatctgcaagacatcctcacagccctcccagaacaggcagacaggccagtgttgctggagtcagcccctggctcccagggttccccccaggccagcccctgagctgggagcctgctgaggcccctcccacctgagcccttctccggccccccgctagactgcatctacacaatccaaggggaccctgaaggctggctggggactcaggacccacacagcccctcaggatgacacacacagggtggtccgcgggcagtgccaggcctcaggcggcccagggcagagtaagcagctttgtggcagtgtggtgtgtcagcgaggggagccttccgtgtcccgttggctggggctggggccagggcacgcagaaggggctgtgcagccaggagggcccccctccggaattgctcctgggcacacagccctctgtgtccaggggcctcccagggtgatgtctaaagtccctggcagctgtggtcctggagagaggcccacagagaggcggaacggagggcccaccccgcagtacgacccgaagacatgtgagcaggagccaccggcaggtgggcgctgcccctgagagtgcatacggggagggtgggtccaggaagccagcctaggggtggtgtccgcgcccccatcacagaagtctcagccctttcttttctctccgtgggcgccgggcagcagcgactgcctgggggatgggcgaagggaaggcgctggccgaccccacccatggagagaacacagccacaggccgggacgatacatcaagctcgcacccacggccctcacatgtccacgaagaccatgaagcaccagcccaggcccccgaccagcagcatggtgacgtggatgccatagacgagcagctcgttcaccaggcggaagtccacgcgccggcggcccagcagcagcagcagcaccgacagcttgcgctggaagcgcagcaggacgcgaacgcccaggtactgtaggcagaagagggcggccagcgcaccccagagcgccgcagtgaacaggctgcagctaaagtagagtaggaagcggatgaagccgtacagccagcgcgtcttgatgtacacgtcgaagttgttgtacttggtgcgggccaggtgggaggcgcgcacgggcccgcaggccgcatgcaggcaggtggtgtgcgggccgtggaaggagcgcacccgccgcggaatgggcatgaccggcattgggccccggcggcggcggcgctaggtcgcagtggcggcggcggtgtccaggcggctgttggcgtaggggtcatgggcgcctaggcctgggagcccgcagctgaccctggggctccgtgcgcagggcggccgcatggtgctggggcgcgcggctgggggcgctggcaaggcggctgagggcgtggttcacgcgtcgccggc

SEQ ID NO: 4555 - DNA, 3682 bp, Homo sapiens
agcgcggcccggctgtgtccctgcgtcccaggggctgggcgcgcccggcctgcccagcgggggatgcggggcgctgtcacttcctcccagcagccgggcaggggcggggggctggccgcgcgtcgcatggtatgtggagttcgggggacggcacggggacgacggggttgtcaggcgcggagccattgtccgacgacggctcctgataggccgcctggatggggcgcgcttggccgcgttcccgcgtcacacaccggctccagctgcgggagagcccgtcccaccccaactccccagccgcccctctgaagtgttccggtgtcaccgtggccacaaggaggcaggggacgggggcttcctgaaggaggccccctaaggggaagggggctacaaggctggccagagtgctggccgcgcggctgtgcacagggccttgagcccctccggtcgtcaagccttgcttgaaatgcgtaaatgcggaaaggtgaagtggctgacccggctcacaccactttaagtagcggagtggggttcctagccaggcctatgggactcccactggagcctttccccctctggggctggggctggacccacaggctgccggagcaggcagaaggggaggggcccaaggcccagactccagggcctcgtctggatcatcaacccggctttgcccattcagcgcaggcctccgtttccaggcctgtctccccatccacaccgtctctcagggtttgttttgggagatgtgggggtggggcatgtggggaggatggaaaggggctgtgaagggaacccactggagattcacttccttccttatttcacactctaggctaggaattcctgccctctggaaaggacccagacatttaggaatttcccgctgggcaggggcttccctcctgcctcactggggcctctgctcctcccctcttttgtttggcctctttccccgccccctgatcactccgccaccccttctgcagcctagtaacaggtcttccaggaccaggggggccagcggagtgggggcggctgtgggttcaggtgccctgggaactgagaacttcctcttccagagtgctggccaagcgccaggtttgcactcggattgccatccatcatcctgtctctggggaacctgtgggggagcggatgcgggaggccgccaggatgcaggatggggcgttaaggctgccaaccccaccccttctctcctaggactccagggatgacatttttcagatgagtccacagagccgcggtgtcccggggctgggagggtccttccaccggcaccgcgcagatggagttcatccacacaggggcgatgaggatacgggctgaggggccctggccggtggctgccttcacggctggctgctgtggcctcattgtgcaatccccacaagcctctcctgccagactctgttcccccaccccaccccctcaccccccctcccattcccaagcagatcgggaaattgctcgggaagtctgcatctgccaggagggcgttgtcaggccttaggccccactgtcccctcgaaggcagcccctggtctccacgggctttgcagggctgaggcggggctgccacccttgtcccccactgacggcagtggcccgcccagagcaccggctggggattgggaaacgaggctgctgccttggacttgtgtctgcaccagtcacttcccctctctaagctcaggcatgagggtcaatggtaacatacgtgaagtcctcaagacaaggaaagtcttctgaaaatggggcagcatggaggcccaagggatgacagccaatggggcccatagggcaggagcagtccttaccctcttctcgcagatgcagaaagcagttcccaagaggccaggcacttccagaggagccaaaggccagcctacggctcctccccagcaggaagccagcatcacatgctgggtggcgatgtttgtgaccagtggccagcggctgtcccattccccagctccccagggcacaggccaggggcagtgagcagggggctctgcctggtggggagggcagcagacaggagcagactggcaatgacctctccatttagcctagaaggcgagtgtgccagcacctggccaggagccacggtcagctcctcgcacgcaacccagggcctcagaggctacgacacatgggatgttccctcccttctgtctgccagagcaatgacagctgactgtttaaaaattattatggtacaatatacataatgcaatttataatcttttaagtgcacagttcagtggcattaagtatattcacagggtcgtgcaaccaacagcaccctccacctgcagaaatcgtcacctggcaaaacggaaactctacccactatgcactaactcctctttccctctcctccgggccctggcaaccgccattctacctttcgtctctgtggtcttgactattctatgtactgcaaataaatagagtcacacagcgtttatccttttgtgtctgcatctgccaggagggcgttgtcaggtttatttcactcagcataatgccttcaagattcattcatgtggtagcaggtatcagaattcccttcctttttgaggctgaatcatattccattgtatggatgggctacactgtgcattcattcatctctctgtgcacactgggattgctgctacctcttggctgctgtgtacagtgctgctataaaacatgggtgtgtataccaggtgtggtggctcatgcctgtaatcccagcactttgggaggcccaggcgggtggatcgcttgagctctggaactcaagatcaacctgggcaacatagtgagaccctgtctccaccaaaaatacaaacaattagccaggtgtgatggggtgcacctgtagccccagctacttgggaggctgaggtgggagaaccacctgagcctggcaggttaaggctgcagtgagccatgattgcaccactgcactccagcctgggcaacagagtaagaccctgtctcacaacaaaaacaaacaaacaaaagaacacgggtatgcaaatatctgttcacgttcctgctttcaattcttttgggtagactgctgatgtttgttgatctccaccggtgccaggcgttgttctaagtgttttgtatacattagccgatttcatcggacagcctaatgaagtgggcactaactctcttcttttcacagatgaggaaactgaggcacagagcggtccagtcatgtgccagccagtggtgaagctaggagccccttcactaagcacagtgttatcttgcttctcctccaacgttgctcagcgtctgaaattcagcttgatgtatttaagtcagacacaagaaaggacttctagaccaaggagtttagatgcagaaatgggaggaggaagccaggccaaggattccttttcgtatttggcagatggagaaaccgaggcctgatgagctctctggtactgatgcaaaatgcctaagtgcagctccggtcccttctgcctggggttcctgtagaacatgggcccttctcggagccggcataatttccaggaaaacagctgcagagctacggcctatgcagggttctgccaatgacagaggccagtcacgtggcaggacctctcttgggaagcccagtgctgcttcatggggctgtttggag

SEQ ID NO: 4556 - DNA, 1538 bp, Homo sapiens
cactccactgtcaaagattaagatcagagctacagaaatgatctgcgcaaatatagatgtcatggtcccctcaaaagtctttttggttccaggccagcggatctcccccatggtgctaccgaagatggaggccacagtatcacccacacccacagccaggacaccggcataggggacgagggccctggctcctcccaggctacccttctgtgtgcagggtctggggatcagccagatgggaagagacatgcccaggagcaggtagatgtgtgtcagaatgagtggtccactgtctcgttcatccagaaaaagggacaggaagctccgtagagtgtgacccaaaggcttgatgcggaagtagcgcacatactccaggaagatgaagaccgccaggcatacagtggcggctacatagagcagtggccggtcaaagatgatacctgggatgtaggtggctaccacaatgaggtggaaatactttcgggcgatggtgggggcctggtgcctgagtccatgaagacaaacagagtgctgaagaaaatgcccatgagtaccatccctactaccaccaccagcaggaagaagtccactgggtccccctgactttccaccagtgtcagagagcgcttgatgagctggttgaggacaaagctaatgccacccaataccagcagtgcctcaccaggggtgaagcagcggggcagcaggtacagcaggatcatgttgagataaacgaagatcagaaggacttccaggacttcgatcacctcccccacgctcaacgagtgcttcatgatataaatgataacacctccagccaagcccaagatgacacaagtgttggttggcactgggcgagtgatgccgagcgccaacactgatgagaagagggccactgccatgccagtggctgccaccacaatgccaaaacgctcaaagaacgggttcccagcagtctggcaccgctccttcatgactagtccaagcaaaggcatgaccatggaggcgggcaataggccactgtttgcggacattcggaactggaagacggcgcttccctgctgtagcagccggtcccacttgtattggacgtagaaggcctgcactgcgagggccacggcgcaccacgagtatcggtcccatacggttgcgtggatgctcagcaccactgcaaacactactgccgcctctgccagcaccgatccactcagcggagccccaggccccggggccggagatgggcactctcgggtcatatctctagacctggggcttcacggaggccggggcgactacggacgccctagacttcgggcccctcagccccgtcaagcagagggaggcactttcacccggccagcaaccttctccctccgttctccagcagcgaggagggaactccaccgcaggtcacttctgcggcctgggagctggcgcccggccaccccccacagcctccaacctacggcgtagacgtcgccactctgcagccttcctcacagttacagccgcccccgctgccggctcctcacctcttt

SEQ ID NO: 4557 - DNA, 3971 bp, Homo sapiens
aagattttggttggagtcttgtagctaagattgagctggagtcctggctcctgaggacaggcactttggccattctgagaaggtctgctcaggccaggagcctgcagctgagagttccctgtggaagggaaacagaagtttaactggggacaacaacacttgtttatttcgaagcctgttgtgagcccatggacaggatgtactgtctatggctggggtcccactgctcccttcctcccggcattgttcctcttaggaagccgggaactcaggccagttctggaaagtccctagggccttccctggccaggcctgtgtcatgggcccccctggagagcacctacctgttgagtactggtgtcccatgaccacgtccatacaatgtatctgggactaagttcacctccatgtgccccacgggctcctctgagtctcaagctctcacacaaggtacagacgagacagcaaagtccagccactctctggggccctgtggccttattgtccagcggccacctgggcgttgtgttgacatacttggtgcagtgatttaatacccggtgtcaggctgatgtggagggtcattcccatttctctagctcaccagctgcctagctgagccaatcctgggaaacagagagggtaacagagctaccagcatgtccccacatagtggtcctgcctgctgctattggcttcatgtgggttcacagctgcccagagcaaacatagtcaatgctcagagcctcctcaaggagctgaagtctcagcatcaagctatgaatggtcccactcactacaaactctgatcgctccaaaccattccctgctcagcaccctaaggccttgcagttggggaagctgactgaggggccggtggggaagcagatccaggggccggtggaggagcagtagggactggcccttgagttctcatgcagcccacagcatcctgtgaagcagcagccaggttctgtgggcacaaacggccagggttccagtccagcttggctgtgtgatatcccctcaccccacagtgccaagtgaagagacttacccaccctgggtcctgggaggaagccaggtagactataaagtcctctacgtgcctgaaggaatttcagtggactggtcatgctagatcctcacagagggacttccctgcccggtaccagctagctcctaacaggaggtggcaggccactgggcaagtgatcaacaggcctgtcaacagctcagtcaagtccccagccccagtgctgaccactgacttctatgccaggcctggcgctgcgacacacagaatcccacgcggtacacagatatccaccctcctctgtggctggcctctcactcctgtgctccgtggctctggctactgggaagagccaagcaatttcatgtgtcgggtcatgctcaggctaaagctacagcttctgaagtgggattatgggctcagcatgtggcctcggtaagccgactctttattgctgactttcagaggcctgatgcttctctgccaactcagcacatagcagccgcctctgaatggctttttaaataaagctgggctagctctctccaggccaactggccaatcatgtcgtttgttttcccacatgcagagctcatccataaacactaagcacgtaatgggcacctaccgtgtgcagtacctgttccaggcaagttggaggaagcaaagatgaaaaaacttgagccattaaagccaattctaccaggagccatgctgagcctctagtttcacttctgttctctgggccttctgcctgaacctcaggcacaactaaaggaggtgcctcctccatgcggccctctctgcctgtccttccccctctgccacctgccagcatggacagtttgttacctgcagcctgggctcagcttttgttccatttcctggagctgccttggcaaagcaccataaactgggtggctttaaaccacaggaatgtattatctcacagttctgggggtcacgagtctaaaatcaaggtgttagtagggccatggtccctctgaaatctctagggaaggatcctactttgttttgtcctggcttctgggggtttcctggcaacacttggggtcccttggtttatagctgtatcaccccagcctctgcctttgtcttcatatgagtttctctcctctgtgtctgtgtcttcacacggtgtcttctctgtgtctgtgcccaaatttccctcttataggaaagaataccagtcattggattacggcccactgtaatctgatatgacctcatttccctttaattatacctgcaaaggccctatttccaaataggagcaccttcacagcgtccttgtggacatgaatttgaagggacgcaattcgacccagtacagttaccacctgtcctgagcacgtggcattcagcagcaagcagaggcccattccattctgcaaggcatgccccctgtgccatccctgtgtactctgtgtgtttcagcagtgccatgtcggtttcactcccatgtgaggggacgtgtcaggaggaagctgggcaggcagttgtgtgtgtagacacccaccacgggccatcattataaagttctgtcctttgcagctgctgccagacatgtcaaattctctctatcaaaagctggatctctttattaaatagtgaaatgactccttagataacatgtggcacaaactggagagctggtgacactcagagctatcctggctggcaggcgggcagcggcgttccttccttccttcctccagcagtgcccctctggagaaggccttccctggctggaccagcactgtctgttcagagccataggcagctgagtcctggggctcccccttgccatcaccccattatcctctcgctggcctccgaggtagtcggaaagggctctgaggatgctggcagtgggaactaaaggcttccggagcatgggagctgcaggccaactgcctttactgctgccttctcaagctggttttcttcctttgctgagatcgcccttgacgtctccacagtgtgtttctgtttttccttttggtgttatcgccactttgctgattttcccctaacaagtgctctaggtcccagagggcaatgtttttctggattagaaagtagaacagctgatttcttgcccacctgtttctcagacatcagaagctgcagagaggctgagcttgactcagtcccccccatccccagatggcttcattttacacctaggttggttccaggaccctaaattgggctctgtctgcttgtatgggtggccctaggatttgcatcgggacctcacagtctataaaatccatggctgtggaatggaaaatggtgcagcactttgggaaatagatttagcagtttttacaacaagtaaacataaatgtaccacacaaatcagcaattccactcctaggcatatacctaaagagaaagagaaatatatgtccagtcaaaggcttgtacacagatgttcatagcagctttatttatcacagccaaaaagtggaaacaatggaaaagcctctcggctggtgaatggataaactaaatgcagtaaatccatataatggaatattattagatcacaaaaacgaatggagtgatacatgctgcaatatggatctacctcaaatacatcatgttaagtgacagaagctagactcaaaagaccacgtattgtatgattctatgtataggaaatttccaggacaaatctacagagacagaaagattaatggttgcttcaagcagaggttggaactaacagtgactgcaaaagggcacaaagaatctttcccagggtgatagaaatgctctaaagttggcttgttgtgatggttgcacaatttgataagtttactaaaattgttcaattgtacacttaaaatgggtgatgtttacggtatataaattatatctcaataaaactgttaggataatttaa

SEQ ID NO: 4558 - DNA, 14047 bp, Homo sapiens
agagctttggcgcaggccgcctgcgcgctgtgccaggaaagcgcttggagaaaatgtccggccccgcgacctgggacaggaagtgatggagcacggacttagtttgcctttcagttcttgtataaatagttttgagggttgtctctgaattttcactcagttgtctaccaagatgttgaatggacccagagccaaggacgtggtcttttatcagtggcacctgagactttcttccctgtggacgcaaatccattattcagcactctgggcacagctacagatctgatcagctatccattctccaaactatctcatcctctgtcccatttttctgtctctcttgtccacaaggcatatacctgagagttttcaaattcctcagagaaatttagatattctgtggctttggcattcacctaatgtgttaatctacaaaccttttttacagtgtggattttttttcatgatgtgaattcaagtggtttctaatggtctcttcataaagttgtaaaccaaaagtaaaattctaaggccccaccccatctgaatggaccccttctctgggccagggcactccaaattaacctgaaaaccgttcaggccacgacatgaagtgggggcgggtgggacatggctgactatgccctcctcccttttggaattcagggaaagccaacacagaccttaagtctaatgagaaacaccatctattctctctgaagcctgctaccccaaggcttcttctgctgataaaactttggtctccacaacctcttataacccagacattcctttctattggtaataactctcaactaattgccaatcagaacatttttaaatctacctataacccagaagcccccactttgagttgtcctgcctttctggactgaaccaatgtatatcttgaatagatttgattgatgtctcacgaccctctaaaatgcataaaaccaagttgcaccccagccacctcctgaggtctgtgtcatgggcgtggccactctatttggctcagaataaatctcttcaagtatttcacagaggttcagccttttcattgacaaagtattcatatcacttgttgaagaatcctttctagaatcttccacagctctttgagctgtagtttctgaagtccatctttattctccctcccatcactggctcctgttttgttctccagaactctgaaaatactaacaactatgattttgtgacccaatttggaagttcttacagggaaacctcagcaagaaacagctcagtgctagacgcagtggctcatgtctataatcccagtactttgggaggctgaggtgggaggatcacttgaggccagaacttcaagactagcttgggctattttaaaattttttaaaagggggagcatctcagtgactgcagcaggcctcagcctccactcccaacagttagttgggctctaccaactgttggccgagtctccaacctggagtaccacagccatcatcacccatggcacccaggagtgctccgtcatgctttccctttagttctaggggtagaaaatgccttcattcaagagaggacacacttaatgaatgcaaccagctagaatccacccttttaatatttaaatataatccacccttataatatttaaatatgtggctttgtttaatcctccccatgccaaggcaccatatccacattttactgaagagaaaactagagttcagagaaggtaacttgcctaaagccaagcaggcagtaagaggagattcaagcccagatccttttgtgctttttctgcatcatctcaggggcagcaaggctgactcttgaaagggaggttaattactatgaaattaaggtttaaagaaaaaacaccctggccaggcgcggtggctcacagctgtaattccagcactttgggaggctgaggcgggtggatcaagaccatcctggctaacatggtgaaacctcgtctctactaaaaatacaaaaaattagccagacgtggtggcaggtgcctgtaatcccagctacttgggaggctgaggcaggagaatggcgtgaacccgggaggcggagcttgcagtgagccgagattgcaccaggcactccagcctgggcaacagagtgagactccgtctcaaaaaaaaaaaaagaaagaaaaaacaccctgcgtgcatactcatatgaatgtacaaatggatgagtctagaacaagagatactagcctgttacatacacaaactatgcagctgcagtccctgctgcttctacaaccctgacctctaagaaacctctagctctgaatcctgtcagtacctgggctgtgctgcttgggacaacattgtcttcacaagtcctctccacattctcagaggtgggggtattgccaatgatgggggttgctgcctgagtcccgtcaccaggggacaaagctacagcagagaccaccatctgccaacaaaaagagagatcatctcccacccctggttctgctgacccaatcactggaagcatcaaggcaccactatctcctcatctgcctcagattcaatttcctcctagccaggtctgttctaagctctccagaagttgagaaattaactgaaagataacactttcctccctgcattaaggttcatcacataatgtatccaaatactgggtcagtctttcctttggtctcgtttctctcagctaatttgaaaatgccttttctgttttcattagaatttttctaaatgtttctgggcacttgtgttcctgaggctttccatagtgcaccctcttatgcatctgatgtctttggcacatataggccctcaacaagtatttgttaaatgaacagataaccatcctgtcctttgtgtgaacaagcatatgcaagtgtacattgtatctgtacatgtatccaacagcatccatctgaagccactttgttcgcttattttctcaggatgactgatggctgcatcatgacatttgcacacagaatcttttcttctccagtcacttttcctttttccagattcccgccatagaattccagggacagagccaaccatgcctggcaccccctcctgtcctgggacaatgatactttctcccgtgactcccatcttccttccaacattcttctgctagaattcagtaaggaagacaatgacttaccacttttaattttttccccttttttgcttttctaccaaatactgcttttaacacaggcttttcactgagtagtggacaatctatcagctaggtgctattcagtgtgaggggcatttgcaaaggtctgcatcagtgctggctgatggaactttctagtgatagcatcattctgtagctgcactgtccagtgcagaggctacttgccactgtggctactgctcaggatggtgcaggtctgaatatcttagacacagcggccaccgtgtctactgcacgggactgaatattttagacacagcggccaccgtgtctactgcacgggacggcgagggtctgaatatcttacagacagcggccaccgtgtctactgcacgggacggcgagggtctgaatatctcagacacagcggccacggtgtctactgcacgggacggtgcaggtctgactgtcttagacacagctcacctttgatccgtgttaggaattatccacatctcctctctgggcaatattctactttctttttatattgacccaattattttacttctttggtgtgtcctttctcctcacacacatgggttcactttaaaaccttgaaacccacatttataaaacattttcaatatgaaacatcgttccatgactcatatagtactccatggagtactataaacatttacatttccagaccacccactgcccagtggttttcctggtctcagtactcatgaaaatggtctgaaggtttgttttgggttcctaagcagtagacacacacacaacactgcctgtcagttatttcttggaaactaaatcagcccttctgttgccatcctatcatgcttcaggggtgcctgtgctagtttttaattctttgtcctaacacttaaatgtttgctcaaacgcccatattaatacttcctcttagtttacaaaaggatttactttcttactggttgggatgaagctgcctgaggttgccacctgttacttttccttcatttattggaccaagtcatcccattacatgtcagctgtggaggttttcaaactgtggtccctggacatgttagaaatgcaaattctcaggccgaaccaggactgaaccggaagatctggggtagggtccctccaggactgaatcggaaggtctggggtggggttcccccaggactgaatcggaagatctggggtagggtccccccaggactgaatcggaagatctggggtagggttcccccaggactgaatcggaaggtctcgggtagggtccctccaggtgatcctgttacacaggttagagaaccacagcattggggtggcaatttgacaactctttttttttttttgagacagaatctcgctcttgttgcccaggctggagtgcaatggcgcactcttggctcactgcaacctccgcctcccgggttcaagcaactctcctgcctcagcctcctgagtaactgggattacatgcacccaccatcatgcctggctaatgttttgtatttttagagatggggtttcactatgttggccaggctgggacaattcttaaactgtcattctttactcacttatttgcaggaattcttctgtaaagaacttttcctaatcagcaaggtttccctgattgcaatttgtagacagaaggtgggataatcgctgatcttccctcaagtgtccactcccagtgttaggagttagtgccctaggtacctccaagagtgaccaattacatgtgtttggttggttggttttggctttgaaaccatcactatgaattcatggttttcatgtattagagaccaagtctaggtgcttcatgtgcctactgctcctggggcagagctaggaaatgtgtctatgtgaaaggaacaacagagttaatgcttatatttctatttcaaatttagtatatggttttacacctttttctcagaaaaatctttttttattttttgagatggagttttgttcctgttgcccaggctagagtgcagtggcacaatctaggctcactgcaacctccgcctcctggttcaagagattctcctgcctcagcctcctgaatagctgggattacaggcacctgccaccatgcccagctaatttttgaattttagtagagatggggtttcaccatgttggcaaggctggtcttaaactcctggcctcaggtgatctgtccacctcggcctcccaaagtgctgggattacaggtgtgagccaccgcacctggccagaaaaatcttagttttagcattaacataattagttatagttttaactcccaccccagataatttcaaaggcttaataccaataagacaagtaacaaggagatgattgattgaaatttaggatttcagtggctctatttgtctttaaactatggctcactaaatctgcatacttgaagtgctgcgttctggcgatgctctgatgacacacgaagtaataggctgtgtgactgtcaccagcctgatgtgcagttgggctgcagaaccctgtgatgctgcctagcccagccagccccaggtcactcctcagactcaaacttgattctgacaccaccagcacccgggatgctgcctaggggctttctctggtggcaggagcatgtcctggattaggccggggtgcccggaattgaccatcctgaccctgtggagcgtgggctggtgaaggaatgcaccagctcccacaatgagcacgggcccagctgcccacgtgggatccggctcccagacaccctgtgccctcacctctttcctgtcttacctcccgcttcccttcagctgctgctcagggccaccttccaaattttggtctcagggttggcacctgcagaagacaatccaaggaatttagattcattcatttcagatactattctttcaattttagggactatcttaaaacttagtttggtaatatgtaaaacacttataatttcaaagtccagatattacttcagagtctatttcagtctcacttccaccattgacccctgtcctccacagcaaccactttagttttttatctttgtactgttttaagaaaaagcaaatatatatttgcattatatgatatgtactctgccccttatcaataggtcttcctcatccctccttctggtactgagttccccactgtacgaattaatgttcctaatcccctactgatggacattttgattgtttccagttttacaaatgccacagtgaagaacttggttgcaaacatatttaggcgtgaaaagaactctgtgagtaaagtcctttcatttttttgccagagttttttttgaggcagtctagaattgctgagtcaaagggcaaatgccacatacttttgttagatgctgccaaatcctcttccatgaggttgcaatgttctgcattccacagtgacgtatgagagtccttgtatcccacagcttcataaacaaagcatgatgtcaaacctgcacatttaccaatcacacaggtgagaaattttatcctagtttcacctttgtttttggttcgcatttttatgaccagcttttttatggtgtaatgcacagaagataatgaacacactctacccacaagcttcttcctgtgcctttggaatctgctcctgccagtctgcagggaaccacggatctgctttccgtcacgtaggaggcattctcgacaccctctgtacacagtatgcacttttaaaatttggcttctcttacacagcatagtgactttcagatttattcaagctgctgcgtgcaccaatagtccgctccttcctagtgctgaggcccccatcacatgagcacaactgtttcctgtgtgtgatgtgttgttctctggctgtgcactgccaaaaaagacatcattaaaaaaaaaatctaaatataatgtaaaacctgccttgtcttaggaaaagtttttctggcagtggctcacacctataatcccaatactctgggaggctgaggcaggaggactgcttgagcccaggagtttgagaccagcctgggcaagatggtgaaaccctgtctctgtaaaaaatataaaaattagccaggcatggtggctcacacctgtagtctcagctccttgggaggctgaggtgggaggattgctggagccccggaggtggaggttgcagtgagccgagatcacagcactgcactccagcctgggcagcatggcaagactctgtctctaccaagaaaaaaaacaaaaaattaatataaggaaaaacaaaaggtttttcttaccaaaaatacactttaaggaacaaatttatcatattaagttggtgcaaaagtaatcgtggcttttaccattgaaagtaatggcaaaaactgcaattacttttgcaccaacctaatattactttctaatgacaaacttggaaataattgtcattgttctctaaaaagaacagcctaaaaataaagcagcagcccatttacttctatgccagttcttttagtatttggttatttaaactggtggtccctaaccttgttggcaccagggactggtttcatggaagacactttttccacggacaagtgtggggatggtggggatggtttggagatgaaacggttccatctcagatcatcagcattagattttcataagcggcgcataacctagatccttcgcatgtgcagttcacaacagggttccactcctatgagaatctaatgccaccactgatctggcaggaggcggagctcgcccagtaatgatatgacagggggcggatctcacacagtaatgcttggacaggaggcggagctcacacggtaatgctctgccgggaggcggagctcacacggtaatgctctgacgggaggcggagctcacacggtaatgctctgtcgggaggcggagctcacacggtaatgctgtgacgggaggcggagctcacacggtaatgctctgtcgggaggcggagctcacacggtaatgctctggcgggaggcggagctcacacggtaatgctctgacgggaggcggagctcacacggtaatgctctgccgggaggcggagctcacacggtaatgctgtgacgggaggcggagctcacacggtaatgctgtgacgggaggcggagctcacacggtaatgctgtgacgggaggcggagctcacacggtaatgctgtgacgggaggcggagctcacacggtaatgctgtgacgggaggcggagctcacacggtaatgctgtgacgggaggcggagctcacacggtaatgctgtgacgggaggcggagctcacacggtaatgctctgacgggaggcggagctcacacggtaatgctctgacgggagggcggagctcacacggtaatgctctgtcggggggcggagctcacacggtaatgctctggcggggggcggagctcacacggtaatgctctgccgggaggcggagctcacacggtaatgctctgccgggaggcggagctcacacggtaatgctgtgacgggaggcggagctcacacggtaatgctctgtggggaggcggagctcacacggtaatgctgtgacgggaggcggagctcacacggtaatgctctggcgggaggcggagctcacacggtaatgctctgacgggaggcggagctcacacggtaatgctgtgacgggaggcggagctcacacggtaatgctctggcgggaggcggagctcacacggtaatgctctgccgggaggcggagctcacacggtaatgctctgacgggaggcggagctcacacggtaatgctctgccgggaggcggagctcacacggtaatgctctgccgggaggcggagctcacacggtaatgctctgccgggaggcggagctcacacggtaatgctctgcggggaggcggagctcacacggtaatgctgtgacgggaggcggagctcacacggtaatgctgtgacgggaggcggagctcacacggtaatgctctgacgggaggcggagctcacacggtaatgctgtgacgggaggcggagctcacacggtaatgctgtgacgggaggcggagctcacacggtaatgctgtgacgggaggcggagctcacacggtaatgctcggacgggaggcggagctcacacggtaatgctctggcgggaggcggagctcacacggtaatgctctgacgggaggcggagctcacacggtaatgctcggacgggaggcggagctcacacggtaatgctgtggcggggggcggagctcacacggtaatgctctggcgggaggcggagctcacacggtaatgctcggacgggaggcggagctcacacggtaatgctctggcgggaggcggagctcacacggtaatgctctggcaggaggcggagctcacacggtaatgctctgtcgggaggcggagctcacacggtaatgctgtgacgggaggcggagctcacacggtaatgctctgtcgggaggcggagctcacacggtaatgctctggcgggaggcggagctcacacggtaatgctctgacgggaggcggagctcacacggtaatgctctgacgggaggcggagctcacacggtaatgctgtgacgggaggcggagctcacacggtaatgctgtgacgggaggcggagctcacacggtaatgctgtgacgggaggcggagctcacacggtaatgctgtgacgggaggcggagctcacacggtaatgctgtgacgggaggcggagctcacacggtaatgctctggcgggaggcggagctcacacggtaatgctctgtcgggaggcggagctcacacggtaatgctctggcgggaggcggagctcacacggtaatgctctgacgggaggcggagctcacacggtaatgctctggcgggaggcggagctcacacggtaatgctgtgacgggaggcggagctcacacggtaatgctctggcgggaggcggagctcacacggtaatgctctgacggaggcggagctcacacggtaatgctctgacgggaggcggagctcacacggtaatgctctgacgggaggcggagctcacacggtaatgctctgacgggaggcggagctcacacggtaatgctctgacgggaggcggagctcacacggtaatgctctgccgggaggcggagctcacacggtaatgctctgtggggaggcggagctcacacggtaatgctctggcgggaggcggagctcacacggtaatgctctggcgggaggcggagctcacacggtaatgctctgacgggaggcggagctcacacggtaatgctgtgacgggaggcggagctcacacggtaatgctgtgacgggaggcggagctcacacggtaatgctcggacgggaggcggagctcacacggtaatgctctggcgggaggcggagctcacacggtaatgctcggacgggaggcggagctcacacggtaatgctcggacgggaggcggagctcacacggtaatgctgtggcggggggcggagctcacacggtaatgctctggcgggaggcggagctcacacggtaatgctcggacgggaggcggagctcacacggtaatgctctggcgggaggcggagctcacacggtaatgctgtgacgggaggcggagctcacacggtaatgctctggcgggaggcggagctcacacggtaatgctgtgacaggaggcggagctcacacggtaatgctctggcaggaggcggagctcacacggtaatgctctgtcgggaggcggagctcacacggtaatgctgtgacgggaggcggagctcacacggtaatgctgtggcggggggcggagctcacacggtaatgctctggcggggggcggagctcacacggtaatgctctggcggggggcggagctcacacggtaatgctctggcgggaggcggagctcacacggtaatgctgtgacgggaggcggagctcacacggtaatgctcggacgggaggcggagctcacacggtaatgctctgacgggaggcggagctcacacggtaatgctgtgacgggaggcggagctcacacggtaatgctcggacgggaggcggagctcacacggtaatgctctgacgggaggcggagctcacacggtaatgctgtggcgggaggcggagctcacacggtaatgctctggcgggaggcggagctcacacggtaatgctgtgacgggaggcggagctcacacggtaatgctcggacgggaggcggagctcacacggtaatgctcggacgggaggcggagctcacacggtaatgctctggcggagggcggagctcacggcaaggctctgagaggagaaggagctcacagtaatgctctggcagggggcggagctcacacggtaatgctgtgacgggaggcggagctcacacggtaatgctgtggcggggggcggagctcacacggtaatgctcggacgggaggcggagctcacacggtaatgctctggcgggaggcggagctcacacggtaatgctgtgacaggaggcggagctcacacggtaatgctctggcgggaggcggagctcacacggtaatgctctggcaggaggcggagctcacacggtaatgctctggcggggggcggagctcacggcaaggctctgagaggagaaggagctcacagtaatgctctggcagggggcggagctcacacggtaatgctctggcagggggtggagctcacacggtaatgctctgacaagagatggagctcacagtaatgctctgacaggaggcggagctcaaacggtaatgctctggcagggggcggagctcacggtaaggctctgacaggaggaggagctcacacactaatgctctgacaggggggcggagctcacagtaatgctctggcagggggcggagctcacatagtaatgctctaacatggggcggagctcacagtaatgctctgacagggggcggagctcacggtaatgctctggcagggggtggagctcacccagtaatgctctggcagggggtggagctcacacagtaatgctctaacgggggcggagctcacacggtaatgctgtcgggaggcggagctcacagtaatgctctggcaggggcggagctcacccagtaatgctctggcagggggtggagctcacacagtaatgctctaacgggggcggagctcacacggtaatgctgtcgggaggcggagctcacagtaatgctatggcaggaggcggagctcacacagtaatgctctggcagggggtggagctcacccagtaatgctctggcagggggtggagctcacaaggtaatgctctggcaggggcggagctcacacagtaatgctctggcagggcgcggagctcacacggtaatgctgtcgggaggcggagctcacagtaatgctctggcagggggtggagctcacccagtaatgctctggcagggggtggagctcacccagtaatgctctggcagggggtggagctcacaaggtaatgctctggcaggggcggagctcacacagtaatgctctggcagggcgcggagctcacacagtaatgctccaacagggggcggagctcacggtaacgctctgacaggaggcggagctcacagagtaatgctctggcagcaggcggagctcacacggtaatgctctgacaggtggtgttcacagagtaatgctctggcagggggcggagctcacacagtaatgctctgacaggtggcggagttcacagtaatgctctggcagggggtggagctcacacagtagctcaccggcccactgctcacctcctactgtgcggcctggttcctaacaggccatggactggtaacaatctgtggcctggggattggggacccctgatttgaataatcaaggacacactcacctagtaaaccgtctgccaagaaaaaggaggaaatgttagttttctccattcgttctcaggcaccaacattaatttgaacttagaaataaactacaaggccaggcatggtggtttgttcacacctataattccagcaccttgggaggccaaggagggaggatcacttgagaccagcctaggcaacacagtgagaccctgtccctacaattacaaaataaatgagctgggcatggtggtgcacacctgtagccccaactactcagaaggctgagtcaggaagatcacctgagctgcccaggagtttgaggctgcagtgagctgtgattgtactactgcaccgatcctgtctcaaaaaaaaaaaagaaaagaaaaagaaaaaagaaactatacaaaatatctggattttgatgtaacacaatacaaagattacatttgatttttaggtcaacaaatatgactaaagtcacaacagtaaaatatttcaaatggatttggaaataaaagaaagtttgttcatttatattttatttaagagctgtgcccagttttatcatctcacaagaatgaagcaagggacaaaggtaagtgccacgctccctggccactgggttcctggcaagctcccagccactaggtgccaatctcccttcaatgtactccttcttccccagagtgcagaagcgtatgaagacagttatgacatggacacatgcatgagctattatacataattacaaaagctgattctgtcatcaccacatcttgtctcatcagtaggagcgaatggctggcgggacggtggcacagtcagcctcgttcaaagttttgtcgatcacgggtctgagctccacactgaccttcccagtgccaacgtccacataggacagggtgtgcttcctccagtgctcctcaaagggcttcttctgttgcccctggatgggcttggagtaatcgtactcatcaatccgcacctgaggccagaaacaccat

SEQ ID NO: 4559 - DNA, 1979 bp, Homo sapiens
gcagacgcaaaagcgtcgtctgtggcggcagctagacatcgggcgaccctcgtcccgccaggttttggggtcgcgcaaacgagcgacgggggctggggctccggattcaggtgttctttcttcagcgctcacgggtttctgtccgtacgcgatgcgagcgaacgtcgcggtcgaggctagggccccgaagcccgcagtaatccacgtctcccgcccgctccgggcccccagtgccgccgtcgcgggcggaggcgcgaggtctgggctttggcgccttcgcagccgcaggcgacatcctctttcctagctaaagccccaaacgcccaggtggcttcctgggagagcacggctgagcctccgccttcagatcagaacaggcagagcctccaagggcggcttgggcccagtgcctgcttatcctgcccgtctctccacacttcttctttccctgtccgttggagtccattccttcctggaaaagccaaagccgcgctcccctaagaggcctggatgtgaaggtgagtgagacgccctggcctctgggtgcaaaggccggcgcctgccgctttcaacactcaggaggcgcgtttcagccccgctggcccccggccgcagactcggagcgctgagctcccaccgttcccatcacccgactcccttcccaggaatgaggagcacccgggaagcttcagccactacacgaaggaggcgccaagcccaaactcctccccagctaccggcggggtcagtgcagagccgcggagggcacacatgaaccctggcacgcagcctcagggaggggcaggctggaaatgaccctgcctgcagctgggccatcagcctgaccacctgccccctgagcaaacgttgatgcaggtcgggcgcggtggctcatgcctgtaatcccagcactttaggagcccgaggcaggtggatcacctgaggttaggcgttcacgaccagcctggccaacatggtgaaacaccgtcgctactaaaaatacaaaaactagccaggcatggtaatggggtgcacctgtagtccagctactcgggaggctgaggcccgagaatcgcttgaacccaggaggcggagcttgcagtgagcggagatcaccactccagcctgggtgacagagtgagactccatctcaaaaaaattaattaaagaaaaaacgctgatgctttctgaaatacattttattatcgctgtaccattctggggcactggagatggcagctgagaagcagagaagctggagacctgaagcctccacccttggctgtggctgccgagagaggcccctgcagagggagccccaggccacacccagacaccacagccagctcacagtgcggccagagggcacaggctgcttggggggtgagggtccccattcctgccacctctcacagaccatgacccacagggctgggggcttcccctgggagaaagtccttccctccccatggcccagccctggggaaagaaagcagagactaactcagggactgcagtaggctgaggacaagggaggtgggcttggggtgaaggccccccctcactcgcagagaagggacactaccggcagtagaggacagggaggcaggacgacggcagttagagacgaggcgtttcaggtgaactgtatgtagtgttactccggacgtgagcatggcctgggtcagtcgaatgaaatgagctgggcctcgctgccctgtgccggcggcccctgtgcctgcggttgctgggccacggggggctgctgctgggggggaccgccagagggtgccatctgtgcaggaggaaagcaggcatggccctggtcctcccttccccagcccagggaggaaggcttttgtcccagcagagccacagacccacaagtgcttgtaatccatgtccacggactgcagctcatgcagccagctcatgcggcctttgcctttcaagtaaattcacggtttttcctgtctaca

SEQ ID NO: 4560 - DNA, 5727 bp, Homo sapiens
gacacacaaggaatggagaggaaagaatgccatcagaagaatatcttcagagaattgcacaataaagagtaatggtaaggaaattttcttatagctaaggccaaatattgagactacagaaataccctgggaggctagagagaggcaacgtcatgggggtaagattggttttttgtttgattggttttttttggggggggcggttaggttttttctttggagaaggagtctccctctgtcacccaggctggagggtagtggcgcaatctcagctcactgcaacctccgcctcccaggttcaagcgattctcctgcctcagcctcccgagtagcttggattacaggcaaccaccacctcggccgaatgatttttgtatttttagtagagacagggtttcaccatgttggccagtctggtcttgaactcctgacctcaggtgatccattcaccttggcctcccaaagtgctgggattataggtatgagccacatacccagccagattgttaaaataatattattacaaggaggtgggtagaaaaggccaaaatcactgccccattaacttttcctaggccccagttcagacccaaactctttttagacttcccttttctaccatcatgggcagcacgggtgttgtggctccgagacccctcttctatccagctccctgaaaagaacaatgcccactaaaggcttgctgggagttgatccatcacttctggtttggtagaatgtttccctaaggatctcttgagcccaggaattcaagaccagcctgagaaacatggaaaaaacgcatctccacaagaaatgcaaaaatgaatggggtgtggtggtgtgcgcctgtagtccctaagggctgtcagaacttaggaggctaagacaggaggattgcttgagcccaggaagtcgaggctgcagtgagccatgatcacaccactgtactccagcctgggcaacagagcaagaccctgtctcaaagaaaaagtttccctaatgttgcccacatgggtaactccctcccacctatcccagttgtaattaagtgagaacactctagtccttgttcttaaatgaaggaagtgaaaatttgtgaggacaagaatgttctgggcctggtgacctcccgaagtgagcttggcagcaaatcttcccatttgccttgggaaagccctaaaaaaaccagagtatgggatactgatagtggttataattgctaacgaggttagggttttaacacatgacgcatgctaagtagtcaaaattccccattttacagaaagagaaactgaagttcaaagatgctatgtgcaatccccctacatggagacacagtctgagtctagtttctcaaggccttggcagggcctgagggagtgggtaacatgggtatggcttgtatacatttatgaattttgtatctgggaagcaatatggagaaatagcctgtaaggaaggaaaagattagacactatttactgcagctccaaacaaaactacacagaggccaggagcagtggctgatgcctgtaatcccagcattttgggaggccaaggtgggtgaatcacctgaagtcaggagtttgagaccagcctggcgaacatggtgaaaccctgtctccactaaaagtacaaaaattagccgggtgtggtggcacacgcctgtaatcctacctactcaggaggctgaggcaggagaatcacttgaacctgggaggcagaggttgcagtgagcttgagaggtgacagcctgctagcagtcctcacagctctcactcgctctgggcgcctcctctgcctgggctcccactttggcggcatttgaggagcccttcagcccaccgctgcactatgggagcccctttctgggctggccaaggccagagccggctccctcagcttgcagggaggtgtggagggagaggcgcgagcggaaccggggctgcgtgcagtgcttgcgggccagctggagttccgggtgggcgtgggcttggcgggccccgcactcggagcagccggccggccctgccagccccaggcagtgaggggcttagcacccgggccagcggctgcggagggtgtactaggtcccccagcagtgccggcccaccggcggtgcgctcgatttctcgccaggccttagctgccttcgcacggggcagggctcgggacctgcagcccgccatgcctgagcctcccaccccctccgtgggctcctgtgcggcccaagcctccccgacgagcgccgccccctgctccagggcccccagtcccatcgaccgcccaagggctaaggagtgtgagcgcatggcccaggactggcaggcagctccacctgcagccccggtgctggatccactgggtgaagccagctgggctcctgagtctggtggggacgtggagagtctttatgtctagctcagggattgtaaatacaccaatcggcactctgtatctagctcaaggtttgtaaacacaccaatcagcaccctgtgtctagctcagggtttgtgagtgccccaattgacactctacctagctgctctagtgggcccttggagaacctttatgtctagctcagggattgtaaatacaccaatcggcactctgtatctaactcaaggtttgtaaacacgccaatcagcaccctgtgtctagctcagggtttgtgagtgcaccaatcgacactctgtatctagctgctctggtggggccttggagaacctttacatttagctcagggattgtaaatacaccaatcggcactctgtatctaactcaaggtttgtaaacacgccaatcagcaccctgtgtctagctcagggtttgtgagtgcaccaatcgacactctgtatctagctgctctggtggggccttggagaacccgtgtgtccatactctgtatctaactaatctgatggggacgtggagaacctttgtatgtagctcagggattgtaaacgcaccaatcagcaccctgtcaaaacaggccactcggctctaccaatcagcaggatgtgggtgtggccagataagagaataaaagcaggctgccccagccaacagtggcaacttgctccggtccccttccacagtgtgtaagctttgttcttttgctctttgcaataaatcttgctactgctcagtctttgagtctacattgcttttgtgagctgtaacactcactgcaaaggtctgcagcttcattcctgaagccagtaagaccacaaacccaccagaaggaagaaactccgaacacatctgaacatcagaaagaacaaactccagacatgccaccttaagagctataacactcaccgtgagggtccgtggcttcattcttgaagtcagtgagaccaagaacccaccaattccggacacaagctaagatcacaccacactgcatcccagcctggcaacagagcgagactgtctcaaaaaaaaaaaaaggccgggtgccgtggctcacctttgtaattccagcactttgagaggctgaggagggtggatcacctgaggtcaggagttcaagaccagcctagccaacattgtgaaaccccgtctccactaaaaatacaaaaaaattagccagatgtggtgggcgcctgtaatctcagctactcaggaggctgaggcaggagaatcgcttgaacctggagcagggctggatggggggtagaggttgtagtgagctgaggtcaggccaccacacacaagcctgggcaataagagtgaaatgccatctcaataaatattgtgtttggttcttgagtaacaaaaactcaatacaatggcctaacttcataggtgtttatttttcccagttatgaagaagacttgagcaggcagtccagagctgatacagctgctccaatcaccagagatgcaatctcctgctagatgtcttcacatctacctttctatgtcacatgtgcaagatggttgctctgccttcagacatcacatttacattccaggcagaaaggagaaggaaagagcaaaagatgtgttccgaacaaatccatcttaaaaacaaacaaggggaggggtagcaggagaaaatttaaaaagaagaagaagaaaaacaaaaacaggaaagccgttgtttccctaaaagccccatcaagccgacttctaccggtgactcattacccagtcatgtggccacccctggattcaaggcagtctgaggaggtgagtgtttcaaagaggcacatggatgccacagacaaaatcaagtttccatggttgaaggagaagaggacgatagagtttggggaggcagcaggctacgtctgccacagaagatataaagatatggagccacacgagaagatgggggaggctgccaaaaaagtccactgggtacaggtgaggagcaggtgacattggagttgctccatctgaggagcccgcacctgcaatggcttgtgctcctgctcctgtgggtataggcacaaggctgatgccgagagagtgagttgtttctgttggggttcagaacacaataccccaaagtatggcgatgagtacttaactaaaggacattggaaggcctcagaagcagcctcagatccaaggtccctctgacctgctcctgccctcctgtctctctcgtccctcgttctcccctgaagtgagtcatagaaaccagaatcctcttccccacggtaggtcctagaaactagaaccctttttccccgaagcaaaagccataaaaactggaattattactctaaactctccttgactttttgtccagaagatggccataaagaaattctcagctaggtgtggtggctcgtatctgtaatcccagcactttgagaggccaaggtgggaggatcacttgaggccaggagtttgagatcggcctgggcaacatagtaagacccccatctctacaaaacttttttttttaaacttacctaagcgtggtggtacacctgtagtctcagctacttaggaggctgaggtgggagggaccctgctctggctgtgactgctttatcacagggagtgcctatctgtgggctgctttctacacattaaagcattttcagaaagggccaacatcagccttggaaaaaaggaggaagagccacggagagtctccctttatcttccccttatgtgatgtgagagtgcacatgactgtgtgcacatacacacacacacacacaccacacacacacaccccacaggcacacagggtcaagaacatgctgggcagagcttaagccactgaatgtttcagtaggaatcatgatatctaaaaataggacagctgataagggggttcttactactcacagttcctggaattatatgcaattgcatcttggaaactcaacaaataaacagttagtatggaattaaggaattaagtttggtgaagttcaaagaagctgatgttactcacaagagtaaatagagaggaaaccgggcgtggtggcttcacgcctgtaattctagcactttgggaggccaagacgagcagatcacttgaggtagagagtttgagaccagcctggccaacatgatgaaaccctgttctctactaaaaatacaaaaattagctgggtgtggtggcaggcacctgcaatcccagctacatgggaggctgaggcaggagaatcgcttgaacccaggagacaggggttgcagtgagccaagatcacaccactgcactccagcctgggcgacagagcaagactccct

SEQ ID NO: 4561 - DNA, 1297 bp, Homo sapiens
gcctagtctcacccctgtctccagaggtacaaaaagcgggggctgtccttgggtcccctccccacagcagatgctgcccccaggactagcccattcctctgtggcctcagaccctgcccacagcggagctgcaggccagagagatccctgaggtcagcgaggggtcagctgggcaggagttgggctgtgccgccccgcagtgcccagcctgtgctgggatcccctgagggaaaggggagggagaaggccccgccaggcctgtgaagggcaggcgggtcccagcaaggtgtcgctagtgtgaagttacccaccgctacccagagaccccagctggcccggagcatcagccttgcccctcgattgaggcctgcagagggaacgatcgcgctccactctccggaccgagctgctcccggacccacctcacagcacagccctcagtggagtccaagtcccaccccaagggcaggtagcccaagggcggttagaggaggacaccagtgtttcaaataaagaagaaaccccactcctgacatgggggaaggaagaggggacaaaaaacaaagcactcttcacgtcagccagctcttcaaactctgcccaagaggataagggcagcagcggcctggatgaggggaggagctgggcgtgcccgggtgctctgaggagcctgtccctgttcccgccagaggggacgcagccgggctggcctcaggtctgcgcttccggctgttaactactcttcttagttcagatctggaactcagcatcaggggagtgtgatcagggcccccctgagggtggccccagctgcaactccagggtaaggagtgtgggctctggggtcagacagcctgggttcgaatcccagcctcactgttccatagccctgtgaccttgggcaagtgaccaagttacttagtttttctgtccctcagtttccgccacggtaaaatgagaatgacagaagtgcctagactgaactaacgtgtgtagtcttttagtgcctgggcacatggcaagcgtgtgatgagtcactgtgcccgtcttatcgtcagccgtcatctcggtgcttttcacaaccaccctgttatgatcgccctccattttaaagaaggagactggggagcttcacccacggtcaccctcccacgtgcgaggcggagtcccgacccacgtccgtctgacggaaggcggagctttcacgcgaggcacgcacggaggcacacacagttacccatcctgccctgccctctggccgcccactcactgggcaagcaaagggctcagaggcgac

SEQ ID NO: 4562 - DNA, 11255 bp, Homo sapiens
agagggctgcggcgtgggacttccatggaaggaaggtccggcagcagggccttgtggggttggtggggtgatctaggggaagccggagagaggaccagggcccagcggagcagctgaagacttcctgggggttggggccggcagtgctggggctggcggcaggggctggggggaatgggcaggcaggatagagtgcggggccgcactggagggagttagagctgctggcccggtgacagaaggctgggggttggtatcgtttcggttcttaccaaggaggaggaggaggagggtggccaacagcatcctgggctgtccagaggtgccggaagggtcccggagcttctgtggtctacccgatggggtcgcggcggagccccgggcgcccaggctccctggtgccgcctccccaggggggctccatggcccgggctcgacccgtactctggatgccagggctgggggcggggaggcggcggcagcccgggagtaggggcggtgcctttcgccaactttggagttgttttctccgtccgccgccgcactcttctctcccggggccggctcctgaagccccgggtctcggcactggggcgcgccctcgcctacagcccgcccgcaggcagcgagcgcccctggtctggcctggtcgccacctgccggggtttgagaccacttcctcttcgggccaaactttgccgactgtcagcccccagggccggccgggtgctgctccactcctccagcgcgtccagccagcggagcgcgacagggaagcgggggaggggaagaggtggctcggcccggcgccccggcccttgcccaggcggtacccccgcccgcccaggggttggagtagccggggcgggtgacaagcccggtcccacccctgccaatcaacgcacgggccacacccacttgctcgccttaacccctttcccggccctgccggacttgtcagacgggcccttgacttgcagcttcagcttccacatttaaccctgctttgtttaatccttggggtgtaacacgtttgtcgttacaggacatgtttgtcatatgtttgtcacacgtttgtcaaaggacgtctgcttattccataactgtgatgtctttcctttgggccctaagctctcagtacttttcttgtcccagggtctgagatccggcagcacttttcggagtgagactttattacagctattaccacacggtacggtaactatttattcgtcattcccgcccccgccccgccccttctctgcaaactgaaacttcccgtaggctggggcctagactgtttacctttgcacctacagggcttctctcctgctgagacacaggaagaactcaataaatggtaaataaatgaataagtacgccttctccatttgctggctgtgacctccaggaaattacttaacctctctgttctcctcaggtataaaatgaggcttatgatagtgcaacttcctcttaaggttgttgctaacatttaaggagagcaagttccctgacatacaggaagtgctccatatctggtagcaactattattatcagtcacagaaggtgtttctaatttgtgtgagctggaggttaccgatttcctgtggcactgatagataacattaataaacaatattgaagctcagaattttcagtgaaaaaataaacacaacaaatagcaaacaattttagatttttccacttttcaggcacagatctaagtaagcactttactaaatacttaggaactattttagtatatactaaatacattaacactttacaagcatttgcgggtttaatcctctaaacaaccctgtgaggtacatactattattacttccaatttccaaggtattccgagaaatgcaggcacagaaaagttaagtattttgcccaagatctagtacagtgggccctccatatcttgggttctgcattcgcagatttaactgatcgtagatggaaaatattatcaggggtggggttgggggaattgagtggaattgcatctgtttttttttgtttgtttgtttgttttttgagacggagtcttgctctgtcgcctaggctggagtgcagtggcgtgatctctcactgcaacctccacctcgcgcctcccgggttcaagcagttctcctgcctcagccacccgagtagctgggattacaggcgcccgctgccaccatgcccggctaatttttgtattttgagtagagacgggtttcatcatgttggccaggctggtctcgaacacctgacctcaggtgatccacccgcctcggccccccaaagtgctgggattacaggcgtgagccaccacgcccagccgcatctgttttgaatatgtacataatttatttccctgtcattattccctaaacaataaagtatattgactattcctatatgtatatttgagacagagtcttgctcaggctgcagtgcagtggtgcgatctcggctcactgcaacttctgcctcccgggttcaagcgattctcccacctcagctcccccgccccctcccccccaagtagctgggattacaggtgcgcgccgcaacgcctagctaatttttgtatttttagtagagaccaggtttcaccatgttggtcaggctggtcacgaactcctgacctcaggtgatccgcccgccttggcctcccaaagtgctgggattaacaagtgtgagccactgcgcccggccatgaagctagggtttgaacccagggaatctggctctggacagagtgcacattctgatcttaaccactttctcccctctacaaatgatataaaatagttttttgttttgttttgttttgttttgttttttctgagacagagtttcacttttgttgcccaggctggagtttagtgacgcaatctcggctcactgcaaccttcacctcccaggttcaagcgattcttatgcctcagcctcccgagtagcttggattacaggcatgtgccaccacgccgggctaatttttgtgtttttagtagagacggggtttcaccatgttggtcaggctggtcacgaactcctgacctcaggtgatctacccgccttggccacccaaagtgctgggattacaggcgtgagccattgcgcccggcaattttaatttttaattttaattaatttattttttgagacagggtctcactctacaaaattgtgtagttgcacaattttggcttattgcaacctcaacctcctgggctcaggtgatcttcgcacctcagcctcctgagtactacaggcgtgtgtcaccatgccgggctaattttcatatcttttttttttgagacggagtcttgctctgtcgcccaggctggagtgcagtggcgcgatcttggctcactgcaacctcagcctcctgggttcaagcgattctcctgcctcagcctcccaagtatctgagactaaggcacatgccaccatggcagctaattttttgtatttttagtagagacggggtttcactgtgttagccaggatggtctcaatctcctgaccttgtgatccgtccacctcggcttcccaaagtgctgggattacaggcatgagccactgtgcctggcctaatttttgtatcttttgtggagatggggtttaccatgttacccaggctggtcttcaacacctgggccaagtgatcctcctgcttcggtctcccaaagtgctagaattataggcatgagacactccactcagcctatttatttatttgtttatatttaatttttttttttgagacagtctcacttcactgcccaggctagagtgcagtggcacaatgttagctcactgtaacctccaccttcctggctcaagtgattctcagcctcccaagtagctgggattacaggcgcctgccaccatgcctggataatttttgtatttttagtagagacacggtttttgccatgttgaccaggctggtcttgaactccttacctcaagtgatccacctgccttgacctcccaaagtgcagagattacaggcatgaaccactgcattcagccctattatttttatttgatttgatttgagatggagttttgctcttgttgcccagactggagtgcagtgcacgacctcagctcaccagaacctccgccttccaggttcaagcaattctcctgcctcagcctcccaagtagttgggattacagccatgtgccaccacgccctcctggctaatttttgtatttttagtagagacagggtttctccatgttggtcaggctggtctcgaactcccgactttaggtgatctgcctgcctcagcctcccaaattgctgggattataggtgtgaggcactgcgcctggccggccctattattttatttttatttttatttttttatttttttgagcggagtcttgctccgtcgcccaggcgggagtgcagtggcgcaatctcggctcactgcaagctccgcctcccgggttcacgccattctcctgcctcagcctcccgagtagctgggactacaggcgcccgccatcaggcccggctaatttttttgtatttttagtagagatggggtttcaccgtgttagccaggatggtctcgatctcctgacctcgtgatccacccgcctcggcctcccaaagtgctgggattacaagcgtgagccaccgcgcccggccccggccctattatttttaaaggctaatcaaataagcagtgggagtggaaaaggaacaaagaaatctgtaactgattgtgatcaactagttgtgaacaccactgtaacaagccagccagaagttttcttttttgtttgtttgattgttttttgcttttttttgagacagggtctcactctgtcgctcaggctggggtccagtggcacgatcttggctcactgcaacctccacctcctgggttaaagcgattctcccacctcagcctcccaagtaactaggattacaggtacgtgccaccatgcccggctaatatttgtattttttggtagagacggagtttcaccatgttggccaggctggtctcgaactcctgacctctggtggtccacccacattggcctcccaaattgctggggttacaggtgtgagccaccgcacccagactcagaagagttttctattaatgacatttattgttgtagggccttagttgggcctgataccatagagttggccataaaaaggctcttcttccacttggaccttggtcccacgccctaactctctctttgctcccaagattaatgagaagattgaatagaactgtgaaggtggaagccagggatttttgatatcttcagggatcctgaagctaatctctcgaatctcatgcagattgggattgggataactataaatgacaagcccaggagttctgagacaagcctggaaaacatagtacgaccccgtctctacaaaaaatacaaaaattagctggatgtggtggtgtgcatctgtagtctcagctacttgggaggctgaggtgggaggattgcttgagcccgtgaggttgaggctgcagtgagccaagactgcaccactgcaccccagcctgggcaatagagtgagaccccattaaaagaaaagaaaagaaaagaaaagaaaaagaaccctgaaggtgagaggcagatgcaaaaggaagcagggcaaagaggttggggaaattgaaaatgtttatgtcctaaaagtggtcacggaagtttcagctgagcactggctatattctttttggatgcctggaattcttaagacttcactttagcttcaaggagcttacagtctagttggaaagagagatcagatacataaattaacaatgccagacagccatggggagtacccatgggaatgggcatctcagggagtaggagtttggaaaggaagcaggaaaggtggtagtgagatgggaagagttatgggggtgaagaaagggggaagagaacccatggtctggaatgctgaataaactgaaatttgcagaaaatagtcaagacctgtgctgttgggcataatcatcatcaggaataaatggcacccaggcagaacacactttcattctgtaaatatttaagtgccttccaagtgcaagacactgtggcagacactgggagttaatattcaagattgaatgcaagccaaaaaaaaaaaaaaaaaagatgagggaaaaattcaagacgacctaggtctttataatgagtttaagctttaattagcttagtgagtttcagtgttcaggcccataaaaatcatatcctaaatgatcaagtacctttgggaatgggactgtggaaatattcttggaaatctttgaggaactatgaaaaatagtgaaagtagtgggaaatggacagatgtttatttttaaatttctatttatttatttgtagagatgaggtcttgatatattgcccgggctgatctcaaactgctggcctgaagccatcctcctgccttggcctcccaaagggctgggattataggcgtgagccaccgtgcctggctgatgtttagtttttaagatgataatatctaacttttatagaggactcaccatatgttaggcacggttctaagcacttcacatacattatctcatttaatcctgaccacattaggaagtaggtgttattttttgtcctcattttttaattgaggaaatagacagtttgacactttgctcaagatcaaactactagcatctgcaagagccaagacataagctgtctgaatcagaggccttgctgttaaacatggtagattctagaatcttcagagcaaggaatctaacacctggctaatttctagaatggatgccagtcatttacttgtctgtgttcagattaatcctgctgcctcttcctgcaaactgcacttcccaggctctctggccaagtgactttggggtagattcagccagcaggaggcactagtgggagactggaggggaggcagggaaggaggacccagggcgggccccatcccctctgcctcagctttgtctttagcagcagccgtgcatcttccatggttctagttcccactgggtagcctggcttcttaggtgctggtgacaccacctcctccctttgttcctccagcttcctgctgttgcttatctctgggctacctcaccatctccttttggacttttagcaatttcatcatatttttctcgttctttgttacatttcttctactgaattaactgttatggattgtttacctgaccagattctgacccatggaggtaatcatcactagtacctggcatagttcaccaactagacacatcattctaaaatcattcttggctgggggtggtggctcatgccggtaatcccaacactatgggaggctgaggtgggaggattgctcgagcccgggagtttgagaccagcctggacaacataaggagaccccatctttacaaaaaataaaaataaattatccaggcatggtggcacatgcctgtgatctcagctacttgggaagctgaggtgggaggatcacttgaaccaaggaggtcgaggttacagagagctgtgatcccaccaccttactctagcctgggtgcattccccatctcaaaaagaaaaaagttaattaattaaaaataaaaatcgactgggcgcggtggctcacgcctgtaatcccagcactttgggaggccgaggcaggcagatcatgaggtcaggagttcaagaccagcctggccaacatggtgaatctcccgtctctactaaaaatataaaaattagctggccaggtgcggtggatcatgcctgtaatcccagcaatttgggaggccaaggtgggcggatcacttgaggtcaggagttcaagacctgcttggccagcatggtgaaaccctgtctctactaaaaatacaaaaaaattagccaggcatggtggcgggcacctgtaattccagctactcgggaggctgaggcaggagaatcgcttaaacccgggaggcagagtttgtggtgagctgagatcatgccattgcaccccagcctgggtgacaagagtgaaactccgtctcaaaaaaataaataaataaaatacaggccgggcgtggtggctcacggctgtaatcccagcactttgggaggctgaggtgggtggatcacctgaggtcaggagtttgagaccagcctggccaacatggtgaaatcccgtctctactaaaaatacaaaaattagctgggtgtggtggcgggtgcctgtaatcctagctacttgggaggctgaggcatgagaatcgcttgaacccgggaggcggaggttgcagtgagctgagatcacgccgctgcactccagcctggcgacagagtgagactttgtttcaaaataaacaaactaacacacaaacaaaaccaaaaatcagctgggtgtggtggcgggcacctgtagtcccagctactcgggaggctgaggcaggagaactgcttgaacctgggaggcggaggttgcagtgagccaagatcacgccattgcactccaacctgggcaacagagcaagactccatctcaaaaaaataaataaataaataaaaagtaaaaaataaataaaagtacaaatcaatttcttttttgggagtattacttagtaccataaacatagactatctagatttaagccaataggaaaatatgggctgaatgataatacgattagtaccctcaagttgaaataggtattcataatgcacacatcaaaactgatgtcaatctgcagagtcccagtcaacatatacaaaaattaattaaggccgggcacagtggcttacgcctgtaatcccaacactttgggaggctgaggtgggcagattgctcgagctcaggaatttgagaccagcctatacaaaatggtgaaacccaatctctacaaaacatacaaaaattagccactgctctccagactgggtgacagagtaagaccttgttttaaaaaaaaaaacaaaattatatgaagatgtagaataagagttaattagattttaagatgacatgaattggaattgggagctagaagacaaaataaggaatctaaagattttgacaacctaggatgatggatctgagagatctacgatgacagaggagataaaaatgcaaaattcaggctgggcgcgatggctcacacttgtaatcccagcactttgggaggctgaggtgggcggatcatgaggtcaggagatcgagaccatcctggctaacaaggtgaaaccccgtctctactaaaaatacaaaaattagctgggcgtggtggtgggtgcctatagtcccagctactcaggaggctgaggcaggagaatggcatgaacccaggaggcagagcttgcagtgagccgaaatggcaccactgcactccagcctgggcaacagagcgagactctgcctcaaaaaaaaaaaaaaaaaaaaattgcaaaatcctacaacttaggttaaaaacaccaacttacagaaaggacaggtagcttaattattgtttatgtaaagaggaattaagcccagaaacttgggaggctaaggtgggagaatttcttgagcccagaagtttgagtccagccagggcaacatagcaagaccccttctttaaaaataaaaactaggagcctggcacggtggctcacacctgtaatcccagtgctttaggaggctgaggcaggtggatcacttaaggtccagagctcaagaccagcctggtcaacatggtgaaaccccgtttctactaaaaatacaaaaatgaaccaggtgtggtggcgtgtgcctgtaatcccagctacttgggaggctgaggcaggagaattgcttgaacctgggaggcggaggttgcagtgagctgagatcgcgccattgcactccagcctggacaacaagagtgaaactccgtctcaaaaattaataaaataaaataaaataaaataataaaaactaggggccaggcacagtggctcatgcctgtaatcccagcactttgggaggccaaggtcagaggactgcctgaagacaggagtttgagaccagcttaggcaatatagcaagaccctgtttctacaaaaaataaaaatacaaataaatttaattgacagattagagatttctgctggtgctgaatgaattagcatggcgtggttgcataaaagctaacatattagagaagcagaactggccagtactgccatttatcaggtgaatgaacttggcaagtttttacttttctatgcccaattttctccatgtataaagtaaggatgatgctaatattagtgttttagttatctattgctgcatagcaaattgccccaaaacttagggcttaaaacagtgaccatttattttctcacaggttttgtgtgtcagtaattcagaagtaacttagctgggtgattccgacttggtgtttctcatgaaggtgcagtcatctgaagacttgactggggctgaaggatccatttccaagatggctcacttatgtgcctggcaagtaggtattggctgttggcaggaggcctcagttcctccccatatgggcatctctataagctgtttgagtgtcctcataacatggcagctggcttcccctagaatgggcaatgtaagagagagcaaggtggaagtcacaatgcttttaacactcagtctcagaaagcacaccccatcatttctgcaatatcccttagtaacacaggtctgccctatgcattgtaggaggagattacacaaaagcacaaatattgacaggtaaagatcattgaggtccatcctgaaggctggctatgctagtctacactagtctacactctggctcccaaaggttcatgtccttcacaaatgcaaatctgttcaaccctcccaagggactcaaaagtctcatcccattacaaaatcagcttgaagtccagaatcttgtcatctaaaacaggcctccaggtgaggttcttctggactaattcctatgtacagctccttgagtagctcttcttgatctgaagacctatgaactaaaaagagaactcatattccctgtcctactcctccatcaccaacatacaatgatgagatgtgggaaaagcataggattacctctacaaatatttctattcacaaaaagagagaggtctgccgggcatgatggctcacacctgtaatcccagaactttgggaggccaaggcagacggatcacctgaggtcagaagttcgagaccagcctgaccaacatggagaaaccc

SEQ ID NO: 4563 - DNA, 3071 bp, Homo sapiens
cccttagcgcagaagccccgcccacctagactgagccccacgttgctgccaaggctccacccactcccccactctcctcccgctcggtcccccaagcctggctggctccactcactctagcacccttcactgctgcctcctcagggaatgcttggccccagcgccttaggaaggagcctgctagggccttcagcactcagcggtttcttctacgcaatttctcagtttcaaataaagcccgtctgcggggcaatttcggccatccagacggtgaccggggcacccgcgatggccacctgagggacacagcagacagatgggggcagagagagagagagaaacaggcgtcgggtcctacagccagcatcagccgctgtcccggggccgccctggagcccgtgaggagcgctcatgcacatggggccggcaaggaaggggccctcagaccgcgtggcccccgtggacggtgcgtggcatgggggtgggcagggcgccacaggcgggcaggtgcggcccctccccgccgccgcagagggccgggtcccactgcccgtctgcctcctcctcctcctcatcgccgccgccccgcagtgccctgactgccgccggcctggggcccccccgccgctctgcacaccatgccccacctctgcccatccgaggccggggtcccgggctcagcctcccacagagagctgctggcggggttttgtgcagccggatgccatcctgcggtcggcggtggcgggcaatgaggaggggggctcggccccgtggggctgctgcagggagaaacagccacgtggcaaggcccctgccgaggcgcctccccgggcgtctctccctcttggatgaaaagtggctcgctggaagccccctgtccttccaggccctgctaaccctgcctgctatctggggatggctggacagatccagcagccatcttgctctgccacctcccaggtgagtggctctgggagccacgtcccctctgagggcgtcagtttgcccatccctaataaagggacattaacaggaagaggacccattttctagagggcacaaggaagaaaaagacgggtgcccaggcatgtgcaagggcacaaagaatggctggtgccatcgccgttgtcactaccagccacatccccaccaccgccactgccacgatttcaatgctggtgtcccctctgaagtccgtgctgagatcactactgcggccttcaagcgactgatccatggggcccactcatgtgaatgggatgaggggcccttataaaagggcctgatggagggaggccacggcttttccgctccttgcaacccctctgccgtgtaggaagcagcacagggcctctctggagggttgctgaccaggcaacctcgtgggaacagagagcagccctccccgacacagccctgccttggccttggacctcccagcctccagaactgtgagagattttcgttctttataaatccccaggctgtggggttttgttccagcagtgcaaaggggccgagatgatcgccatcaccaccgtcgtcatcaccagtgtcagcacaacttgtctctgtccctgcagggcgcagcccagagctgagcagcaaagcatacatccccttttgttctaaaagggcgcctcattgagcctgcgtcaccccagccagaagtgcccttctgcgggtggtattccagagccgctcccatgccctgcacccacacggcccagggctcccttcccgagacccaaaggacccagagcaacagggaggagttgttaccatttggtttttcagggccccttcgaaccgaagccctcgctgacaggagcccctgccgtcaatcacaaccacggcgtagcccagggaggccagtgtgttgagccgcaagtacttgatgcctttgaaggagttattcaccagctgcacctgtggggaggtgagggccagcagtccagcacgagatgccgggcaggacgggcctggcaggggagatgccggtgggctggggaccgggccgggctggggcctcagagcctaatgaaagcacctgtgccccggaggctctggatggacacctgggagtggcaaggcgggaggggcccatactcgggaccctgctagggagggggaagggccactgtcaggctctttctcagctgggccactgccccagtcctgcctggaacaactactctggcatgatggacattggggtggctccttctcgggtggggccatctgggcactgcggggtgctgagaagccactccaggccaggagaactcgcagtggtgatgaaccacaaagtacccagacatcgccccgtatcctctgtggggacagagctgctctgggtaagatgtgcgcctaagatggtccaactgccaatctgctgcctgcttttgacccctgctccaggaattgggcccagggcccatggccacctccataccaacctggagactaggggacttcctagaggaacaagggagagtcagcaggcggagggggaaggggaggccatccaggaagggcggggagcgtgcaaacgggcacagagaaaggagggtgaggggccccgaggaccctgtgtagtcagggcaggcggggtgggctggggcaccaggcaggtagccggggagcctcctctggttgactgttctacagctggcacttgagtggggatggggagtcctcgggtggatggtggggtgggggcctggggagcaggtgtgcactcacctgggggcctccatatacaaagaggacggtggggtgcttcttccctggctgcaaggcgtggggcttgtagatcatgccgtagagccgcacatccgagcgcgtgtggaaatggaagatctctggaggaacataatccggggggcagcctgcgggagacagggcggctatctggctgcccggggaagccacatccagctgacacccttgttctcctgcccaccccaagccttggagggtggaccaaagcaccccctcttttcctgggcttcccgagagttgataattgaaaaaaacgtttttttttcattaaataagatttgtac

SEQ ID NO: 4564 - DNA, 1127 bp, Homo sapiens
ctatgtagatgaggcagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaagggatacatgatcccttaattcaggctcaggctgaagaactgacccacttacgacagaagacacaggaagggagaggtgtctgctacctttttacccagcatgtgaagaacacagtcaagtcttttgagggccttctcaggaacactggcattgcctactaccagagacagagattctgtgagcaaatggtacaaggaagccagctgacagagatccttgtcagaaaacttgtcacaggtaagttggctacaggctctgaagacccttagctcctcccaagtgtcccaaagtggggagaaaaaatgcaaacttatctccattgtagattttattttagttttgactatggtccttaatctgcattctattgttttctctttagagcactcaggtaatcacttttcatattctttcaagaattctaagttttgttttttattttgagacagaatcttgctctcttacccaagctggagtgcagtgacacggtcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggcttgtcttgaactactgagctgaagtaatccacctgctttggactcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccgctgtcttctggcttacactgttccaacaagaagtctgccataattcttatttctgtttctctgtacataatatgtc

SEQ ID NO: 4565 - DNA, 1622 bp, Homo sapiens
gggaagcagacaaaccaagaatgctaatgcccatctgacatcagagacggcagtgctccccagacctctcacagcaagctggatggacaggcagggccagaagagtcctccagccaagcctcctccttggttcttgtacccaaaggtagagaaactgcaggtcttcttgggtctgagcctggggcaggggttctggctggacgaaaaggggcagggaagcagcaggagccagagaccacaggctgagctggagcccacatggttcctaagggcagaacaggctctgaggaaagatgtgaacagctggaaggctgacagtgaggtctcagcagtgtggtgcacccctccccagcacatccgagtccctggggtcccaggtaccataggtactgcaagatttcccaagagacagcaccagcaacctgggcctgaccctgtacaaccgccaaaccatcacgagccccgcccaggcttgtgagaaggacatgcatggatcaagaccttgcccttgacccatctgcttctcagatgggctcccaatcaccagaggaagttgctgtaagcccactttccagactgcccccacactggggctctaagtttcaggtcggagattttatgctctgtgatcccccacttggggttcccagactccaagctcctggctcctgtgttcagtggctgaattcaacgtccgagattcggaatatgggctccagcctgcagaaactcttctccaggcattgtggtttgtgcctcctagtgttggctccctcatgaaaagagggtcaacacccttggcccccagccaagatctctgctcaatgtccatacaaggaggaagccaaaaccaagtgaggtgctggagccacattcaaatgtggttgataatcttggggcaggccagctctgatgtggatgaaagctgatccaactgtcgccacagctgcccagctgggtccgctgctcccctggctggctgttcagctgtctactaagcccaaaaaaaatactatgcctcactagcagaggctagacccagaaagagggaacaatgaggacccctcccctcccagaggaaagagctgagccactctccccatccagggaacagtaggtccaggctggatgctggtatgatgggaactgcccttttcacctgccagggagttcctaaagctgatcttcctggggttctgaaggttgcgacctaggttaatgagaccaaattctaggaaccactgcccaggccaaccaccgccagtgctgcagagatcaaagaaatccacagccacaggaaaaggagcttctttggacatgcccagctccaaactgtcccagggggaactggcacagcccttacatagcccaccccctcttggcctcaccgtggcctggaaattggccagagggtccacatcctgcccaaaccactctcctctcgtcccaaggcaaaggtgatgccctgaggcctagggctggataaagcccagctctggatgctgctaacccactctgctgccccaccccatcctccaatttttatactaggctctttgccattgtgacgtcccatgacatagtctgatgcacgataaaacaattatttctttatcttgcaa

SEQ ID NO: 4566 - DNA, 4596 bp, Homo sapiens
aaggaaggagggtgactgcagagaccggccctgggcagcggtaccaggggcacagggagcctggcccggcccattgtcactggaattcatgccatgcagacttctacatcaaagggaaacaaggtcaggagggccgaggggtccacggcactccgcacccacggggccaggctggcacaacgccccaacgctgcaatcctgggaagagtcacacgcgccctcccgggacccacgtgaccatcaagggagtgtggaggacacatccctcgggggtgacgcccctgcagatggagtttccccatctgtgccacccttgcaaggcctgggaaaggctgcggggccaggcggcaccgggcaagctgagtgccaggtggtggttgcaacacaccgggcaaatctgaaaccatgggacggacgagctgcacccctgggaaagagaacagaggaaggccggttatcaacgtcctcctgtgcctcagtttccagaaacaagccagactcagtgcctcagggagaccccgtgtggcctccggagagcacgggacccgccctttgtgcaggtgaggaaactgaaccccagagcagtgagggactggcctggggaccctgggctcagccctgggcgccttccctctgcccatctcagacgggcacagccagcaccgcctcaccccaacgcgcctccagactggccctccaggggcccccaggcacaatcctctcactttcttcctcaagcccctgccttcccccttcgcactgtgacccaggggctgctagcagctgggctgggctccaaagcttgaagctgcttctccaggtctctttccagggggcggcggatggctgctcactcagggacgccaacaccaacaggaagggacccatgcacggatctgacttccctcccaggctctgccttcactcaatgtccctgtggggcagctggggctcccggccgccctcccctgcccacagccgtgaggttgcttcctagggttctgttttccccacagtcggaactgaggtgctgggaggctccagaagagggatggggtggagcaagtggcctggagccccccagggcagaccccaaagagaagggtcagaagtgccctctggggcctgggcagctggggggagcccacaagcctgagaccctgtgggagggaagcgcccccaccccgtggtaagaaaggggctggtagaggctcctatgtggctccctctgtcccctcccgacctctggccaggcttgggataatccctgagtggacacaggcgccacgatggggtctcgggggtgagggctgaggaggctgagcctccaaggaccccagggtgcctgttcccactgcacacccaccagggcacagggtagggatagtgccaggagggccacagctgcagggtccatcccaggccgtggtacacaggtagaggtgggtgccagccttcgtgaagcacctgcagaagctccactcagggagagaacgaggcactcgcccaaacagatcctgggtcacacggggcagcaagagagggtggagcaagtggcctggagcaaagggttggaggccccggggcggcgcgttctcccccaagcccattccagggccatgggcaccccccagaggcagctggtgggactgcagccatgcaggtcctagagggcaggtgacaggggacgtgacagaaggggacaaagggccggcaacatccctgggggaggcacagagagggccagactgccctcggtggactgcggaacccagaacccaacggccaatcctccccctactcctcacccacagtaaggggccagggctccatgcaatgagaacccacgggtgatgccacacgggggagaagccacgcgggggagaggccatgcaggggagaggttacaagggggagaggctgcggggtgagaggtcacatggggcagaggccacgcgggggagaggccacgcaggggagaggtcacatgggggaggccacgcaggggagaggtcacatgggggagaggccacacaagggagaggccatgcaggggagaggtcacaatggggagaggccgcaggggggagaggtcacatggggcagaggccacgcgggggagaggccacgcaggggagaggtcacatgggggaggacacgcaggggagaggtcacaagggggagaggccgcagggggagaggtcacatgggggagaggctacacaggggagaggccgcacgctggggagatggtccctgcgggaagactccgaggcagtctcctgcagctccttccggcgaatccggttcaggaagtaaaaccagccctgtgtagaggtaagtgatgcttgtggggataatctccgagcagctcaccgcggcgctggccattgccgttctcttcacggtagaagagtccatttggggaaaaggtccccatcagagatggagatgttccctttcagactccaggctatggctgtggggccggctccctaccacgtgggctgggggctgggcacatgcatgcccactcctgggccctcttcctggtaggccacagcaccacacacactgcaaaccaggcctcttcttcatccaccaccaccgtccaggcctcaacatcaccgcgtggggtcttgtgccctctgggggaacttccgggctaatgaggggggacagtccccattaccggtctatctttataaggcagtatatgcaacagtggaagttctgtgagacatgttccaaccccggggctgctggcagaactgtccccaaacccaccctcgatcccacggccaggaagtgggtccaaaattgcctggccaggtcacacccctgcgtgaaccgccccacaacacccagggcgctgcctgacttgccgtccacctctcagcccctcccctcacccctgccgcagctgcagggcctaccctcgccgggggctgctccctgcttacctccctcgcccgtgcaatgcctctacttcccgcaaggcctaccgggagatgttacaggtcacggtcatatttgagcatgagaagctcacgcagagaacattctggctgagggagaggtcttggggttcaaggctgtttcttggctctgctcagccatgccaggcaggaaaatgggcacctctagtgacccaggctggctgagagcctgcagggaagagcctttggaacgtgagccactgtgggctggcaggactgcaactggcgtctccatctactggtaccgaggcgaggaggaaaaagcaggggggcccggagacggcccctctaagtctgtaactccagagctgctgctcagtccccagaacgtcacctccgagcagagcctgtgacaactgtcaactgtgaagctgtggcgtgggttgctactgaagctctgaagtcagcgaggacacagcatgtttgttctagaccgtttggctgcgggaggaagctgtacatgcacacactcgcctcaccaccctgcgagtccacaggcccctccccggagtcacctccaggtaaagggggccctgcgtcgggacttgctctctggggcgctgagatgctctacaatgagctgtgctgcagtgcacggccgcccgactgtgcacccgcaacggggaactgaacgctgcatgaagtacatctccaagttgttctttaagaaggcttagggtccctggaagaccctcgcccacacccagcgtggagcgttgttgctcacgtggccacacctctcgggatggccgtgggtctccgtgatgggcaggcgagtggaaccacaggtgcttcccgtcctggtcacaaagtcagagtggctgggccaagtgtcctgagaagagtcacctcctgggatcccatcagcctggccatagcagaacacccagacaggggcccatccccgaggctcaactcaacgcatgcagccactgtagaaaagtctggaaagtagttcttcaaccgactagacatggtgagcccaaaacccagccatgacactcctaggcatctgccccagaggaatgaaagcatccatcccctgcaaactcatccttacacagcagcgtgactcaagacggccaaaggcggaaacaccccaaacgtccatcagtggacaaacgggcagatgcaatgcactgtctgtaccgtgggatgtcactcagccatatgaaggaaagactccagtgtggatgagccctggaaccacggtgctgcgtgatcccgtaacacatggccagaacagacacggcccggaacctgaggccgggaggatgcgtgcaggtggcggggagacagaggggcgatggcccagtttcttttgggctgaaaatggtctaaagttgactgtggtgatggctgtacaactttgaatatgctgaaaactcgaattacacacttcagttgggcgaactgtactccatgtgaattacctctcgatggttctctcctgggctcaggcgcttctcccaccttggcctcctgagtagctggaactaccattcatgtgcggaaataaaacaactcggtctcaaaaaaaactcaactcaaaactcagtctcaaaaataaaaaaataaaaaagtaaaagaggctacc

SEQ ID NO: 4567 - DNA, 4598 bp, Homo sapiens
aaggaaggagggtgactgcagagaccggccctgggcagcggtaccaggggcacagggagcctggcccggcccattgtcactggaattcatgccatgcagacttctacatcaaagggaaacaaggtcaggagggccgaggggtccacggcactccgcacccacggggccaggctggcacaacgccccaacgctgcaatcctgggaagagtcacacgcgccctcccgggacccacgtgaccatcaagggagtgtggaggacacatccctcgggggtgacgcccctgcagatggagtttccccatctgtgccacccttgcaaggcctgggaaaggctgcggggccaggcggcaccgggcaagctgagtgccaggtggtggttgcaacacaccgggcaaatctgaaaccatgggacggacgagctgcacccctgggaaagagaacagaggaaggccggttatcaacgtcctcctgtgcctcagtttccagaaacaagccagactcagtgcctcagggagaccccgtgtggcctccggagagcacgggacccgccctttgtgcaggtgaggaaactgaaccccagagcagtgagggactggcctggggaccctgggctcagccctgggcgccttccctctgcccatctcagacgggcacagccagcaccgcctcaccccaacgcgcctccagactggccctccaggggcccccaggcacaatcctctcactttcttcctcaagcccctgccttcccccttcgcactgtgacccaggggctgctagcagctgggctgggctccaaagcttgaagctgcttctccaggtctctttccagggggcggcggatggctgctcactcagggacgccaacaccaacaggaagggacccatgcacggatctgacttccctcccaggctctgccttcactcaatgtccctgtggggcagctggggctcccggccgccctcccctgcccacagccgtgaggttgcttcctagggttctgttttccccacagtcggaactgaggtgctgggaggctccagaagagggatggggtggagcaagtggcctggagccccccagggcagaccccaaagagaagggtcagaagtgccctctggggcctgggcagctggggggagcccacaagcctgagaccctgtgggagggaagcgcccccaccccgtggtaagaaaggggctggtagaggctcctatgtggctccctctgtcccctcccgacctctggccaggcttgggataatccctgagtggacacaggcgccacgatggggtctcgggggtgagggctgaggaggctgagcctccaaggaccccagggtgcctgttcccactgcacacccaccagggcacagggtagggatagtgccaggagggccacagctgcagggtccatcccaggccgtggtacacaggtagaggtgggtgccagccttcgtgaagcacctgcagaagctccactcagggagagaacgaggcactcgcccaaacagatcctgggtcacacggggcagcaagagagggtggagcaagtggcctggagcaaagggttggaggccccggggcggcgcgttctcccccaagcccattccagggccatgggcaccccccagaggcagctggtgggactgcagccatgcaggtcctagagggcaggtgacaggggacgtgacagaaggggacaaagggccggcaacatccctgggggaggcacagagagggccagactgccctcggtggactgcggaacccagaacccaacggccaatcctccccctactcctcacccacagtaaggggccagggctccatgcaatgagaacccacgggtgatgccacacgggggagaagccacgcgggggagaggccatgcaggggagaggttacaagggggagaggctgcggggtgagaggtcacatggggcagaggccacgcgggggagaggccacgcaggggagaggtcacatgggggaggccacgcaggggagaggtcacatgggggagaggccacacaagggagaggccatgcaggggagaggtcacaatggggagaggccgcaggggggagaggtcacatggggcagaggccacgcgggggagaggccacgcaggggagaggtcacatgggggaggacacgcaggggagaggtcacaagggggagaggccgcagggggagaggtcacatgggggagaggctacacaggggagaggccgcacgctggggagatggtccctgcgggaagactccgaggcagtctcctgcagctccttccggcgaatccggttcaggaagtaaaaccagccctgtgtagaggtaagtgatgcttgtggggataatctccgagcagctcaccgcggcgctggccattgccgttctcttcacggtagaagagtccatttggggaaaaggtccccatcagagatggagatgttccctttcagactccaggctatggctgtggggccggctccctaccacgtgggctgggggctgggcacatgcatgcccactcctgggccctcttcctggtaggccacagcaccacacacactgcaaaccaggcctcttcttcatccaccaccaccgtccaggcctcaacatcaccgcgtggggtcttgtgccctctgggggaacttccgggctaatgaggggggacagtccccattaccggtctatctttataaggcagtatatgcaacagtggaagttctgtgagacatgttccaaccccggggctgctggcagaactgtccccaaacccaccctcgatcccacggccaggaagtgggtccaaaattgcctggccaggtcacacccctgcgtgaaccgccccacaacacccagggcgctgcctgacttgccgtccacctctcagcccctcccctcacccctgccgcagctgcagggcctaccctcgccgggggctgctccctgcttacctccctcgcccgtgcaatgcctctacttcccgcaaggcctaccgggagatgttacaggtcacggtcatatttgagcatgagaagctcacgcagagaacattctggctgagggagaggtcttggggttcaaggctgtttcttggctctgctcagccatgccaggcaggaaaatgggcacctctagtgacccaggctggctgagagcctgcagggaagagcctttggaacgtgagccactgtgggctggcaggactgcaactggcgtctccatctactggtaccgaggcgaggaggaaaaagcaggggggcccggagacggcccctctaagtctgtaactccagagctgctgctcagtccccagaacgtcacctccgagcagagcctgtgacaactgtcaactgtgaagctgtggcgtgggttgctactgaagctctgaagtcagcgaggacacagcatgtttgttctagaccgtttggctgcgggaggaagctgtacatgcacacactcgcctcaccaccctgcgagtccacaggcccctccccggagtcacctccaggtaaagggggccctgcgtcgggacttgctctctggggcgctgagatgctctacaatgagctgtgctgcagtgcacggccgcccgactgtgcacccgcaacggggaactgaacgctgcatgaagtacatctccaagttgttctttaagaaggcttagggtccctggaagaccctcgcccacacccagcgtggagcgttgttgctcacgtggccacacctctcgggatggccgtgggtctccgtgatgggcaggcgagtggaaccacaggtgcttcccgtcctggtcacaaagtcagagtggctgggccaagtgtcctgagaagagtcacctcctgggatcccatcagcctggccatagcagaacacccagacaggggcccatccccgaggctcaactcaacgcatgcagccactgtagaaaagtctggaaagtagttcttcaaccgactagacatggtgagcccaaaacccagccatgacactcctaggcatctgccccagaggaatgaaagcatccatcccctgcaaactcatccttacacagcagcgtgactcaagacggccaaaggcggaaacaccccaaacgtccatcagtggacaaacgggcagatgcaatgcactgtctgtaccgtgggatgtcactcagccatatgaaggaaagactccagtgtggatgagccctggaaccacggtgctgcgtgatcccgtaacacatggccagaacagacacggcccggaacctgaggccgggaggatgcgtgcaggtggcggggagacagaggggcgatggcccagtttcttttgggctgaaaatggtctaaagttgactgtggtgatggctgtacaactttgaatatgctgaaaactcgaattacacacttcagttgggcgaactgtactccatgtgaattacctctcgatggttctctcctgggctcaggcgcttctcccaccttggcctcctgagtagctggaactaccattcatgtgcggaaataaaacaactcggtctcaaaaaaaactcaactcaaaactcagtctcaaaaataaaaaaataaaaaagtaaaagaggctaccaa

SEQ ID NO: 4568 - DNA, 642 bp, Homo sapiens
tctagtaggaattactgagtgttttggaaggcacttgatagaggcatctctgctttccagcacagggattctcagccttctaaagatctagaccagtttccaagctagcttctccacagcccaccactgcctagtgtttgcttgtgtattctctaatggattttaggaggataggccttctgacagagtcatgaaagactgaaggcatgtctagggaaataaaacctgacttgcccttcagcaggaatgactggcagcggatctctgtgttcaaggaaagggtgagcgctaagcatgccagtgatggatccgaagtatttagatggattgcagaccaggaattagagaccgtttgtgactcaaggaacttgatggatctgtttagagccctacatgaatttgccaagggcagtgatttttatgaaattcaagaagcaaacgacttcgatacagctagaatatgttgcagtcttcctatttcaaacttgattttaatatttttaccaagaagtttaactgacaactctgcaaaattttcattcagtatcattaaacctgagttaaatgtttgcttagcttatcctcttagatgttcttctgttgaacaggcaggttgcccttaacagtaacttgctacttaaa

SEQ ID NO: 4569 - DNA, 2177 bp, Homo sapiens
gctacaagaatccatccacctacaccccttctccacctgggtgtctctcagacccagaaaatggtgccattggcccactgacaactaaatgtggggacaggtctcttacaagccactgggtagtaaaagcatcctgaggtggcataccatatcgcataattgcattaagaaaggcttttcgctgacgagcattaaaaccaagtacctaggggaagaagaaacccaggtgagaggcagcaggtcgcattccaccaaagatgcaatatctgacactcacccctccttagaatcgtatggcacttacttcaatattcccaccaacacgggccaacagaggaggcaatggcttatctttatcattccgcaggcccttacgactgggcctacggggagctgcaagaagaaaaagatgaatgagtgacacaggtaggatattaaacaaagcaacatttagaaaagcaacaaaaaaagcacagccctcaccttctgaacgttcatcaaagtcttcatcaccttcctctgaagccactgagtaatcggactggttgtcggactggtcgtcctgccaatctggagggagagagggcagatgagcggggcccactgctctagtggaacggcccatgggtggggggcggggccggccacacacacctcggtcctcctgggagccatcattgtagttgacctgtttacggattctttttcctttgcccagatttcgggctagatcttcttgctgctgctcataatggtgccgcagcaatttctcccagtagtcaggatccacactttcttcctgtttaatgatttcccgttctacctcctcttcctcctgggacagagggagggccaggactcaggagtgctgaagtcagcaccaccagctacccctggtcctcacagttcccactctgctagctccttttcatgactggactcttaaatacttggtgtgcctgtttggacctaagaacttagaagaaatttgattgagagtacacagctcctcataattacatatagattagcagtcagcataactcaagaaaaacatgggatagagctattatcacaggtaaggatgaagagacagaatgctttcttctaaccccttgcactgatgcatatacaattgaaagatagcaaaaagaaaagaggtcagagccttagcaaggcagaatggagaaacttctgaagtactgtaaaagattttcataagagagaaggaaggagaggatgactataagcctttctattcttcataaacttcataaaagcttaccaactgtctgcagaacgaaaagaattctatatagcctcttatgtcccaaaaacgttgatactcctctaaaagtgaatttttttcagacacttgaggaccactcactgattccacatcccttatattggaattaaacagctgctaatagcataacattagaaacaacctaaaagcccatcattatggaactaattaaataaattacaatcggccctctgtatccacgggttccgcacctgtggattcaaacaaccatagatggaaaatattcagagaaaaaacaaaattatgtctgtactcaacatttacagacttttttcttgtcattattccctaaccaatgtagcatttacattgcattggtattacttttatgtttacaaggaaaaaaaagtctttgggtacatatatgtgagtgtacatatatgtgtatgaatatatgtataatttgtatacacataaaatatttttggaaagatataaaaggaactgaaaacattagttgtccccaagaagggaactaaattgttagaggacaggagagaaaagagatacgtgtgtgtacatataaatatatatatatttttttgagagagggtctagctgtgttgcccaggctggagtagagtggcgtcattacggctcactgcagcctcgactgccaagtttaagcaatcctcccacgcagctgggaccacaagcgtgagcaaccacactcggctaatgtttttattatttagagacggaattttaccatgttgcccaagttggtctccaactcctgggctcaaacgaccctcctgcctcagcctcccaaagtactgggattctaggcatgagccaccgtgtctggcccttttgtgtattttgaactatgtaaattctatctatt

SEQ ID NO: 4570 - DNA, 3756 bp, Homo sapiens
gtagggctcgcggcgctggaagtccgccagcacctcgcggctgggctgggactggcggaaggctggcaggccctgcttgcagcgcttgaggcagtgcgcgcggcgcagcaggcccccgaagaggcgcagctcgggatagctggcgaggccggcggcgggctcgggctgcggcgcggcgctgcagttgcggtggcagaaggcctcgctgtcgcgcagcaagcggtgcagccgcaggctgatctccaggtagcccacgctctcggcccagtgctcgccgctgtacttgtccagcgcgtgccggtaggccgactcgagcggcatcagctcgtcccgtgggaagctgcggaagctgtagcgttcgtattgggcgcgcccggcgcgcagcgcgcaggccacgcacagcagcgctagcagcgccgcggccccccggcgccccggctccatcgcgcccggcgaaaggaaggaaggaagggacgaaggaagggaaaaggggagggagaaggaaaggaaagaggacggtgcgacgcggcgggcccagtgctttcggggcggggacgccagcctccggcccgccccgtccggccgcccctccccacccagccgggggatctgggcgccagctgccagcacctagagggtgcccgggaaaggcgcgctgcgcactggttcacgcaggctgatgcgcatgatgggactctgccgctcattcacttggagacccgcctgcaaggccgacgcggccctaatagattatatacatcggccctacggtctatataatctacgatctttatattcgtttggaggtttgtgaaaacgaagattcctgggctgtgcccccagagtttctgattcagaaagtctggggtggaggtctgacgatttgtgtgtttaaccagcaccctgatgaggctaatgctgcgggcccaagggccgcacttttaatagcactgcccaaccttaaattttagtgagagaaaaagacagtgcaaaaataaaattaataaggatgtcagcactttgtaaactgtatagctagtcaggttgaagatgtgcacaccttatgaatctgcaacaccattcggtggaatatgctggagaagcttgcgcgtgtgcatcaaaaaatatggatggaatgttaatggcagcacttttaaaaaatctttaaacttttaaatcttgaaataatttacaagaaagctgcaaaaacagtacaaaaagttcctatatacccttcatcaagattcacaagttgctaacgttataccacatttctatctttacatttttttctgactcatttgagataggttgcatgtatcaggcccactgtccgttagtcttttttttttctttttttttttcctttttttttttttgagacggagtctcgccctgtcacccaggctggagtgcagtggcgcgatctcggctcactgcaacctccgcctcccgggttcaagcaattctccctgccttagcctcccgagtagctgggatcataggcacacaccaccatacctggctaatttttctattttttactagagatgaggttttgccatgttggccaggctgttcttgaactcctgaccttaggtgatctacctgcctctgcctcccaaagtgctgggattacaggcgtgagccaccgtgcccaaccccttagtctttcagtatgtatgtcctaagaatgaaactaccagacaatcaaatttaggaaatttaatactgatagaagactttaatcatgttccatttccggttatgtcagctgttccaattatgtctttcatggcacttttttctcttaggatgcagtccatccgtgatcactgttacatctagtctatttcatatcctttaaactggttcctcggcttttcttgtcatgccgttgtcatttttgaaaaatataggccaaaacagcaatgagataccactacaaaatccaaaacactgacaacgtcacatgctgacaaggatgtggagcaacaggaactctcattcattgatagtggcaatgcaaaatggtacatacagtttagaagacagttgggccgtttcttacaaaactaggcatactctactcatacaatccagaaattgcacttcttggtatttacccaaatgggttaaaacttatgcacacacctgcgaatggatgtttgtagcaactttattcacaattaccataacttggaatcaaccaagatgtccttcagtgggtaagtggatacataaactgtggtatatacacacaatggaattttattccaagccaaaaagaaatgagctatcaagccatgaaaagacatggagaagtcttaaatgcatattactggttgaaagaagccaaactgaaaaggctacatactgtgtgattccagccaaatgacattctggaaaaggcaaaactatggagacagtaaaaggatcagtggttgctgagaattatggaaagggaggaatgaatgggtagaggacaggattattggagcagtgaaactattctatatgatagtataatggtggatatatgctatacatttgttaaaatccataatatgtacaacactaagagtgagccctaatgtaaaccggactttgggtgataacgatgtgttgatgtaggttcattgattgtaacaaatgtaccattctagtgcaagacattgacagtgggggagcttgcgcatgttgtagggtcatggagtatatttgaactctgtagtttccgctcagtttcgctatgaatctaaaaccactctaaaaaataaagtcttttttttgttttttgttttgttttgagatggagtctcgctctgctgcagaggctggagtgcaatggcatgatctcagctcactgcaatctccacctccagggttcaagcgattctcctgcctcagcctcctgagtagctaagattacaggcccgtgccaccatgccaggctaatgtttgtatttttagtagagactggtttcaccgtattggtcagtctggtctcaaactcctgacctcatgatccacctgcctcggcctcctaaagtgctgggattacaggcatgagccaccgcgcctggcctttttttttttttttttttaaagaacacaggccagttaactttataaaaagttcctcatttgaggttttcctgatgtttcctcatgactaaattcagattaagctcatgactaaattcagattaagctcatgactaaattcagattaagctctttggctagaatgccacagaagcaatgtgccatccgtctcaggtgtaaaatctaaataacacaatgcccaccccttgtctgtgttaattttgatcactttattaaggtgatgtctgttttccctacttcatttgttttcttttgtaattaacaagtgtctacagtaaggtaacgcaacattgttcttaatggcagaaagcaggaataacctgtccataaacagaagagtagatttaaaaaaaaatgagagtaaatgcatatagaagaatatattatagcagggaaaatgaaagaattagagctacaaataacagttcaatctgggggcgggggggaaccattgagaatgattccatttgcctaaagtttttttgtttgtttgttttttgttttttgtttttttttttttgagacagagtctcgctctgtcgcccaggctggagtgcagtggcgccatcttggctcactgcaacctctaccgcccgggttcaagcgattctcctgcctcagcttccc

SEQ ID NO: 4571 - DNA, 1209 bp, Homo sapiens
caagatgaacatctacattttctagagtgggacaagaatctctgttcatatttatgtcccatgcatttgcacgtggccggacaaaggactttgcttctgccagcacatctgtcttcagatatgagaggaaacagacacaacctggaggcggcaaagaagcagctctttctcaagtgacctcctctatctccctacttcctggctaatggggcagccttgatccttgggaatccaggacagatatccactcgtgacaaactagctggaagaatgacaaccaatcaggttccaagcaccactggatgtgaaccacagaatttcctcctctccttgtggaatgtcagcttacgtctgacaaaaaatgtaaaactgagagagttacaatcttaaggaggagtcaagctaaagcagaaagaatcacctactctggactccagcatgactgctgagctcaaatatatatatagagagaaagaaccacaaacttgaagatggatatcagctacagactttcctgagtcaggtctcacctaagaaaataaacacatgctatgtcagagaagcctcagggcttccacacctgctcgaaaagggagttgagcttcagcagctgacccaggactctgttcccctttggtgagaagggtttttgttcagcaagacaatggagagctctcactgtggtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggag

SEQ ID NO: 4572 - DNA, 2405 bp, Homo sapiens
agcgaccgctgccttcgctgccgcccagggcgcttccccgctcaggagcttcctctgggcctctggacggaggcgcgcaggggcccgggaggcgggaacgatgggcctttctaggcggtatcagggccgatgctcgtggatgcagagcagtgaccagcccagaaccgtaccggcttcccggggcaggggcggcccgagagcgccgctaacgggagcaacgggccctgcccccggtggtgtaggggccacctcgccccgcccagcccagcccgatattgatgggggcccacgccttcattgtttttttgttgttgttgttttttgttgttttttgtttgtttgtttttgagacggagtctcgctctgttgcccaggctgcagtgcagtggcgcaatctcggctcactgcaccctccgcctcccgggttcaagcgattcccctgccccagcctcccgagtagctgggactacaggcggccgccaccacacctggctaatttttgtatttttagtagacacgaggtttcaccgtattggccaggctggtctcgaactcctgaccttgtgatccgcccgcctcggcctcacaaagtgctgggattacaggcgtgagccaccacgcacggcccatttgcgttctaatttcaggcgttcctcaatcctctgtggaaccaggaagggcgcaaattataaagggactggcccagcgccgcctctgggcaggctttgggcagcgcctggcccgctgccggcttggacctcccagacctaggggcccggttcctggtggaggctgcagggacctctgccccacccgcccgggggaggcccgaggggctggactcagactgagattgaatgcggctttgtcttcctagttcagccccggcccacacctggggctgagtggaatcgggagcttcgaggggtctggacagagagattgatgccaagaagggggtggccgagccagaggttgaagtgggctggatcctgaggccccctgttaaaggagagggctccccactcagtgctcctggaactttccgaactagagactgggacttataggagccttctagaggaaactgtcgtgttttcacagtgtctgcgagattaatctctcatggccgctgcacaagaacctggcttttagctgaactaaggagaaagtcctacaacagtttggcgtgcaacatggggcttgagaaagggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctgaggttgtatttgtattttaaaatgagcatttgccacacaaagccaggagcttcagaccagcgtggttaacacagcgagaccctcctctctgtgagaaatt

SEQ ID NO: 4573 - DNA, 6213 bp, Homo sapiens
tggtaggtcctcggcgtccgggaggagcggaccggccctcccggggaccgggcaagagggtgggccggaagcggcatcaggccccgtgcccattggccagcctcgccaggacgctgcgacctgggacgtgcgattggctgcggtgcgccgcgtcggtgctggcttcgaggtcgcgcgcccgcccacttccggggtcgcgccaggtcaggagtccagagtcggctgaagcgagttgccgcgttctctctggcggcgcgacaccggcccgtggaccgcccggccgccctccaggacccggtctgcaggagcggagagggcggtgtggacaccgcctgcaggcgaggagaaggggtggcggagagggtacctgggtgcgtggctgtgcggcgtcaggaggagcagggtgtgggcgcccggcctggggcgtggagaggacgcagggaacaggtgtcttcctggtatccatcgaactgaaacgtagcccttgagcacacactacacttaaagctttactctttcgaggaggagtcctggaagcatatgtgattttgtgactatagcatggtgtggtgtcagtaacaggccctggattgctcaaactctattgtcagtgacaaaacccagtgtaagctggcctaatatattaatagtaatatgcgagtcctcccggggtggcgggcactgacgtaagtgctttacttgggtcttctcatttcatcctcccagcaacccaaagagctggcggcgtcattcccattttacaaatgcgaacacgggctcagagatggagcgactcacgttgtaagcgatggaactgggatttgaaaacactgtatcccgcctggcagaaaactggcaaggttaggatggagaaaggagaaaaaagaaagatgtcggccaggtgcggcggttcatacctgtaatcccagcactttgggaggccaaggcgggcggatcacttgaggtcaggggtttgagaccagcctggccaagatggtgaaaccccgtctctagtaaaaatgcaaaattagccaggggtggtggcgcatgcctgtaatctcagctactcgggagactgaggcaggaaaatcgcttgaactggggaggtggaggttgcagtgagctgagatcgtgccactgtgccaccgcactacagcctgggcgacaagagcaaaactccttctcaaaaaagaaaaaaaagggcatctgatggaaggctagatactacccgacattgagctaaaccaatgtcacctggttggacctagggacctattcctgctccccctctagttctgtctcatttctggggttgcacacaggcttttcctgggccttcatgtttggggaagccccacacaggccagctccagtggaagaaaacgcccccagaagcctcttgttcaccccggatggctctgtggagtcctgtgtctgaccctgactttagcttgggcctgagggactggcatttgtggacttggtctggagatgtgggcagagcccccctcaagcataagggctcagccaggcacagggggtggctcctcagaggaagatcagggtgctattagcagaaggacgatgagtgggccgggcgcagtggttcacgcctgtaatcccagccctttgggaggccgaggcgggtggatcatgaggtcaggagatgagaccatcctggctaacatggtgaaacaccgtctctactaaaaacacaaaaaattagccgggcgtggtggcgggcgcctgtagtcccagctactcgggaggctgaggcaggataatgaggtgaacccaggaggcggagcttgcagtgagctgagattgtgccactacactccagcctgggcaacagagcaaaactctgtctcaaaaaaaaaaaaaaaaaaaaaaaaggaggatgagtggtcgctagactgctggagaaacagtctagaggtagggagccctgggttctgtcctgcctgtgacactctgtagccatttatctcctctttagctttagtttccacattaaaagaggcattgaaaaaaaatgaaaaagaggcattgaattaggagctttctgtggccccttgcagttttcatgtgtggtgacaaagttcaatatagttttcctgaattcaggggcttggggacccatgtccccctatcccgagttctttttttttttttttttttttgagagggagtctcactctgtcacccaggctgcagtgcagtggtgagatctcagctcactgcaacctccacctcccaggttcaagcgattctcctttctcagcctcctgagtagctgggactacaggtgtgtgccaccacgccaggctaatttttttatttttagtagagacaggatctcaccatgttggccaggctggtcttgaactcctgacctcaggtaatccacccatctcagcctcccaaagtgctgggattataggcgtgagccagcatgcccggccaaaagtttgctttcttttgagtctgtgatcagcctttcactgaatacacaatttacatgtgagagtgggtagaggaatagtcacatatgccttactcactgtctggctcagtgaatctgcattttgtataaacaataggacagaggaagaaatcacatatgcatttgtcttcagtgagcggagggctgactttctgcattgtacctgtgaagataagctatcaatttacattgccagggaaaattcatcagaactgttttagggcaaagatcttgaggcccgaaaggaatttgcttgtggagaaattgtgaggggggtatgtagctcttttgaactttctagctatcttattgaagaataaaacgggaggcaggtttgtctgatgcgaccctcagcttgacttttctctttggcgtagtgatcttggggtcccgagatttattttcctttcacagtaggatacattgatcaggtcagtgccacagtacaagggtcagaagtgtttgaacccgagcgactccatcttgaacaggggctgggtaaaatgaggctgagaactgctgggctccatccccaggaggttgggcattcttggtcacaggatgaaataggaggtcagcaggtttggtatcacaagatacaggtcacaaagcccctgctgatagaagaggatgcggtaaagaagccagccaaaaccacgatggtgatgaaagtgacttctggttgtcctcaccgctcattatactctaattataatacattagcatgctaaaagacactcctaccggtgctgtgacagtttatagatgccatggcaacgtcaggaagttaccctatatggtctgaaaaggaggggaaaccttagttccaggaattgccctctgctttcctggaaaactcatgaataatccaccccttgtttaccatagaaccaagaaataactataagtatactcagtccagcagctcatgctgctgctctggctgtggagtagtcattcttttattcctttactttcttttattttttatttattattattattattatcttatttgagatggagtctctgtcgcccaggctggagtgcagtggcgcggtcttggctcactgcaacctccgcctcctgggttcaagtgattctcctgcctcagcctcctgagtagctgggattacaggcgcatgccagcatgcccggctgatttttatatttttaatagagatggggtttcaccatgttggccaggctggcctcgaactcctgacctcaggtgatccgctcacctcggcctcccaaagtgctgggattacaggcgtgagccaccacgcctggcctggagtagtcttttattcctttactttattatcattattatttttgagatagaatcttgctctgttgcccagactggagtgcagtggcactatctcagctcactgcaacctctacctcccggattcaagcaattctcctgcctcaacctcctgagtagctgggattacaggtgcacgccaccacacccagctaatttttgtatttttagtagagacgtggtttcaccatgttggccaggatgttcttgaactcttgacctcaagtgatccgcccaccttggcttcccaaagtgctgggattacaggtgtaaaccactgcacccagcctgttcatttactttcttaataagcttgctttcactttatggacttgccccaaactctttattatgtgaggtccaagaaccctctcttggggtctggatcgaggcccctttgcagtataacaaggatcaggagtagacaaagaaaagtccaggtccctggctcaacagaatctactctccagcaaacaagataaaacttgctatctccctttaattgaagtccctaatgtttaatggaagtcccagtaggcatccatatggtctctgtatttaccagcggctggaagctcgctttgtacgttactctgcacaacaccacatgactgctcctgacagtaatttgaggagcttctggtgatggtaaacttgcacagtatgttcaaaaccaacctacaatctgtgttacgcctgtatgtttcacaaggaacatgtctgtatatttcgactccagaaatataatttgtcaaaccaattatcgtacctaaaatgtcttgtgctgtgttttataataatttacgcaaatgagtttcatttcatgtaattaacctattccagtgtgatgtttctcaccccaactttgccagctctctttccagcacagaaacagattccgctaaccatcgccaaaggcaggacctgtgaacagctgaagcatctcctggtctctgctctgctgagccttccatagcaaatcccaggcagacagggtcctgaggattgatggcacctgagcagcagttgtgaccttccgcaacattctcttatgcctctataaaagccagtaatctcccggcatgatggctcatgcctataacgtcagagttttggaaagcggaggtgggaggatcacttcaggtcaggagtttgagaccagcctgggcatcaaagtgagcctctatccctacaaaacatttttttaattagccagatgtggtagtgcgtgtctgtagtcccagttactagggaggctgaggcaagaggatcgcttaagcctaggaggtcgaagctgcagcgacctgtgattgcaccactgcactgcagcctaggtgatggagcaagaccctgtctcaaaagaaaaaagaagggccgggcatggtggctcactcctgtaatcccagcagtttgggaggccgaggcaggcagatcacgaggtcaggagattgagaccatcctggccaacacggtgaaaccctgtctctactaaaaataaaaaaaatcagctgggcgtggtggcacgcgcctgtagtcccagctactcggtagggcgagacaggagaatcgcttgaacccgggaagcggaggttgcagtgagccgatatcgcgccactgcactccagcctgggtgacaaggcaagactctgtctcaaaaaaaaaaaaaaaaagaaagaaaaaagaagaaagaagaaaaagaaacaaatggtcaataaacttatgaagaagtgctcaactacagcgataagcaggaaaatgcaaattaaacccacaatgagttgcctgccagacaggctaagggagtagaagtacgagctggtgccatcactggggaaatcagtgacatgacctcatagagctgaagctaagattgtgctgtggcccagcagtgatttaggtgctgtacgtacacaccttaccagcattctctatgtaacaacagccccaggtgtccatctgtagtggaatgcatgatcagtgtgatggagtcacattaggttgctgcaaaaggacttgtggttttggccattaaaagtaatgacagggtgggtgcgatggctcacaccagttatcccaacgctttgggaggccgaggtgggcagatcacttgaggtcaggagtttgagaccagcctggccaaaatggcaaaactctctgctcaaaatacaaaaattagctgggcatggtggcacacacctgtaatcccatctactcaggaggctgaggcaggaaaattgcttgaacccaggaggtggaggttgcagtgagatgagatcatgcaactacactccagcctgggcaacagagtgagactccgtctcaaaaaaaaagaaaaaagaaaaaaagaaaaaaggccaggcatagtagctcacgc

SEQ ID NO: 4574 - DNA, 1400 bp, Homo sapiens
ctataggctactgcagcactggggtgtcagttgttggtcccacccagaacgcttcagttctgctctgcaaggatatataataactgattggtgtgcccatttaataaaagaatatgtaaactgaacagccggaagaaaccttcccgaacactgaaaccaatggtgaatttggtaaacaccctgcagaagatatggaagagtaacaagcatttaaaagatctagaaacactgatgagatggttgaattacgcattctgcttcagaccaagaatgctggggcagtgattggaaaaggaggcaagaatatcaaggctctccgtacagactacaatgccagtgtttcagtcccagacagcagtggccccgagcacatattgagtatcagtgctggtattgacacaattggagaaattctgaagaaaatcatccctaccttggaagagggcctgcagtttccatcacccactgcaaccagccagctgccgctcgaatctgttgctgtggaatgcttaagttaccaacactataaaggaagtgactttgactgcgagttgaggctgttgattcatcagagtctagcaggaggaattattggggtcgaaggtgctaaaatcaaagaacttcgagagaacactcaaaccaccatcaagcttttccaggaatgctgtccttattccactgacaagagttgttcttattggaggaaaacccgatagggttgtagagtgcataaagatcatccttgatcttatatatgagtctcccatcaaaggacgtgcacagccttatgatcccaatttttatgatgaaacctatgattatggtggttttacaattatgtttgatgaccgctgtggacgcccagtgggatttcccatgcggggaagaggtggttttgacagaatgcctcctggtcagggtgggcgtcccatgcctccatctagaagagattatgatgatatgagccctcgtcaaggaccacctccacctcctccaggacaaggtggtgagggtggtagcagagctcggaatcttcctcttcctcctccaccaccacctagagggggagacctcatggcctatgacagaagagggagacctggagactgttaccatggcatggttggtttcagtgctgatgaaacttgggactctgcaatagatacatggagcccatcagaatggcagatggcttatgaaccacagggtggctccagatatgattattcctatgcagggggtcgtggctcatatggtaatcttggtggacttattattactacacaagtaacgattcccaaagatttggctggatctattattggcaaaggtggtctgcagattaaacaaatccgtcatgagtcgggagcttcgatcaaaattgatgagcctttagaagg

SEQ ID NO: 4575 - DNA, 524 bp, Homo sapiens
ctagttggaaaaggggacttgaagctaagtttacatggcactttaagactgagaacatatcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggaattctcaatgtgtggtccctaggccaacagcatcagcacatcttgccctcaccagacctactgaatccgaaactcccagcgcaaggcccagcagtcttcaacaagccctccaggggtctttggtgcatgctcaagtttgagaaccataggctttgccacggttaaaaagatgttttaatggactggtctcctcctaagctctgaggtgctctcatattccctccataagtaaagagattttttttgtataa

SEQ ID NO: 4576 - DNA, 1611 bp, Homo sapiens
gttgagggctgagatatagttctccaggatggcccgggcgcagccgccacacttgggtgcgaacatgtcgaagtagtccttgcgacagtaggccttgccgtccttctcgtggaaccctggggagcgggggttttggaggcacagttcattccggcttccagaagtggagccactctgactccaacctcagcagcgtctcccacccccacctccccggccctcctaagaggcggtgggtcagtccgccggtccagcccgtaccttcgggaccaaagaaggctccacactgtgcacagaagaagtgttcagggtgccacgtccggtcaagggctgtcaccactttctgtgaaagcaaaatgtgggatcaaggctgagctctgggcagatctcacaactgagacgcccagcaaggccgtccttccacccgcagctcatagccatagacagagcaaaacactcccaagatgggggtctctcctaattgtgctgtgaatgcctctaagaattcagagttactcaggatgggacaagccagacacataccctctcctctactcctcaccccaagtagagggcacaagttctatgactcccattttataagtgaagaaacataggctcagagaggccaggcatttcctaagttcacagagagggagagtgaggccgctggcatccaactccatttatctcctcagggctcctgagtcctgggagtctccacagaaaggaatcgagatgggaggtgaagggaggtggggctgcccgatgcacatcgggacaggctgtggttcaggtgtggctgtgaatccggccccactgttccctagccctgtgagcctcgggcatgtgacctctctgagcctcccacggcaccccctgcatcctcagagggctgcggtgaagctggaatgagcggaagcgggcgcggtgccggatgaggaactcacatccaggatggggccgttgcagtagtagcagcgcggggagaagaggttgtggtagtccttttcacagtagggctgtccatcccgctcgaagaagttccgggatccgatctcctcctggcagtgggtgcagacgaagtgctcggggtgccacgtcttccccatggcggtcacaacctgaggaggagatggaatgcggtccagggccaaggccagccccggagcacccccacccctgcaggagtccactggccacacccctgcccactccccctcatcacctgcccggcgatgggcttcttgcaggccccgcagactcctttggcgactgtggcgacccccagcttgttcaggtcagactgcaggctccccagcatgctgtccagctggctcccgggcttcgggggccccccagggggtgagctgctccctgtcttcccctgggccatgaactgtggacacggagggggctggtcaggactcctgaggctcggggtacggtgtctggcagcacagggatgggggtacttttctccctcctggacagatgagctgatggagacaagaagtacaacctcctccaggggccaggagccctaaagtgggagtgacgtcagcaggactcctggtggtcggaggggcccaccagggtcggaaaggctga

SEQ ID NO: 4577 - DNA, 5805 bp, Homo sapiens
gtgggacccctcagcctcaccctctctagggcgcagcaagtccgccgcgagcccctctgctcatcgctcgttaccccccaggcccttgggcttgggctcaggcccagtcgttcctctgcaacaaatccaatggaaccgcgccctccctgaatcccacgtctaggaagaggaggaggagcccctcttgcttgggggaaggggctcccgactcggagccccgagccccattcctctcccgcgccagctcttcgggacgcggcctcccagcggacgccctgagaccttgcaagtccgctagggaggggtcgggacgagccgtcgcgggtggatccgcccggccgagcaacgacccgcccgggcgcgaggaccacgggctgtcgtgcgggaggcgtcgaggggcagtaaactccgttcgtgaccaaacggagacgatttgaaacttgctgctcacactggatcaccgtctggaaggtgcgacggggaaaaaatacacattacactccagcaggattgaacgctttcaccctgtgccccgcgcctggcgtaacgcgtggccccagaccacacgctgtaacccggggtgagagggagtgaggtgggacttcgtaccggacccggagcgccggcctcgcccgcgcgggcagcgttcactgtggggagtgctcactcagcctagggcggcccgggaggactgccgggaggagggagtcggccttgaattgaggcctcagccttgaatagggtagggaggcaagcctagccgagagtttagcactagcaaaagcctggaggcaccagggtctgccctaagaactgcagcgcctctgctctggctgggatttaacgcattacgtctctgctgtttataggtgttgtgtttggtcttacgacttcgtattctatagtttttatttattcctgttttctgaattttcccacatttgcttttatcttctatcgtgattttcaaggcagaaagtatttttaattcttctcgcggctgcctttagatttatcaaatgaaaatagtttacatttcacacattagtaaagtcagtgacaaataattcgtttttatattcccccatgagaaattttgtgtgcttttctgcctcctacctgccgccctcactacttatatttgtccacttaatcaggacgacagacctaacttttgtttacactttttttttaagccacaacattctttttcaatccttgtttttggcttttgccaactctgtttaattggtttcaatgttactgccggttttttgtgctctaatttttctattcctcatttggacccatctctcacatgactggtgatttcagggaggactctggaatgttgtatttcctaagcctttgccttaggtgagaatgcctttataatgatttcctgtttataggattcttgagtctcaagctttccccctcaaaactcttgtctttatttcattgtcttctggcactgaaaatgcaaagctgggtttgtctgtttaaggtcagcagtttgcttggtgcttgcaagggtttttctttaccctcaaaagtcaaacattttgccagtataaatcaatatgggccttatctattaattttccagaaacaaaagaggtcttctttgtagcttagaaaagttttcttcctgtccattctgtgaaaagatttgggtttttttctttcctctcctctaaaactatcacattggatcaccaatgtcaaataaatctgtttgttttctctgcaccctgggagactatatcaagtttttcttcaccattacggatttaattttcttcagagccaagagtactgtttattttctccaataagacatttgattctgcttgttttatttttctttcagccaatttccattccacctctgtcttgatctcaacttaatctctctttgtagtctccattcctatttcatagactaatgtggttttgcatctttaaaagaacaccaggaaaataagagaatactatctatatctgactctggtccaatgcatatgaaaacttttttgtttttttgagacagagtctcacttaaaatttacacaaactctagcatagtgtgtaactattgaatgaataactaatgcaatccccttcctttctttcagagcaactatgaactagactttttttttttttttttttttttttttttctgaaatggagtctccctctggaatgcaatggtgcaatctcagcccactgcaacgttcgcctcctgggttcaagcaattctcctgcctcagcctcctgagtagctgggattacaggcatgtgccaccaccacgccgggctaatttttgtatttttagtagagacggggtttcattatgttggtcaggctggtctcgaactcctgaccttgagatccgcccgcctcggcctcccaaagtgctgagattagactatttgtatctaggttcatcagttcagtgaactaatcaatactttgttttgttttgttttgttgttgcttaagatgatttgtcacctgctgattaatgatcacacaagttgtttttttttgagagagtcttgctctgtcacccaggctggagtgcagtggcatgatcttggctccctgcaacctccgcctcccgggtttaagtgcttcttttgcctcagtctcagtagctggcattacaggcgtgcaccattacacccagctaattttttgtatttttagtagagacagtgtttcgccatgttggccaggctggtctcgaattcctggcctcaagtgatccaccctcctccaccttccaaagtgctgggattacagaactgagccaccgtgcccggccctgaaaaccttgataaaggggctcattttctgggaaataaaattacaaggataacaaagatattaaaaacatcatccaagaaatatgtccaaaaaaggttctggtggccggcatcgttgctcacgcctataatctcaacactttaggaggccgaggcaggaggatggcttgagcccaggagttcaagaccagcctggacaacatagggagaccctgtctctacaaaaaaatttaaaaattgggctgggcatggtggcttacacctgtaatcccagcactttgggagaccaaggcaggtggatcacctgaagtcaggagtttgagaccagcctggccaacattagtgaaaccccatctttaccaaaaaatacaaaaattagccagttgtggtggtgaatgcctgtagtcccagctactcgggaagctgaggcaagagaatcacttgaacccaggaggtggaagttgcagtgagctgagattgcgctgttgcactccagcctgggcgacagagtgagaccctgtctcaaaaaaaaaaaaaaaaaaaaattaaaaaattagctaggcacagtggtgcacacctgtgatctcagctactcaggaggctgaggttggatgatggcttgggcctgggaggttcaggctgcaagtgggccgtgatcgtgctactgcactctagtctgggcagcagagcaagaccttgtctcaaaaataaataaatgaaattttaaaaaggctctggcctcagacagtttaatggaagaaatctctcaaactcactgaatagataattttcaccctactaatctgcatcagaacccagaaaagatagaatgctgtctatttcattttatgaagccacaattccccttataccaattcctaataatagcacaggaagaaaggaaaactgaaaaccatactcatcagtcatcagttccaggggtggaaaatcctacatacaattcaagaaaataaaactgtagattattctgtatgaaattaataagccatgagtttgtcaactgagaaaaaaaaacaattatcataatagatgccaaaaaaatcagtcaaaaatgaatacccaaaaagaaccctcctaattaaccaggaacagttgaaattaagaattatgtattaccggccaggcacggtggctcatgccttaatcccagcactttgggaggctgaggtgggtagatcacctgaagtcaggagtttgagaccagcctggccaatatggtgaagcctcatctctactaaaaatacaaaaattagctgggtggggtggcaagtgcctgtaatcccagcgactcaggaggctgaagcgggaggatcacctgaacttgggaggtcgtgactgcagtgaacagtcatcatgccactgcacaatgcagcctgggctacagagtgagttgccatctcaaaaaaaaaaaaaaaaaaaaaaaagccacgtgagatgtgagttcctgtttccctacagcctcaccagcataggatatcattagtcttttaaatatttgttttaatcacgtcttctttgccccatagctgacggaggggttcccactctcatgtgatggcagtggccaaacacaacacctgacactgggcagctctcaactttggctgcacactggaatctcctactcatgctccctgactatgccctcacagattctgatttgactggtcctgggtgcaacggggctggcatgagacgactaaaaactccccaggtgaatccaatgagcaaccaggctaaggaccagtgatctaactgtaagtcattctcttcttttccctttgtaattttatgtttccacctcatactgtggttggctacatctgtttcttccctctcctactagaatgtaggctccagatggccttccaaacaatacatgtggcccttcacgctccaggtgatgacaagtacccgttgctgatggaagtagcagagtcatacctttcttggaatttaggttctacagtcaatgcttatggcacccaatgagtcaaaaacacccttggcaactcctaaggaaggctctgccctggaacctgatgtactgtttccccatcaccatccagggagagtttcctcctgggccggaacagaaagctgcctcctccatcaggcaccagaggaagtagggggcttctgtttagggaccactttgcataaatacacatttaaacatgtgcctcaccctcagcacagcaggatgctcacgccatgaacagccaacaggaaccagagtgaccgaccctccaggaggtacacacctccctcccatcccacccacttctgagcatatggttctcacatccaccagtgggtggaatcacccacaccatttaaactttttgtcaaggatgtagagctgaattcatgtgatttcccacatgagcaatgtccctccctccactgcacaattatagccagctcaagcaggtcctctccttccttctacctgccctgcaaatggctctctccttcactgaccccccgccctccttcttaaaggctgatgctccctaggactctatccttgatgcttctcattaattcttctccccgctggctctcagccctacttagggctcctgatcagttaaaaaagacccatgagacctcccctccccagttaacagagatgtggcccaagaggctccccacttctaatttgagtgggggcaaaagaagagaaagatcttatctaggtcttgggggcagggcttgcagggcacaaagaaacagagtaaatgtgcaacaggctattttcttgaatgaatggattcataataagaacaggacttcaccagcttccaagggaccctccccacctctcggatatattctgaagcctaaatttcacctgcttatctaggatcctaggccaggccttctgccacaccaagccacaccaagctcagcagtactcacaggcctttaatctataactgcctg

SEQ ID NO: 4578 - DNA, 10237 bp, Homo sapiens
gtggctccaggtttgtttttctccggtacagcctggtagggagggctcccggcatctccctgcttcggggcagaggatgccgggggtagagtacgggagggctggagcgagggtggactggaggtgccgcttgtcctggaggtgggagagagggagcggctttgccgcctggcctgcgtcctaatcctgtcctggttcttctgctcccgaagggaacgtaggtcccgcgcctgtgataagtaaggttggattttctcttccctgaggtgaaggatgcccggaggcctcggcaggaccgtgcggaaacgggccttctgcccaaaagatgctgcttctctccttattctttcccctcagaatctcgctgtctccttccaaccacctgtggtcggcatccccgcgttgtcactgcgacgcagaggcgagcgaggtggcgggaagcacccgcggggcggggagggaccctgcgggcgcggactccacaccaagcctctgctcagcgtcaccccgcttgctgtgtcctcgcaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtggggtgagaagggaaaggaggggtgagggtgcaggggccctcctaggaggacatcggacctgttgggccgagacctcattagagatctagagcacggatgggaggagcagaggctcgatttgtgtcctgttcagactcccacaggctgggtgatggtgggagatttgtgcccattcagatgtggcggcagaggagggcaaggccgaaggagcagacagcaccgcttcttggggagttgtgaaggcatcatgcggagggccgagcttagcagccaagtggaggacagcaccctccatgcctggattcgttactcgctcgttctcgatgttgagctgctggcatattgcagcacaactagagatgtacggatgcccccatcttgatcttacagaatcagaggtgcagccgcaagaaaggtctgtaagttatctatttcggctttatttaaaagatgggatggggtggggtggacaggaaacaagcttaacatgttaagtgactgttgacattgacacattttgttgtggcagagtcaagaacagacactgagtcgcttgaggactcaggcaggtgtttgctgcattgacaacagagtaagaaaaaatccgtttgctttttaaaatccaaagatggttttgagaacctgaaaccaagttagagcaagttcgttttccttccaaaaaaactgggctctgccgggcgcagtggctcacgcctgtaatcacagcactttgggaggctgaggccggcagatcacgaggtcaggagttcgagaccagcctgaccaacatggtgaaaccccgtctttactaaaaatacaaaaaattagcccgacgtggtggtgcgcacctgtagtcccagctacttgggaggctgaggcaggagaatcacctgaacccaggaggcagaggttacagtgagccaagactgtgccattgcactccagcctgggtgacagggcaggactctgtctcaaaaaagcaaacaaaaaaaaactgggctgaaaaataccacatcacttttttcaaaaccttgttgggattctctggtttataataaagattaaaacctgaatatttttgtttagcatcagttttaatgaaagtattatgttccattctttggcttttcctaacttgcttaattagtttaatatattggtttgcatactctgttagagtacagcataagttgtttataagtcagtagaaaaccaaacgttttcacatttgaaaactaatgtgtccaagcagtacataaccatgccagagtcatgcatggacgtgtgagtatctcccttttagagatgttttgccagctgggaggtggacatttttaggcaagtgacatttctcatgttcttttcttgtttgtaagctacaccctctcggttttctctgctctgccaacactagtggaatatgatcacatcccagagtttcactctttttgcccaggctggagtacagtggtgcgatcttggctcactgcaacatctgcctcctggattttcaagtgattctcctgtcttagcctcctgagtagctgggattacagggatcagtgtcatttagggatgtgactatgggcttcactcaagaggagtggcatcatctggaccctgctcagaggaccctgtagaggaatgtgatgctggagaactacagccaccttgtctcagtagggtattgcattcctaaaccagaagtgatcctcaaattggagacaggcaaggagccatggatattagaggaaaaatttcgaagccagagtcatctgggtgagttagtgccagatggaatttaaagaattaattaataccagtagaaactattcaagaatgaagttcaatgagtttaacaaaggtggaaaatgtttctgtgatgaaagcatgaaataattcattttgaagaggaaccttctgaatataataacaatgggaacagcttctggctgaatgaagacctcatttggcatcagaagattaaaaattgggagcaaccttttgaatacaatgaatgtgggaaagctttccctgagaattcactcttccttgtacataagagagcttacacaggacagaaaacatgcaaatatactgaacatgggaaaacctgttatatgtcattttttattactcatcagcaaacacatccaagagagaaccactatgaatgtaatgaatgtggagaaagtatctttgaggaatccattctctttgaacatcagaatgtttacccattcagccagaatttaaatcccactctaattcagagaacccactcaattagcaatattattgaatataatgaatgtggaacctttttcagtgaaaaattagcccttcatttacaacagagaacacatccaggggaaaaaccttatgaatgtcatgaatgtggaaaaaccttcacccagaagtcagcccacacaagacatcagagaacacacacagggaaaaccctatgaatgtcacggatgtgggaagaccttctataagaattcagacctcattagaaatcaaagaattcacacaggggagagaccttacagatgtcatgaatggagaaatccttcagtgaaaagtcatcccttactcaaaatcagagaacacacgtggggagaaatcatgaatgtcatgaatgtgggaaaacctcgtttaagtcagttctaactgtgcatcagaaaacacacaggggagaagccctatgaatgctatgcatgtggcaacacctttctcagaaaatccgacctcattaaacatcagagaattcacacaggagaaaaaccttatgaatgtaatgaatgtgggaagtcattctccgagaagtcaacccttactaaacatctaagaacacacagatgggaaatcttatgcatgtattcaatgtggaaaatttttctgctgctactacagtttcacagaacatctgagaagacacacaggggagaaaccttttggatgtaatgaatgtgggaaaaccttccatcagaagttggccctaattgttcaccagagaactcatataagacagaaaccctatggatgtaatgaatgtggaaaatcattctgtgtgaagtcaaaactcattgcacatcatagaacatacacaggggagaaaccctatgaatgtaatgtttgtggaaaattattattaagtcaaaactaactgtacatcacagaacacacttgaggtgaaaccctataaatgtagtaagtgagggaaattactctgggtgaagtcagaactttgtagagcagagaacataaagggtgagagaaatctgttaatataatgataatgagaacacctttgccctgaagtcagttctcacagtagagaagagaacttaaagagggaaaaaacaatatgaagatatggaatgcaggaaaacattattctgggatttgggccatagattatgtttaagaactaaaagtgaaaaacacttattggtgaatgaatataggaaacattttgctcaatgccacacctcagtaaacatcagagagttcacacagggtgaaacctggctcaacatccgtaagttgagaagggatgcatttttttgctactactacagtttcacagaatatctgagaagacacacgggagaaactttttgggtgtaatgaatgtgggaaaacctttcaccagaagtgggccctaattgttcaccacagaactcatataagacagaaaccctatggatgtaatgaatgtggaaaatcattctgtgtgaagtcaagaggccacagaaaatgcacaaactataggaaagcatttactatgaggttatattttatagagtatatgtaataagaagtaccttcttagtgaacatcagatagtgagaaagtatttttaactgtatccaatgtgtggacactttaggttaaaatctaaatttaatatagaccagaggtgttgaattgcaggatatctagcaatttaagaacatgtagagaaaaggttttcttttttttttttttttttttttttgagacagagtctcgctctgccacccaggctggaatgcagtggcatgatctcggctcactgcaagctctgcctcctgggttcataccattctccttcctcagcctcccaagtagctgggactacaggcgcctgccaccacacctgactaattttttgtatttttagtggagacagggtttcaccatggtctcgatctcctgacgtcgtgatctgcccgcctcggcctcctaaagtgctgggattacaggtgtgagccaccacgcaaaaaaaggtttttattgagaaatagcattttactttgcttatatccagttcagttcattgtcaagactgctgttttctgacacttgaaaagatgccacgctggagccaatgactataactaggtcaaagatgtattgcttagccatatgtaaaataagggaagagtttttagcaaagggaaccataagcaagagtgcttttgtatgtccaggaagaaagagacccttaatctggggccataggacaggagcccaccagcaggatttttgaataatcctggggcagactaattttgggtgacccgtctcagaatggtggatcaagggggcaagtcaacttgccttgtatgcagcttaagaggattagtagaagagagtgggtccagatttctggtggtttctgccctagcagatgtccaacacataagccaggacattctgctgtgagtgacttattgtacccaactctatttctctccaaagtgaaatacatttttcataggtgatataactttttaaaatgtatatagagatataacttaaatatggggctttgaaaaagcacaaataggctgagcatggtggcttgcacctgtaatcccagtactttgggaggttgaggtgggcaagacctgaggtcaggagttccagaccagcctggccaacatgatgaaaccctgtctctactaaaaatacaaaaattagccaggcatgattgcgcacatctgtagtcccggctactagagaggctgaggtgggaggatcacttgaacctgggagttggaggtttcattgagctgagatcatgccactgcactccagcctgagtgacagacactttaaaaaaaaaatagattttgctattgggtaaggtatagtagtcggcagcagaatggactgattgaggacaactataaaattacaaaaaatatttaaatgcaacttattgctatagaagcaaagagaactaaaggagcaaaattctagagagtggtaaatcccagaaagcacatgcacagaatgcagctctttgctctggggaccctttccacttctggctatagggaagaacctgaatactgaacttggttcaggcagagggccataccctgggggtcaggggaaggcatgggggggaccagaaaccaggagaacaatcaagactgcaattaaaaaaaaatggatacattaggggcttcaaacacataatttctcaagaaatttccagatatctcatgctgcatagggcaggaggctgaaaagctaatttgagaagaaaacaagtaggatttttgttttgttttgcattttgcaatatggaggagaaatgattagaccttaggaagtgccagtgggttggtcctttcatgaacatgccatcagtaaaagccctggaaacaaggtcataccagagattcattgtaccttgtcacaactgcaaacaatatctgagtggaatattcaaaaacttgcttagaaagaaaactctaggacagatggctccactgaagttattccaaatatttaataaataaagcataccaggcttttataaactcttctagaagaaaaaagttggaacttttccaattcagtttttcaggccagtgcaaccttgataccaaaaccaataaaacaaacaaacaaacaaaaaacataaagctatagaccaaagtctcatagatttagatgcaaaatcctaaaattgaaaaaaaaagtctagtcatatccataaactgtatcatcaccaagagatgtttattagggcaatcaaaagatgatttattattttttaaaaaatcaatgtggccttcccttcctctttcttttgattcccctctttgagtttttatgtgtctcttttgccttcccttcccagagtggaggagttagacctgcattgtgggatgagaggagttgtggctatgtgtctgctggcaccaagagggctgagggtgaggtgtggaagggacagggggaggagatgggcagcattgttaagagattggtaccactgagcaaatatgttgagaatgatgatggcaaggtttctccctgttagagaaggtatttgtagaaataggaatgaggagagctagaaaacctggagtgtgggattagaatagaactcatatcttttaaatacataggaacaatagagaaattgttgggtgtgcccatatacatatattttgtgattcattctaccgagaggacataaatgcagtcacagctcagtaacagtaaacacaccaactgccaagttattatttcctaaatactatccacaaaaaaggggaccagggatgattcctagtcggagattgggagaaaaagaagatgagcctgaatcatttcatgtacctaacagaaagaaaatactctggctgggctcagtggctcatgtttgtaattctagcatgttaggaggtcgaggtgggtgtgttgcttgagcccaggagtttgagaccagcccaggcaacatggcaaaactgtctctacaaaaaatataaaaattagccaggcgtggtggcatgcacctgtcatccgagatactcaggaggcagagaggtgggaggatcacttgagcctgggagattgagactgcatcgagctgtgatcatgccactgcactccagcctggaagacagagtgagaccctgtctcaggaaaaaagaaaaaaaaaagatgttgctcagcaagttaatggacaaactgtgcaatatccagaaaactttaacattcttcaaagaaatagaaaacacaatcctaaaatttatatggaaaccacaaaagacctagaatagtcagagttatcctgagcaaaaggaatcaaactggagggatcatattacctgacttcaaattattctacagagctacagtaaccaaaacagcatgatactggcataaaaacagacacataggaacagaatagacaacccagaaacaaattcatacatctacagtgaactcacttttgacaaagttatgaagaacatacattggggtaaagatagtgtctttaataactggtgctgggaaagctggatatccgtatgcagaagaatgaaactagacccctatctcttaacatatacaaaaatcaaaattaattaaaaagttaaatctaagacctcaaactatgaaacagctaaaataaaacattggggaatctctccaggacattggagtgggcaaagattttttgtgtaatacctgacaaacaggcaaccaaagcaaaaatggacaagtgggatcacatcaagttaaaaatctgtattgcaaaggaaacaacaaagtgaagagacaacccatagaatgggaaagaatatttgcaaactatccatctgtattaggccattcttgaagtactataaagaaatacgtgagactgggtaatttataaagaagaggtttaattggctcacagttttgcaggctgtacaggaagcatggtgctaacatctgatcagcttgtagggaggcgtcaggaagcttccaaccattgtggaaggcaaaaggggaataagtatctcacatggcaggagcaagggcaaagagagggggagggaggtgccacacacttaaccagatcttgtgagtactcaggtcttgtgagggttgcttgaggtcagggataccccatttaccctgatgtgttcatatacatttcatgactgtatcaaaatatctcatgtacccccataaacatatacacctatttgtacccacaaaaatttaaaaataatttcaatgtttgaagactcattattaaaataatagcagtttctataaatttaatatttcaataaaactcccaatatttattcttaacactggaaaaacttttccaaaatgcatatggcagaaatatgggcgttgatgaaaggacagcatcaattaatgagggatcctcccccttgacgaaaataccttccaccaagacccacctttaatgctgaggattacatctcaaaatgagatttgggcagggacaaatatccaaactatatcactagctatatcaggagctgtaactataactatatcaggaactataacaattctatagaaaaaaaattaatctgaaaactggacaaaaatctgaataggcatttctcgaaagaagacatacaaatggcaaacaggcatatgaaaatgtactcaacatcattgatccattagagaaatgcaaatcaaaactacaatgagatatcatctcaccccagttaaaatatcttctgtccaaaagacaggtaacaacaaatgctgaagaggatgtggagaaaagggaaccctcgtgcactgtggaagtgtatattagtacaaccactatggagaacagtttgtaggtacctcaaaaactaaaaatagagttaccatacaatccagcaattccactggtaggtatataccccaaagaaaggaaatcagtatattgaagataaatctgcaccatgtttactgtagcactactcgcaatagccaagatttggaagcaatccaagtgtccatcagcagatgaatggataaataaaatatggtacgtatacacaacggagtactattcagccataaaaaagaatgagatcctgtcatttgcaacattatagatggaactacagatcattaagtgaaataagccaggcacagcaagacagacatcacatgttctgacttatttattggagctaaagatgaaaacaactgaacttctagagatagagtagaagaatgtttaccagaggctgggaaaggtagtgggggcatgatgagggggaattggggaatgttaatgggcacaaaaaggtagaatgactaagacctagtatttgatagcacaacaaggttactacagtcaataataattgtacatttttaaggtataattgaattgtttgtaacacaaaggataaatgcttgaggttatggatatcccatttaccctgatgtgattattagacattgcaaacctgtatcaatatatcatgtaccccatagatgtatacacctagtatgtacccaaaaaaattaaaaataaagtaaaaatttcaatgattaggaagaccattattaatatgttttctttaaatgtttctgtaaatttgatacaatttcaataaagcttccaatatttattcttagtactgg

SEQ ID NO: 4579 - DNA, 3504 bp, Homo sapiens
ttcaagaacagcttaggcaacatggtgagaccttgtctctataaaaaatataaaaattagccaagtgtgatggtgtgcgcctatagctgagtagtcccagctacccacgaggctgaggtgggtggatcacctgagcccaggaggtcgaggctacagtgagctgagattacaccactgcactccagcctgggtgacagagcaagactctgtctcaaaaaagaaaaagaaaaagaaaagaaatttttaaaaatgtgaaggcaaagctttttttctgattcctttaaatggtattttggctacgaaaatgtaaccatccctgaaaaatgctcatggcctcagccattctcaaaacattccctccatcttggtattgagataaatgagtaacaaggaaggcagcatttcttaatcggaatcacagtggacccagcagcatctaaggggtagctggggcttgggctctagttggctgggtgaccctggacaagctggtaacctttctcaaccaataataaccaggtgattggccgggcgcggtggctcacgcctgtaatcccagcactttgggaggccgaagtgggtggatcatgaggtcaggagatggagaccatcctggctaacacagtgaaaccccgtctctactaaaaatacaagaaaaaaattagccgggcgtggtggcgggcgcctgtagtcccagctactcaggaggctgaggcaggagaatggcgtgaactcgggaggcggagcttgcagtgagcggagatcgcgccactgcactccagcctgggcaactgaggaagactctgtctaaaaaataataataataataataataataataataataataataataataataaccaggtgattattccacagtaaaatgtaaaagatttttggttgttgtgaggttgaaatgaagcaacataggttaaaatatttaggccgggtaccgtggctaggatataaaattgaaccacgtggtctgattctagagctctccgaaagattgttctaaaactctgcccttctttttgaaggggcttttaacattctttagacttcactctaccattccctacttgcaataccatgttcaggattattctaaatgattccgagactttccacaactatgtctatttcaagtctgttctcggaagatggaactccacagaaggcggttcacatgatttttagtccgaatctataaataattggtggatccattttagcccccaaaactcccatctggttctctgttcacacaagacactaggcccaaagcttggaaggatagtaatcctgcgaggcatgaagatcgtaggataattgtgattatagtagatgctccttgcttctggttttttgtggactgtaacttgggctttcccaaggtgatgtgcaccggatccgcaggctggatggatagggtggggcaatcgcctctaagtggacatttattttatcttccctgttcaattaccctgtgtgtttccaggcattaaaacgcttgtggttcaggaccaagaaggtctgacctccttcctgctcttattgcagactttttataattcctgcctgtgagagaaacagaagaacacagcttgtttgggggatcccagatggagtttgcaggatggatattagaaaaaaatcatctcttttgagtggtagactgagaaatttaaattggaacagcgatgaaaaaccatacacgtcgggagatggagtgggggtgaggcaacccatgaagtcagttttgcatctgtaaaaagtcattttggagagtcgatctgcactttaagaattcctaatgggtacagtcagttcagacccagctgaatgtgttggagtctctgatagtgttcttctaattaaaggggggtggggagggaaacaataacagacacacaaaaacacacactcaaccaaagatgggggaaatgtgagcaccagacatgctcgtgctgatttggggatgacagttgaagagacaagaacattttaagtgcagggaaggaagcaagaacagccccccaaaacaggagagaagggtcagcaaaggtaagtttataagcaaaacaaaggggcggggggcggggggagtacaggagagaataaaagaagcaaaaccaagtaagcaaaacccaccgtgacttattaggaatgtttaatttgaaattgtgatccctacaattactgaaaagggagcagttagaaaggaaggcatgttgattgtgacagggcaggaagaacctgagaaatctctgacattcgagtgcctttttttaaactgcctttgttcccaagttcctattttgcatctggttaaatgcatattaatttctcttccttcctaatgaatcactgtgtgttctgtgtcttctttatgaagaggaaaggggtgtcttccctgcttgctccctcagctcaaacttttcatcttgatcctataggagtgatgagacattaaatggggtaatctggaaaaggggatggaatgtgaactgaagacttttgagtgtaggagttagaagtcaatcactttgctagctatcagactgtttcatcgttgaagaggaggctagagcatttactttagttaaaaaaaaaaaaaaaccctccctgacaccccaggtcttcccagatccctatctcataaactcattttatttacccagaaccccccaaacaaacctggacttgaaatcatctttttctttgcgcgttcctgagagtgactggcagtgcagccacagaactggcaagttctgttggaggaattatattcaggcccattcacgatgcacgttaactttgtgggtggaaagaaacctggaggagagagaggaaacaagccttaaagcctccaaaaattggcaggcagacttccggaatgaggcttctccaaggaatcttctcctagaattaaacctaggactgaaatacatttgcaaatgattgggcttaaaagtggggttgggtttccttgtgtcatgccggtatgggcccagagagttttgtgggtttttttggaaatgaagagggagaaataaatgatgcacaatgagaatgcagagccgaaaattctggaccacacatcatttacttagaacagactttccctctgatattcttcccaaatatgtcatggcattcacaaagaacactgcttctgaaatgtcggattatgcagtaatagtcactgaacgagaacatgaatgtctttaaaaaaattaatcagttgtctttaaggtgtgtgtggctgctcaaaatcctctctgtagtgtctcatctttagcagacctcacgtggaaacagctttcttgtttacagaccaccacactgacacattatctgctgtgattaattaaagacgatttttaaacccatatatttctttaaaaggcagaagagacagcccagctttttaaaaatggtggtcataaactaccatcagatggcactgtaacataaattatggaaagagtcagctat

SEQ ID NO: 4580 - DNA, 1232 bp, Homo sapiens
ttttagttaaactgtttcacctcatttttatgctgagttttgtaaagtaggtattcttgctgaacagagtcctgaaaatcaaactatacaagtagtaggaagtccattaagctgtttagaggaaaaagtgttataaatggcagttaaatgaacccaggaaagacccatcctcctttgtggctttctctgaggccccatgaggccaagcagaagcaaactggctctaggtgcagccagactttgaaaaggaatcccggccaggcttggtggctcatgcctgtaatcccagcactttgggaggtcaaggcaggcagatcacctgaggtcaggagttcaagaccagcctggccaacatggcgaaacactgtttctactaaaaatatgaaaattagctgggtgtgctggtaggcgcctgtaatcacagctacttgggaggctgaggcgggagaatcgctcaaacctgggaggcagaggttgcagtgggctgagatctcgccactgtactccagcctgggcgacagaccaaggctctgtctcaaaaaaaaaaaaaaaaaaaaaaaaagggaatcccaaccagatactggtgcaaggtcagagatgcagccaatggggagatttgtagaaagctcatagatgctaaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggtagcaataaaatgcaaactttattgcatttccagtaaaatctctcccactttgagcaggaagcactcacaaaaaacgcatatacatgtcaacgttgtgagctcatcagagttttagaaatcaacttccacagtgaaagccaatgtaggcagaaggtttataacagaatccccaggcagagaagtgaatttcagagcatttcagggaggaaactcctctgcacatgtcagcatgtttaacatcgatgatggcaggttgtgtgctggcagccagagtctgaggccactgtccaaagttcagcgtcagtggttcctgttgctggtcatggagagagacaactggaaagtcaggtgtcttcacgctctaactagagcacagggatggaccatagccatgctaacctttgttaacccctaggacttgtcaaggtgtttaagcagtaggaatgag

SEQ ID NO: 4581 - DNA, 2326 bp, Homo sapiens
tacaattgggccactctgatcctgctgtaggggtctgagactggttctctgtttccaactaagtggatctagccagctgcctcacacagagttgatgctcagtaaacacttaagaagtgcgaaggggtggatccaagttagaaataagaatggggaattagccaaagccagggcctctcagtcccctgtgccccaacatctattcttctgatggcagatggttcacctagttgagcagcctctgggggctctgctcagcatcccacccactgactcggtcgctcaccccatgagagagattaggagctttcacaggatcttggaacatccactacaggctgtgtggagccttccctctgtgaagttgctggtctgtgagggtggccacgctgcgctggggtggggaggggactcaggggcctagaaaagagcagggccttcatctgagcattcttccatccctcctgggtaaggcacacaggtattcattcattccacaaagataggttgtacttaagaaataattgcttgattagttaactataatggtttgtaggtgttttaccaaatgtgcctggctcagcaggtgcttaatgcatatttgactaattaatgactagttttcaggcccttaaccagatgtgcttagcatagtgcctgtgccataggtgtgcagatagtaaaatgaataaattaatgtttgaatgaacgaaggggtaggaaggaagatcaggctgggaacagcctttctctgctgagtgtatgtatattgtgtgatcgtgtcctggtgtgtgtgtgtgtgtgtttgtgcctcctctgctaacaggacacaagctcgtcatcctctcctgccactgccatgtcgcctcagcctaaatcagctctagttctgaaccccctcctggtcagtgtggaccctggccagcacgtctgcacagctcttggctcagagcagcgggagctggccagactccggcagccagtgttaccctgagactgcccctcggagctccaaagatatgtcttcaccagaaaccaggggggagtccccacgggccagctcctgatgatcagacccaaaacatttctgttgttattgcccagtggggccccttgggaggaatcctgcttctgcctctgttgtgtccctctctgggtctcagaagggttttctccagcctggacctgggagaggaacattcttcccctggagtggagctgggcagagtatcaggtgacccctgagccacctgggaaagcagtgaccaccccagatattaacagtaacctcattacccaggagcaggtgctggtgctggccacatctgagcaaacatcaggccagtcaaagcaaatctggccgggcgcagtagcttacgcctgtaatcccagcactttgggaggccgagatggacagatcacctgaggtcaagatgttcgagaccagcctgaccaacatggtgaaaccccgtctctactaaaaatacaaaaattagccagggatggtggcgcacaactgtagtcccagctactcaggtggctgtgatggtgcacaccggctactcgagaggttgaggcaggagaatcacttgaacctgggaggcagaggttgcagtgagccaagatggcaccactgcactccagcctgggcgacagagcgagactccgtctcaaaaaaaaaaaaaaaaaaagaaagcaaatctgatgattctgaaggccagcctctgggaatgtctggacacatagtacgtgtttacttaccttcctgctatgcttcctttccagaaacatgctggtgctttgcaaacagaggcagcaaaacaaacaatacattctccaagaacatattttaaagaaagcattctacacagttttgaggccaggctgtccagatgagtgtctgtaaattaaatctaggatctgtttctgctttctcaattgatcacgcatgtcccaacggaaagaaatgtttgctgcctctgcaggtggtgaacaagtgctgaataaggcctttcattcattcggttgttcattcaaaaacacgtattgaggccgggcgcagtggctcacgcctataatcctagccctttgggaggccgaggcgggtggatcacctgaggtcaagagttcaagaccagcctggccaacatggtgaaacctcgtgtctactaaaaatacaaaaattagccaggcgtggtgttggatgcctgtaatcctagctactcaggaggctgaggcaggagaattgcttgaatccaggaggcagaggttgcagcgagtcgagattatgccactgcactgggtgacagagcaaaaactctgtctc

SEQ ID NO: 4582 - DNA, 1618 bp, Homo sapiens
gttagttcggcccaatggcggcaccgctgcttcacacgcgtttgccgggagatgcggccgcttcgccctctgcagtcaagatgctgggcgcgtcgaggactgggatttcaaatatgcgtgcattagagaatgattttttcaattctcccccaagaaaaactgttcagtttggtggaactgtgacagaagtcttgctgaagtacaaaacgggtgaaacaaatgactttgagttgttgaagaaccagctgttagatccagacataaagagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacgtcacagagccttgcaaataatagcaagatatgtaccattgaatgttacgttcataacttactaaggattagtgtatattttccaaccttgaggcatgaaattctggagcttattattgaaaaactactcaagttggatgtgaatgcatcccggcagggtattgaagatgctgaagaaacagcaaatcaaacttgtggtgggacagattccacggaaggattgtgtaatatggttagcagtttattaatgaaagtggagatgaagtttatcataatcaaagggtggaaacagctagtgctgctcatctttggattcgcagaggcatttttggaacctctttggaaaaaattgcaggatccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagtggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccactggaggagactcagtgcagacctgcacaaacccactggacaccttcttcccctttgatccctgtgtgctgaagaggtcaaagaaattcattgatcctatttatcaggtatgggaagacatgagtgctgaagagctacaggagttcaagaaacccatgaaaaagttgttctggagaatcatgtagcgacagatgaagacgaacctgctttgaaatgccagcgactagaaatcaattgccaggatccatctataaagtcattcctgtattccatcaaccagacaatctgcttgcggttggatagcattgaagccaaattgcaagccctg

SEQ ID NO: 4583 - DNA, 5284 bp, Homo sapiens
ttttttttttttttgagacagagtctcgctctgtcgcctaggctggagtgcagtggcgcaatctcagctcactgcaagctccgcctcccgggttcacgccattctcctgcctcagcctcccgagtagctgggactacaggcgcccgccaccacacccagctaatttttcttatttttagtagagacggggtttcaccatgttgcccaggctcatctcgaactcatgacctcaggtgattcacctgcctcagcctcccaaagtactgggattataggcgtgagccaccacaccaggcccagagcctgtaattttcacccttactctactgtgcccaagaagtggaagacatactccctactccaaggagtttaagattgaaagataaacacgtgcagtctggctgggtgtggtgccgcatgcctattgccatcccagctatttaggaggctgagacaggagaattgcttgaacctcagaggcggaggttgcagtgggacaagattgcaccactgcactccagcctgggcaacagagcaagagtccatctaaaacaaaaaaaacagaaaaacaaaaaacaaacaaacaaaaaaacagataaaaaacaaaaacatatgcagcctaagatgaaagaagactagtcccatagggtacacatgcacacttactaagaggaggcataacctctacctgagtgaaacttgtctgaggctttcctgaatctgcagtggggctgtgtccctgagcccctgcactgctgcctcagaaggggcactagacccaaagacccaaaggcaaaaggcttgggttcaaactggtaagaagggacctgggtgactggaagaatagggttgagagaaggaattttatctgtaccttttgaattttgaaacatgtgaatgaactatcttaaaaaataaatttggccgggcaaggtggctcatgcctgtaatcccagcagtttgggaggcggatcatgaggtcaagagttcgagaccagcctggccaacatgatgaaaccccgtctctactaaaaatacaaaattagcagggtgtggtggtgcatgcttataatcccagcaacttgggaagctgaggcaggagaatcgcttgaacctgggaaggcagaggttgcagtgagccgagatggtgccactgcactccagcctgggcaacaagagcaaaactctgtctctaaaataaataaataaataggccaggcgtggagggaggttgcagtgagctgatattgtgccactgtactccagccagggtgacagagcgagactccatctcaaaaaaaataataataataacaataataaatttgtaacaaaagcaaatatgcactctgctatggtctgaatgtgccccctaaagtttatgggttggaaacttaatccctgctgtaatagtgttgagaagtgggaactttaagaggcaattgggtcacgagggctctgccctcatttatgccattatcatggcagtgggtcaggttatctcaggattaaaaaaaaaaaaaaggtgagcttggctcccttcctctctcttgggcttgcaagctctctggccctgccaccttctaccagggaaggatgtggcatgaaggccctcaccagatgccagtgcaatgttcttggacttgccagtctccagaaccatgagccaaatacacttctattgtttataaatcacccagtctcagttattctgttatagcaacacaaaacagaccaagacatacccccagaaggccagtggttaagataaacatgttaaaacaaaagtgaatttatgacttcatctcacccagaccctagctggtcctcctctgaagtgggaataatatctgccctgtctagcacaaagtgctgttagaaagatcaataggatcatgtgggtgaatgtgctttgaaagctgtgaagtattaaacaaatatgagatgagagggaaatctatcccacagaggattatactcccacgtgtgggcctagaggcatttcaaatactgtgttgtgactcagggcccgtcccagccccagttttgaagtaggcaccatttatggtcctaacaacttccatggtgtttgaaatgcctcctgtacccattgggcagcctctctcctcgctcctgctggctctcgccttcgagccgcctgcaggaagggaaacactcacacaagcccacctgcattgggtctccagggtcattgttactcaagcgtagtcctctctcctggggcccccacccacctctctagcctggtccccagctcctcctcccacccctgaagagcgaaccctgtgccctgtgccaggctctgtgatgctcagacgtgcagggccacaccagattactcactgttccctgaacacaccccacccttcccagctgctcctgctctgctccaggactacaggcctttctttcttcaccatgctccccccagggagagcctcccctcctttctagaccctgtccccaaatgcactccaccaaggccctgtttgaaagaaggtcgcctgctccctggcctgtgctggccttgggcgttgttgagtcctcctgagacggctccttctgctgcccactttagcacacggaccccatcttccacaggcctgagtctccatggagcctagctcagcaccttgcccacatgaggtacacaatgaatgatgatcgcattgaatttttatgagacagctttttcaaaaaaggcaaaagtaaggctctttaagggtggggcttcaggcacagtggcttctgggtgggggagaggagtttggggagtgaatctttgctcttaaacacccccactgcagggagagccctttttcccctagatcctgccttttctcagcagtcctgagggagcctcagggaatgaatgactggggctggaagctgcagctggtcttcaggccaaaagctgtaaaagcccagacccctgaggccttctgtctggggcaggccgcatgcaggctcctgactgcagccaagagcagtgatctcgcccttaaaaatcaacagtctctaatccacgtcggggtggggtttcttttgcgtgttattccagcaataatacgtaactggtccagaaaccgcctctgagccctgggcacagtctcactgagagttccagcccttgccccgagctgcaaactggggcctaaagctgcagcaccgagaggccacgtggggcgaggcctccccggaaggcctgcggcgccgccgttgtccaccagggggcgccaggaaacggcgcggcgaggccccagctcaacccgcccgcgcgggcacacccgggctttgacccctttgtgatcgaggacacggacgggtttctctccaacaaaagggggccataaattacaaacggaagcagagtgtgtagggaagaacaggaaagcacgtgcgttgaaaccggaactcgggcctgcttgcttgcttatttattttagttattactgttttcttggggcaggcccttgctctgtcgcccaggctgcggggtggtggccccgtcatagctcactgcagcctcaacctcggggctcaagcgaccctcctgcttcagtctcccaaagtgccggggctgcaggcgcgagccgccaccccggcctccgtgctctttctcagggagcattttccacctcccctgcaagaggccgttttgccagtggctttcagaaaagactgttgtcatctcggggttcagagttaatcgtggatttacctaccacacagaaatttccaaagaatcgatctgctccctctcaatatccaccctaaacaagagcactttcccaatcagcgccttgtcctggggcttccagacccatctggccttttgctctttgctctatgcccacttgagctgtgaggttctcagagacattccccaaagccctcccagccgatctctgctgacttcaatcctactcatccctcaggggctaacaaaattgttaaaatttaaacagtaataattaaataatgatattgctgtatgtcaggcatgactccacaaagcaggtattaatacagatggtccccagctttcgcaccatcgtaagtgatacactttacaaactgtccttcgagtagccatacaaccactctctttttcactttcagtacattattcaataaattacacaagatattcaatagtctcttataaagtaggctttgtgttagatgatgttgcccagcagtaggctggtgtaagtgggctgagcacgctgaagttaagctaggctaaactatgaagttcagtaggctaagtgtattaaatgcattttgacttacaatattttcaacttactatgggtttatcagaatgtagctctatcataagttgagaagcaacactagtctcatatatatatatacatatatatatataaatattttggcacgatcttggctcactgcaacctccacctcctggattcaagcaattctcctgcctcagcctcccaagtaactgggatgtagtcccattctacaagtgaagaagttgaggctcaaagaggtcaaatgcccaaagtcaccagatactgagggatggccccagtgtctaaatcctaagcctgcgtttttctcctatatgccagtggttctccatgtgtgctccttgaagtagcagcagcaacatcacctgaaaactcactagaaatgaaaaatttttaaatttttgtagagatggggtctcaccatgtcggccaggctaagtctcaaactcctgagttcaagcgattctcccacctcagcctcccaaactgttgggattacaggcgtgagccactgcaccaggccccgagatcacccttttatttttatttttttttaagacaggatctccctctgtcaccctaagggaggagaccatccctcacattgtcttatgcccaatttctgcctccaaataaagaagaagtaaaaactaaaaggcagaaatgaaatccacgagcagacagcccggccccataccctgggcctggtagttaaagatcgacccctgacgtaatcagttatttgtataagaaaagcactgtgaagatccctgtcctgttctgttccgttctaattaccggtgcatgcagcccccggtcacgtaccccctgattactcaatcaatcatgaccctctcacgcggacccccttaaaagttgtgagcccttaaaagggacaggaattgctcactcggggagctcggttgttggagatgtgaatcttgccaaagctcctggccgaataaagcccttctttcttt

SEQ ID NO: 4584 - DNA, 2095 bp, Homo sapiens
actcctgacctcaagtgatctgcccaccatggcctcccaaagtgctgggattacatgtgtgaaccaccgcacccagcccataaggtttttgaagaaatggcagctataagtatctactgagtgcctgctctatgccaggcattgtgcgaagggcctaacaggcactgtcgtctttgatctaacaatagtcttgtatggtgggtactaggatggactccattttacagatgaggaaaccaagacccttagacttgactgacttgtccaaggtgctcagcagcactgggcctggcacctctgcctgactctgaacttgggaggatgccgccttctgggtgaaggaggggatggatgaatgataaaggagtggcagcagcagaaatgaatgagcgagagccaaagtgtcaggcacaagacaggctcctctgcgggaggaggagctgacagcaactcccgttctctagaactggggaggagcctgcagatttcagctgcaggtttttatatgtgtagtaggataagtagtgccccacccccaacaaattcacgcccatccggaagctcagcatgtggccttacctgaaatagggtctttgcaaatataataagctaagggtttcaagatacaatcatcttggacttagggtggcccctaaatccaatgactcatgtctccgtaagaagaagagagagatggccatgggaacacagaggcagagactgcagagatgggcccactgggcaaggaacgtcaggagccaacagcagctggaagagcaggtatatccaacacgcagtgaagacatgaggtaccgtgtgggctgtttctaggcaccgtggcgtttcgtcttcccagccacctgcatcctcctcgtctccaacccacagatgaagaaactgacagagtaagtgacagagcccaaatccaagtgcaagctcttaaccaatgcctatcctcctccccatgggatgccatattacacacgcctgtggacacacacacctctagacatgtacatcaattctgaaaacagagatgggaccgtacaataggtaagtgtttcaaagcgacttgtggttttcaaccaacggtacaccatggacatccttccatgttgatgtctcatgccatttaacggcaggagcgtttcctaaactcagcacaaaggtggtagacacacgcgcacacacacacacacatttcctaaactcagcacaaaggtggtagacacacacacacacacgtacacacacacacacacttcctaaactcagcacaaaggcggtggacacacacacacacacacacacacacacgcgcgcgcacaggagaaaagaggaaataggtcccctgaggagccaaccctaaagcctcattacctggaactaccctagaatctatcatgaaagggaacctattaaacccataaagagggacaacaaagtttgcagagggtgtttacctttcagaaaagaaaatttcaagccctaagtagctgtttgcttgtgggcatggccagtgtgaaagaaacaccctgcccccggctaacaggctctgccgagagcctattcaacaactcgtgcctctgggagaaacgggtgactttattcagcttcataacactcaaagagctttcccatggcgaggcttaaaaccaacccccaggccatctcttcctccccagcctacgtcttccttgctgagtctctggactcaagtcctccagaatagagatgcagggatgggactgccagcggctcaggggtccaatctgcctcatatgcacagggttttgtttgcatgtgaggcagattttcgaatagaaaaaaattcacttaggaatcttgatttcttctctagaggacctggaatatctggccacatgctacctacccaaatcacccacacatctctgtcacctcccctgtgggcagtgctgggatatggtgctcagtctggcccttccgctgcgtgcttatccaggaagctcagctggtgtcatcaatctcattttataggggaggaaattgaggcccagagatgtcctaactccattttttccctttttttctgagatgaagtctcactctgtcg

SEQ ID NO: 4585 - DNA, 4481 bp, Homo sapiens
tatgtgcacgtgtacacgggtcatgtgtccaggagtggcagtggtgcatgcccacacctctgcatgtacatgcctgtaaacacactcctgtatgtatagcccgaggttctgagcccctggacctctgagtctccctccaatgctgtctctggatgaaggtcccagccctcgcctgcccatggtgtcctggtgacattttaacaggagggcaatgggccaagtttaactcagacgctggggcctggaggggcagctgaatttgcagtcaagagagcagggtttgagtccctgcccaacacagacttgcaggaggcgttggtgggccagtccctggctttctgcactgaggtctcctctcctgacaagaccagacttgcaggatcagtatgggatgaggatgagcattgccaattggcaagttccaagccgatgagagcctctgtgtgtacgagctgcgggagagacttgttaaaggtagattctcacagttgctccaggcaggacctgaggacctgcctttctcaggtgcttccagggaccccactctgagaagtgaggggctgcagaaaacccagggatttctccaaaacttgcacgagttgtctgtgggaaggaaagagacagactaaccctgcaatggtcttgtgctggctgcccggtgccaggtgcagtgggagggagggagggaggttgatccctcagaggccccggcaggtggcactgtcctctccagcctgccgggaggctggagggagccctggggccccccaaatcctgttacatcctggcaattacagttgattgctgtagcactaatcccttaaaattagtcattagcggcttaagaaccatttagcgttgggtgcccactaaggagctggggggaagcggggaatctgccagaaccagaactttctctggcccggcagccagggctgggcagggacaggggaccggtggcgcctcctggggtcctcacacgctgtttctttcccattccacctggcagacgcgtgaagaggatttgacaaactcgtggggaaggtttattaaatcagcccgcaagggacacatgttatcagagacctctgctctctccagcccacccagacacgtcccttgggggtgtgagggctgctccagccccgcctctgcctcttcccggggaaaggaaaatcccatgatcagagcagagccgcctgccggccggagctggtgcatctcagcgctggctggggggcccagcctcttgtagaccctcccggggagccggcaggggaggtgccggccccgggctccccgaaaggaaggtgctttggagatccctggctgtggagggggaaggggagaccaaggcaggagggtacccctggtccggatgcggatgtggacggggaaggggagaccaagtcaggaaggcgccccgggtccagatgcagacttgagattgcacctggggacagggggcttgtttgtggccctttagctgccaagcccgtcttgatgccacagaagccggggtggaaggcaggtgtgggccgtggcccaggctgcagcaaccagaaggttcagcagcctcagatcttgggaaggtgacacaagggcttggggacagtgggtggagtcctgtggccatgagggtctgtggctgtgggaacccctgctgcggtttttctggtgtggttggaggccgtgaccattgctcctcagccaccaggttatgcatcggtgatggcagagccagtggtcccagggtcccggagctgaggggtgtgtgtccaccgggggagtcagtggttctcagcctctgccccaaatcctcctggtaagttccattcccacctgggctggctggagtttagctctggccttgcaatcaagaccaccacctttgggggggctcctgcctggacctggacccggctgtcgcccaccagggaccactccccctgctgcccctggggcagaggctgcgggcttctgttctgcctgagggctcagccctctgtcctcccccaggatggcccctgacctccagcctctgggcccaccctatccccgcttcctacctggtggggtcccatccgccttcagggtccagtcggaccccatctcctaaattgccttgacaagaaccggcccctgtccctctgtgttcacagccagggtggtgctggctccctggtcctgaagggccagctgagtggggctcggtcccagaagccccaggtccatgagtgtgtgtgggggccgtcaccggggctgctggcggtgaaagggtgggtggaggcaggcacctcggctctcaggctgtggcacggcaggaatggtgatggggaaagcagggtggtgggggctggggtgccaggaccctgggattgacctggggggtattggcagaggacagcccaaaggctagaccagggccccgttctgattatctgtggctgtgggagcagcatcctgtgtgggccccgctgtgctcagctgagacatggggctgtggccaccccagggctgcgatggggccgaacagtctgggactccgggtttcagtgtgagagccagtggttgcccagctctggcggggctgtgtgtctgtctgaggcacatgtgtgtccaggggccgagccagggcagaacaaccttcacgtgacatggagacatctcacttctcttgtctgcacagcctgcgtcccgcacaaagcctcgtgaagctgaaccccatgggcctccgaggacccctccgtcaaaccccttgcgcccaggaacagaagccaacactgaaaggtgacattggggggtagggagaggacacgcaggaggaatcaggggcttcctgtctcgaggctgggggacacaacacatccgtctctcccagtgggcctcttagtggacggccccccaactttcccctgagacctggaggaaaagggctttcatgaagggtttgtggaacctgacggagtgttctaatggtgggcgggggggggggggggttgctgggagtgggaagtgggacgtgaggcgggggtggcagagccggagctgccccacctttgaggagtctgggtggaggcggcagtcccgggcgtggccctggcccaggcccacagttcgcaggcaggtggcagggtccacgcctccctgctccttcctccccctgcccccgcccccaccatgggtctccctccgtctcagcattggaggctctggagcaaggccgttcccctggctgcaccagctcccctctgctgggctcagatagcggcagctgcacctctgaatcatcggctcatattccccatggctggagaaggccggggccgccgagttgggaggaggggactcgctctccagcctccagggccagatgctccatctgccccatggggcggagccaccccacacccctgggtttggtgctgccagccgggtccaggccctctcttggccctggagagatgggcacagagggcagtctcccctcgatgcacccttatctgtgaggacagtccccccagcccctgtgcctccatccgggttccatcagcaaagggaagtcctggagctggggcccggccttgaggcagagctggaagctgctacgcggaggggcctcagcccatggtggtggggagggcaccccagccacccttggtcccagctgccacctgtgcactccctgagcagagatgcctgactcaccctaacgttgtccgggctgcagatggcggcggctgctgagggagctccttcccctcctcccgcccaccctgctagggctaggccacagatacacagggcgagtgggagtgtctaggggagaagattttatttcacaaggtgaggaacccaggctggtggccgacgcccacacaccaggctccgggacgcatggggtctgcacgtggagagggtgctggccgccccagcaggaagcccgacgtaggtcccagcgtgtctgtcagtcatgctgctgccctgtggggctggagaggcaggacgtgcacccagcctgtggctggcggggcaggggacctgcaggtcaggccaagcagagtggctccggctatgcccccgagcctgcaggctacgccacggtctggcggctgaagagctcgagggtgagcgagctgaggaaggcagggatgctgtcctggcgccgcaggtgcacctcgatgagctcgcccacggtgtgtgagaactctgtctccagtagctgcatcttggaacccgaggggctggtggcctgcggggcagtcaagaaagagacaagacagcggtcagcccgacaggcctctccctctcccctccctccctacacagcccctccagccatgggggcttccctcagtctgaggacctggacaggggtagatgcgtcctcaaccctgccaggccttattccaggtcacctaaagggactgaattaacccagggcaaggtctctgttgtctacactgtcatctacccaggca

SEQ ID NO: 4586 - DNA, 2241 bp, Homo sapiens
ctcgtgctcttcttgcccctggagcgctgggggcatcctgagtcaggctgtgagaagattcgccaccagagggcgccccgggccctgggtcgtccaaggggacaaggacgttcccgtctgtgcttcggggttccctgacccccccatcctgcagcccaccttcctgcagtgtcgtggcaggtctgtcttgcagccgatgagcaccatggggatcccgcggcagaaatgcgtgacctcagggaaccactgtggagggaggaggcgggatcaggggtgcggccgggcccagatgtggggccaccacccaggaggccggcctcaccttgatgaggacgttgtcgtagctggtgggattcatgacgtcatagcagatgagcacgaggtgggtgttctggtaggacaggggccgcagccggtcatagtcttcttgccctgaaagcacagagcagcgggggtcaggggacgtcccctccctgtctggactctgacgggtgaaggggaaggggccaggcaagtgaccctgccttagggcctcaatttcctcatctatacaatgggcagcaagccaggagtgctggcacaggcctgtggtcgcagctactcgggaggctgaggccggaggatcgcttgagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtgatccccctgccctgatggtcaagggcagagtgcagactggaaccctcccctccccaaagattcagacctgtggggctgagtgggctcatagtgtccccaagtcctgagaggctggtgtctggcttcagcctccagcttctcaggttctgatgcagtcagctgagttccctgcctattcttgcaagcactaggaggagggtggtgggttgctgggaacagcaccgagcgccctccccacccagattcacagagcacactccctggggggatactttaatccggaggccgtgacgcctggctccgccccgagacgagctgaatccaaatacggatctaggcttgagcttggttgggtttgcttttttcttcttcttctttataaacaattctttgtaactttttgtattgacagtttcaaacttacagtaaaattgcaacacgagtatgaagagctctctgactgtgattcaccacctgtttgcattggcccctctgactttatctggagacagacacttctgtttctccctgtcagggcacggtaactgtagacatctgcctcttcaccccttagctcagcgcctatctgctgagaacaagggcgttctctcccctgccccaagcccccagaaaccgcatggactctgcattctaatctgatccacagaccatagtcagattttgaccatttcaccaatattgtcctttatttttttccccgttgaggagccagcccagcccagggttctacactgcacttagtcatcctgccccggtatttttttaaaatccccacagtgagaactgagagcttttcaggctcattggtgaccagccccccgcccctccacttccttccactgaacaaggaacgtggaggcccaggaatccccctgccctgtccgcagctgttgcaggtgctgggtggcaccagcctgccccccgttccttctctgccagacacctctcaggacaagtggcctctccacggagtaccaccaggccatgtctgctcctaaccccttgctggtgatggggcatggccaccctctccccactggatccccctcaacccagggacctccaaaagtcttcagccagctcccccatggaacagtgcttaagggtgaggtcactagagacagatgagacacatgttcaaatcccagctctgccctcactggctgtgtgaccttgacttagacaggacagtggtgggagtcttggcttccccatctgggacatgaaaatcataaaatctacctcacggggctgtcaccagccaaggcacaccattgcactccagcctgggtgacaagagcgaaactctgtctcaaaaaaaataaaaataaaaataaaaaatgaattaacataaagcattc

SEQ ID NO: 4587 - DNA, 1347 bp, Homo sapiens
agttttcagagtaccctgctgtggccttggaaacagaaaacccacacagaggtcaaacgcagttctcgtggagtcaccttgtcatcctgctttgttttggaaggaactgggtcggaggcagcacagtaggactacagcatctttaacccttgtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaatcacacagttagcctcatctgatcaccactggccacgatcaggccctctgaaagtgcctagttggatgcttgccaatctgctatgccttggaggaaaaaatcatttcaatttaagaaaatagacacagaagcaaaaaaccaaagtgagcctggaaggtttgcctgtctgtgacagtctacagagcagctgtttgtgcctgtcacctgctcaggctctcacggtgactgcatggggagggcagggtgtgtgcattgatacctgccgtgcccagtgtacgccgaggtttgcccatgctgcagctggaaggctgcagaacaaaggttcgttccaacctctacacttgaattgcattctgcgtcatcatcctgccttctagaacaacatccaactccgtgggctgccttttaaaatcttgatggagggggagaggagtatgtatgttgcttcagcccttaatttgcaaggtggtgaaaccactatgggcctggccaaatcagcaagaagggggctggaggaagggcagctgtcttggggtacactgggactggaaggagctgccttcctgaagtcctccttgcttctctgaagttgtcccagcacagctgtggcttccgggagaggaatgtcagggccctgataaggaaatgaagtggagcccgcacctgcccagaatgtgaaatttcttcagcagcctctgaccgggctccagatgggcaagtgcagcccctcccacacctgctgagtttgatctccctcctcctggatgctgtgaggcttggcacctgcccagccaggcactcaggaaacctgctgggggtctctgagcgcccaccagggtaaaccaaggtccctttcttgtgttaaagagaagaactgggatggaagcgtgcccagggctctttggaagcacccaggaggggcaatggaaggcttcctgggaagagggtttctgggttgcattttaaaatacacacaggagttagctaa

SEQ ID NO: 4588 - DNA, 1227 bp, Homo sapiens
tactgccaccagaaggggatcctgcacagggacatacagccaaagaacctgcttgtgtggatgctgaactgaacctcacgtttgcagactttggctttagcaacgagctcacctttggcagcagggtagataacttctgtgtcagtgcttcttacactgtcctggaactcttctaggcaacgtacgcaaaagtacgatggctctgagatggatgttggcagcctgggagtcattctctgtgcagtggtcggtgatcatcaggtttctgtcttacaatggacagaactatagcagagcttccaaagtaggtatatatcacattccctttacatgtctatggagtatgaacacctaaataaattcctgctcccaaaccccagtaagagaggcactgcagaggaaatcatgagggacccatggataaatgtgggctatgaagaggaactaaaactacatccagccactccctgactccagggatccctggcacactgagttaatgctgtccttgggctacatgtaagggaaattctggactcattgatgggctacaggacacctcagctggagggccacaccatcactgtgaagtcctttccttagctgatcccaccaactgttgccatccttctccatccttccaggtacagcctagggtctctgccagcccaaagcagcgagcctgctcttcccacattttctttttcctctaatagaaaatcagtggcttgaggaggatcaggagtcaggttgaaaggccagcagaacagtcaaagtgcctgccagtcttctgcctcaccttgagatgaagactggcccagcaaagcctccagcatggccttgtggcctccccctccacccacagcaccagcagcagtggtggaaccccagacagaatcaactgttcctagggtgtgtcctccaaaggagaactcccttcatactgtgcagctttggttaggaccggcagaatttgccagaatgtataacctcagccattccctctcgcaacattcagggctggcagggggccacaggaggttccttatcttcatccacagacacctgtgtttcaggttggctgggaagatctggcatgtagctggaatgtggggagttcaagctgtgctcgctgcatttcacatggagcaggaagatcctgagctccatggagtccaaggacatggtgcaggagatcagccgggtgtgggatgcagacagttgcag

SEQ ID NO: 4589 - DNA, 2425 bp, Homo sapiens
acaggactgcgttctggaggccgagccggaacccgtgcggcggcgctgggaagagactgtgcccctgcagctcccctgtcaccggctccaaggagcgtcgggctccccccgcccagccctgcagcacccatccggcaacgccagactcggcgcaacgggggcagctgcgactttaaatctctcagatccgcggcctgagggctgccgccaccgagaaatggaggcacagagctgtgaacaagagaccacggctcgccgaaatggcggtgccaggagcctgaaagggaatgcagccggcggggttgtcaaggacaacatttgttttggcgcaaccagcggtgccgtcaccaagaaaccgtcgactctgagaaaaaaagagaagttcggctaccgagaaactccgtgcagcaagtgctgtgacagcaaaaccgccggcttcgcgccgctggcgaaagagccaacggaaacgccgggtgctgcgaccgcgaagccggcactagagggcctcggatggagaaagccccgcaccgagacgaggaaactgtgcacagcacgactagcagttgacacaaacagaaaagtgtctcgtctgctctctgggagaaagcgtggatcaaaaccagcaactcagtggagagaaccccgcagccactgaagaagttgcccacgtggcggtggggccagagaaacaccgcgatttcgacgacagccgtagggataccacagagaaacatgcgcggccacagaagtacatccagctccgcgcaatcagtggttctgcgatccagaaaccgccagctgggctagactagaaacttctaaaaaactgtcgtcccatagcagctttcctaaccacgacagacagtcgcctttagagagcacctaacggtgctgagaccggcctgggccagcaaaagcgcagagcggtgccagtgccaagaaacgcccgacttggtgaaaccaaccttgtgaccaccgattccactggcttcgcaggacgcaacgggcgaaggcgcggcggagaaaccgcaggctcccttcaccgattatgctgcgggctggggatggtggggggcacccgcgaaattgtgaaaccagcggcgctgggacccagcgatcagctgcccgtagcaaatgtctgtgcagttgcaaaagataatttttggccgtgagaaggttgccgccagagagcgtccgataacgctgacaaaggcgtggcgttgccagtgagaaacagccggcgctgggaaaggaacggtgcagcgaccgaccaactgcgcgctcggtgccaccaaagtgctactggctctacccactctgtcccccacgggcttagggaagtctgatgtctttttcttttcttttttcctctgtcgcctaggctggtgcagtggtgtcatcttggctcagtgcagcctcgacttcctgggatccagcgatcctcccgcttcagcctctagagtagccgagaccacaggtcacccctcgctgccaggctctcttcccggtccagagcccacaggatcctacaggaggggccaacaactgcttgcctttgaaacttgaaactctcggtctaaggttccttaggagcgtaaaaggcacagcgttttctgatcgcagcttcaggtctcccgcccctgtcccggtacctctcctgcaggacggaactctgtgggaacgctcgttgattctgatggttaactgtcagatatccttgatattggacataggatttggaagagggcaggagagaaaaatgaactgcaagactccagcacaagaggtgggattgctggcagatgtctgctccctctccaaacctaatgaacatctcaaagtgccatccactttcctatacccttgatctgtgaaatggatcactgacgctttctctgtctttccggaaatgcaaaacaggtgaattttcaagcgcttgaattgtctctcacacttttcagtcaagagtggggctataaactccttcctcataggaaataaggaactgccactgcttggaagtaaaacgtatttttcccataagctttcacatttcccaaaaaaaattatacatccagatgtaatccccctaagaggcttacagaccctaccaggagcgttcccacgcgaacgcatcatctcccaatcggatcctgaaaacaccatgcaaccaattccatccttttctggatcaacctgggcagaggacaggtgcagaggagcccagagaagggccttgacaagtcaggagacccaatttggggtcgcaattgtcactcactccccaggcgtttgctttgatcttcccctcccaccatactacttcttctgctacctggtttctccctggtatttgaggatcctccaattgccttctggtcttacagacgggagaataaaggaaaaatggcatcgtttccacctt

SEQ ID NO: 4590 - DNA, 1204 bp, Homo sapiens
ccctctgcctcctgaacaaccctgatgcttccctgtgtggtcccttgtggcatagagtgccccctcttctcaggaactatggtgatggccagggtgcacaagaccccggtgaaggatgggaaaaagagcaagaagatgaagaaagtcatcatctgtgaggcccgccaggctttgctcggaggctggaaattcatcatcaggctgatctgaagagagagaggcagccacctcccatctgcagccggagcagcggcagagggaccccagccaggcctggcttcctgacacctttgcagagcccccttccccagctttaagcgccaccaggtcacaggtgactgaacaaagctgattgatggcaatgtcggactgactcacatttttggagtagaacatgatgaaaagcataatcatttggataaagggcagcagggggcagaagaagatgccaatcctgtgagggagagaggagacgggatttcaccatgttagccaggatggtctcgatctcctgacctcgtgatccacccgcctcggcctcccaaagtgctgggattacaggcgtgagccaccacacccagctaatgtgtgtcacttctaagctggagcacttaatgcccctgtgagactctccagaactcctcatcttccctttggaatggcgatcaacgatattcaagatggctgcttctctctgagcctggatccctcagtaactaacataagaaggtccctcctgctaatccacactgtgtatataacacgagcaagaaataaacctttgtgttcgaagccactgagatctggggggttgttactgcagtataacctaacttattctgactgatacattctcttttgttgcatctccaaatgatctgatttcacttcccattataatgatagtaaatgtacataatgtttattgggtgctgacccagcgtacactgccaacctctttattgaatcatccccctcagtctttacaattccatcatctagtagatggtattttatgcccatcatactcaatatgcaaggttatggggtgcagtgagacctaacatttccccttctatacaaacttttaaaagtggcaccatggatcggtggctgggatgtggggaataatgagggcataggaatatagtcagagttttctttctttctttctctctctctctttctctctttctttcttccg

SEQ ID NO: 4591 - DNA, 314 bp, Homo sapiens
ggcccgcccggcaggacgactgagcaaggccttggaaaaccggagagattggagcgcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaa

SEQ ID NO: 4592 - DNA, 1951 bp, Homo sapiens
gggggatgatctgtcctcgggtaaagctcatctctccagattacagcaaggatgggaatctgaagcccaccacatccttctttccaagtcaaagaacgtaacactgagagggctctgagtgccagcatgtgcagagttggaacctcccactgacagccagaacgatgagccactcccgaagagctgctcctactcaggaccaatgccacactccaggattccccacctcccgtgaaaccagtgggagcatatggcaggccaggatctgtggatctttacaggctctggacacatggcgaacacacatccccagaaagagcccagctcccactcaggcatcacagatctgtctgctgttgcctgaaagcccctggagaaatcccacaccccggggatttcttaaacctttgattaactgggatgctatcctgtacttcaaagaaaagaggaatatccaagtaacaacacaagctcatccccagaaccaggccagctgcagctctcaggaggtagccacacccgggctagtgccactggcagctgcaccaaaggtgtatgagcggtcacatgataacctgaacgctgaggcccaaggactggcaggtgctcaggtgtcgaaaccacagaatcccattaccaggctctgttctctgaaggaacagtcaatcttgaagatcttcactaagcagagcatctgaggtttaccggcttgaagacccagcaaactaagagttcagcaaaccagaatagcctctctggagggcacccgtgcctctgccggtgctggaccctgcgggtccctggtctatgagcttccccagaaaccctccaatctcatccacgcagctgccagaatgaatgttcaaagataagaacctgagcacagtggctgggggtttcgcacacccctgggactcgaccccaagcttctccttctcagcactgcagcccaagccgccctgcccttcctcccaatgccactacttgtcactgcaccttggattccaggccggcccttctgctgccctctctgaatgcccggcctcaatctagcctcctcctcatcccgcgagacatggctaaaacatcacctcaccctggaggcctcccctgacccctataaggggacaggtccctacagcagcccaggcttcctcttgataatgtgaatgttaattactttaattaagactttaaattactcctctaaaatctgtcttccgtgctacaaccacaaactccaagaggacagggatcaggctttccttgttctcctgccccactcccacagcacagggccaggagatgctctgtcaacactggctgcgttgaaccgaagtcatctccccaccgcagcgctctgcaccacacccagcaccagggcaggtgctccatgaagggccgcgtgaatgactcaacttcagccccataaggaatctggacagcacaccacgcaagttaaacgcttctttacaacataatgaaaggcggacttggactgtactaatgaacattccccaaacctaggaagctagatctaaaaaggactacaaatgcaataatcacatgtgaaatccaggaccgaacttcttttttttttttttttttgagatggagtctcattctgtcacccaggctggagtgcagtggcgcgatctcggctcactgcaacctccgcctcccagtctcaagcgattctcctgcctcagcctcccgagtagctggaactacaggtgcatgccagcacgcccagctaattttttgtatttttagtagagacggggtttcaccatgttagccaggatggtctcaaactcctgacctcgtgattcatctgcatcaacctccttaagtgctcggattacaggcgtgagccacagcgcctggcccaaacatttttatatgtccacttaatagttgactgacagaaataaatggtatgttttacaca

SEQ ID NO: 4593 - DNA, 1597 bp, Homo sapiens
gttttggccaggatggtctcgatctcctgacctcgtgatccgcccgcctcggcctcccaaagtgctgggattacaggcctgagccaccacgcctggccgacctcagaatttcattcctttttaaggctggtcagctaggttgtcagcctcagttccttaatttgagaagtgggtatacttctaagttataaccttgaaaatataaagtattctcttgtgtagatgtgaatagttctaagtctttctgccacccacaccccagtcagaccataaattcacttattgaatgaatgttaataaaagactaaagtttgaacaacagccaggtaacatttctttgccttttattttccactcccctatctcacttaggactagacacctcgagtgaccctcacattcccctttcaaacagatttggtaagaatttgattaaaattatctagcattctttatatttttttagagacagcgtctcactctgtcatctaggctacagtgcagtggtgcaatcatggctcactgcagccttaacctcgtaggctcaagtgatcctcctgagtagcacaagtgtgtgctaccatgcttggctagttctttaatacttttgtagagacaaggtctcactagaccaggctggtctcaaactcctggcctcaagccatcctcctcggcctcccaaaatgctggaattataggcctgagccagtgcacctagccaaagttgtctagcattcaaccagctgctcttgaacctgcccccgcttccccatttcccctacttttcaaatatccaaccccacgttaattgctttatgctatttcagccttatgaccctgggtggcaggtgcaatcccattttacccatgagggagctgaagctcaaaactagagcagtttgctgaagttcacccagctaataagactggattaggacttaggcctgcctgattcaggttcagttctcagtacatgctcatgccaggcatggatgtcttcatgtccagcactctgaacatgagctagactgcaggtgacttagaaaggcctcagagtctagaacagagtgtctcaagggcagagccacattatggagattaatctggctggaccaaagtagtagtagaaaaatagaaagccatatgaaatgagctggggttttgcatgagaaagtagggaggttccgggcatctcagttaaggtggaattgcaggtcctcgccctaatcctgatcccatctgcagcatctgttcctatttgcacattgctctagaattgatgaaatgcttttagtgctaccacctcagtggtattcaaatgttattaatgaagaaaacaaacataatgaaaccaatcccttccaggccaacatgggaataatgggttgtagggaggtgtacacttatgttttattcttacttgtttttgagacgctctgttgcccaggctggagcgcagtggtgcaatctcagctcacttcaacctctgtctcccgggttcaagcgattctcatgcctcagcttcccaagtagctgagattacagctgtgtgccacctcacctggctaatttatttgtattttttagtagagacggg

SEQ ID NO: 4594 - DNA, 4481 bp, Homo sapiens
aatgtgggagaggccggcggctctgaccttggtgtgttacagcccttgccacctccctccgctgccctgcatggggactcaaaccacaaacagcagctcggaaacaagcagacacgcgtcggactctggttcacggggaagagcgctgtttaggagatggacgtgctccacgcagagacgcgtcgggctctgattcatggggaagagctctgtttaggagatggacgtgctccacgcagacacgcgtccggctctggttcacggggaagagcgctgtttaggagacggacgtgctccacgcagacatgcgtccggctctggttcacggggaagagcgctgtttaggagacggacgtgctccacgcagacacgcgtcccgctctggttcacggggaagagcgctgtttaggagatggacacgctccacgcagacacgcgtcgggttccggctcacggggaggagcgcgctgtttaggagatggacacgctccacaccacctctggcgtcctctctgccctcaggctcttgggcattcagagccaggagctgtttctggggaggcagagatccctccaagccccaggaaaggcctcctgctgcctcggggacaaagctgtgtcaggctcttctctccacgctccccaagggaggggaggtgctcagaaacagaccaagagactcagttggtgccaggatggtgcccgtgaccagggagatgtgcacatgcgttcagcgtcactggggaagggacagccacacaggcagtctcaggctgtagctgaaaccccaggcatttccctaaagcaccagcgtccagaactgaagaagggaccagccccatccggccccagaccacagtggggaaccttccagggccagtctccccctgctgcccttcccgcagggccaggggctggtcagcagcacaggccgcccccggcgctgcagtcctggacgtccatggctgacagctcctgggcctggaacactgccctttcctccagctctgcaaagacacttgaggttccagccaggacacgggacataaagggggtcagccctcacggacagtgtttccatagagggttcaggaggtttataaacaccagcaggatggatgacaccacagccaccacaggagccagcatccaagagaccccgtgagatgccaagggtcactcgtgcccgaggtgccctccggaaccggagactacagataccaggggatgcttgggccaagtgtgtccagccacgaaggttactgcccggccctgggaggtcactgggaccaggagctgcccccacaaggaatgggcggaaggaaagggtgaccgagtgcccggccccgtgcccgtggctcaggaagacatgctgtgtttgcatttctgttgttcccagagcgaggggatgagaagcctgaggccggcccgtccctgctccagacgcccccccaccgctccccctcataggagccaaggaggaggaagtgcttcattctttgcaaagaatactccgcctgatgcaatttgcgtgtgcaagatgtgtgaagtgccttttccatttcatcagcacccgcagcctgtatgaagctgctgtttgctctctgccagctcgtggggcttgaatggtatcacgggaggttcttcatcttgcggtgggacggtcgcctcctgctgatggctccgcgttttcattgaccacattcattacaaagagacatttcaaaacatgttctgcagctgatttgctccttggccccaagaatggaatacagataatctgctcacatccatcaggaagcactggttttctttcgggacacaaccgaacgtgccaggactgcaggagccgctggattacagagcagcaaaccaggcatggcaggcggtgctcgcggaggtaccacggggcggaccagggtgtgcagcgttacgtgacttgggaagatgtggggggcccgatgtatctaccaggagacagtggagacctctaccctttagctgtcctctgtcccacacaacccagcccccactgggcggccactgcaggggaagctcagctggaaggttccatgggagagaccagaccagtcctggcactgtccagcagctgccttcggcccatgttctgaaaccgggatgcacacagcatggagatctcagccctgggcaggcctcgccccctccagcagctgccctcggcccatctcccaaagcctggacgcatacactggggagacctcagctctgggcaggcctgggttcccatcgcttcggcgtccctgggcccgggacacggaacacacttgctgcgtgctgtgtacaagaatgaacgaatcggcctgcctagcaccccttggccggctccaggcctccacttgctgtgtcaagtgaggctcccacgtgctgaggggacagagggtccctgtgacctgcaatgctcccactctcacccacgcagctgctcacctacacagccggtttctccagggctaacaggccacccagatgcaagccagtctcagcccctgaccacactggttttcaaatgaactgtggactctcatgacagagaagcggctgggagtcccagcgtgggatgtggtgggacggggctggggtgtgcagagacgatgatggaggagctcctgggggcacacagacctagtgtcgctctcagggctgggtccgcaggccactctccctccctcaacaacactcacgcctgctgcagccccaggaagggtcaggactcacagatgccaacaagcaagcagcccgtgctggaagcatcaccaccaccggccccagcaaaggcttcctggtgtgtgcggctgaccatcggccactcgggtagacagaagtgtgggtgggctgtgtgcatgccagggcagacggacagcccggggtctcaggccaatggaaacaggaagtttccggctccatttgaatactggtggaaatgccgggccctcatgctgaataggacactccatccaagcttgccgcctcctcggaggcttgggccagtcaccgggcccggctgtgctttcacagctgcttttcttatgggagagcaagatctcctgggattcaagaccctaccaggagtagaagacaagggtcatgggaaggctgtgtgagccctcaaggggcaccatggaccccgagcaccagcgatttgcgctcctggttccgagagcccagcgctgaatcctggcagatggggaagctgagctctgtctgacctgctctggaaaacaactggtccagagaaggacgaagatgtcacttaattctgagttgctgaggataagccaggggccctggaggtgactgtgctgcccacagcatcccaagggatgccacatccccacaggggcagcccaggtcccccagaggattgtgtgccccccaccaccaaggtccttgcccactggtctgtgcctcaataggacagcctccttctcacactattttgaaatataaaaataacactcatcacccatcacccagtcactcagaatcacaccagcgggggcacagaggcgacggcatgtagttctccagcctgtttgtgagcacgggtgtacatgtacacacacacacacacacacacacacaaatgcacatgcacggacacatgcacacacacatacacgtgcacacacagacatgcacacacacgtacacacatgcacacacacacacgtacgcacatgcggggtcagggagctgatgctgtgcgaggctgtcgagggcttcttcactcagcggcacttgggaagcgctgctctgtgggaggcccctcatccatgtcctcgttattggcagcacaaatctccaagtgaggaggggccatgtttaccagccgtccttccagcccacgtctcctacggttccttattttcacaggtactgttttgcagacacagagcccccaagcagcccacacgtcttagccgggtgaagctttgctttatgaagtgctgcctggacccctgatggtcggccctccccgtcgagacagtggcaggcaggcgggggtgctcagggctgtctgcagggggcagccaggacctcactgaggtggccgactgggtccacgccctcctcagcctgcactgctggacaggccccaagaagtcgtgctcggcgtggcccaagaacgggaagcggcagcgtcctggcgtcctaggtgagacttcaagacggctccctgctcccacctgggctaaaggtggaaccccaggtgtaaagagccccctggggtacaggggaggctggatcagcagacgccggctctgggagggccctgaggggctgtggagggaaggtgaccccgcagtggcagcggcagcggaagcaggacggcgcggtgcccgacacctgaggccactctccctggacggggggcgggcggcactgagaggcggccataaaaaccggagtttatttaataaaacaagagcccacgcggc

SEQ ID NO: 4595 - DNA, 2614 bp, Homo sapiens
atcacttctgctcacaactgcccagtcccagccagtcacatggccccatctggctacagagggtcaggatgtacaatcctgccatgtgcccagcatatggtgaacagcataatgacttccatactcatgtatctaaacggtccaggagaaacgtggtttcaggcatggctggatccgggatctcaagagctattaccatctctcagctctgctttcttgtgtgtttcttgctgcccctcccagtaccctccttacagcttagtaatcccagcagaaagagagcatggaccagctagggtacgttccagcagagcaaggtgaaaaagagctgaaagtggcatcagaagcccagagttctggttccagctccgaccactcattcagtgtgtgacctcaggcaggtcaccagcctgagctgtgccttcatttcatctgtcagacggatgactctgcccctcagagcttgcagacggcaaggtgataaggaacaatatggacttcttgcagctcctggaggcagacgctggagggctgggctccgcctcagtcacaggcaatgccctgatcccacaaagccccggagatgctgtggaccaacttgcaacacaagaccctaggagggaggacggctgttgtcatctgttgaccacaaacacgtttactgtgcacacttgtgcacatgggtgagctccgtgagtccagacatgcacagggcaggtgaatgcatggagtaccatgggcattatcccaggcccacaggcacgtgcaatcacacacacacgtggacatgccactgcgcacctaagacacacacacacacacacatgcatatgcacacacacacatatgcacacacacacacagacactgtaaacatcaggctcaaaggcccatccaggagaccaaaggctgcaggtgtcttcacatcacagcccaggtgaccttgtctctggctcagggcccagtggcctggccagctctggacatccagtcagcctcattagctggcctggggtccagggctcgaaagtggcggaggaatgaccacccactggcggaggtagctccgggggggtccttcgtccccggggctggtgaagtcacactccacagggctgctgcagtcagagcccacaaagccactgtcaaacgtgtccatatccaggccggccaggggtgagcccgcctcactctctgagacccctccaggtgaccggccaccccagggcagtcccccagcccagtcctccccatctgcaaggggtggctttagtctgtccaggaggcttcccaggggccctcctagcccagggctgccagctgagacacagccacaggacaggactgtggtccctgcatccaagagtgggtcctctaggcctgggctgggctccaggccagcatccaggtccagggctgggtagccgtcatcctcacagctgcagggccaggtgcatggcccctctgcatctagcacagtcactgtgtcaatggacaccaggccgtatggccgatccctctcctcactgtaagctgagccccccgagttctgggctgtcggccagaagctgggcttgggcacaccgtcagactccaccagctctgctggttcttgtagctccgtgagctgcagcctcttggccgggctccgtggtgggtggcagctgtacacctccagggtggagggcacctctgggctccagggtcccagctccaggctggagccagtgaagggtgcacccacccatttctgtgagagagaaaaagagagagtcatagcacaggatgagggtaaggtgagggtttatttttcttttacttttattcttttgagacagtctggctctgctgcccaggctggaatgcagtggtgccatctcggttcactgcaacctctgcctcccaggatcaagtgattctcctgcctcagcctcccaagtagctgggactacaggcgcctgtcaccacacccggctaatttttgtatttttagtagagacgtggtttcaccatgttggccagactgatcttgaactcctgacgtcaggtgatccacccgcctcagcctcccaaagtgttgggattacaggcgtgagtcactgtgcccagccaaggtgagggtttaaacagacagaaagacagacacagacacagagacaagacaaagagacatcaagagagacagacagagacatgaagatagacaaagacaccgagagacagagagagagagaggaatcaggaccacaatgtgctcccaccctagtggatccccctcctactctgggcctcagtttccctacttgtagaagggagttgctacccttagtagtgtgaccagtcagacaactggtggccccatagtccaggcagggaccaagattcctgagtcaaggagacatgggggcaggagggcctgaggtctgaggtacccctgagccatctcctgctttcccgcctccttgatgcttcttgaaacctagcactctcctggtttatgtgtccccaccagacagacacttggcccccggacataagtcttgtctcttctgtccatggctgtagccccagtgcctagcacaaagtaggtgctcaataaatgtttattaacgaa

SEQ ID NO: 4596 - DNA, 2612 bp, Homo sapiens
atcacttctgctcacaactgcccagtcccagccagtcacatggccccatctggctacagagggtcaggatgtacaatcctgccatgtgcccagcatatggtgaacagcataatgacttccatactcatgtatctaaacggtccaggagaaacgtggtttcaggcatggctggatccgggatctcaagagctattaccatctctcagctctgctttcttgtgtgtttcttgctgcccctcccagtaccctccttacagcttagtaatcccagcagaaagagagcatggaccagctagggtacgttccagcagagcaaggtgaaaaagagctgaaagtggcatcagaagcccagagttctggttccagctccgaccactcattcagtgtgtgacctcaggcaggtcaccagcctgagctgtgccttcatttcatctgtcagacggatgactctgcccctcagagcttgcagacggcaaggtgataaggaacaatatggacttcttgcagctcctggaggcagacgctggagggctgggctccgcctcagtcacaggcaatgccctgatcccacaaagccccggagatgctgtggaccaacttgcaacacaagaccctaggagggaggacggctgttgtcatctgttgaccacaaacacgtttactgtgcacacttgtgcacatgggtgagctccgtgagtccagacatgcacagggcaggtgaatgcatggagtaccatgggcattatcccaggcccacaggcacgtgcaatcacacacacacgtggacatgccactgcgcacctaagacacacacacacacacacatgcatatgcacacacacacatatgcacacacacacacagacactgtaaacatcaggctcaaaggcccatccaggagaccaaaggctgcaggtgtcttcacatcacagcccaggtgaccttgtctctggctcagggcccagtggcctggccagctctggacatccagtcagcctcattagctggcctggggtccagggctcgaaagtggcggaggaatgaccacccactggcggaggtagctccgggggggtccttcgtccccggggctggtgaagtcacactccacagggctgctgcagtcagagcccacaaagccactgtcaaacgtgtccatatccaggccggccaggggtgagcccgcctcactctctgagacccctccaggtgaccggccaccccagggcagtcccccagcccagtcctccccatctgcaaggggtggctttagtctgtccaggaggcttcccaggggccctcctagcccagggctgccagctgagacacagccacaggacaggactgtggtccctgcatccaagagtgggtcctctaggcctgggctgggctccaggccagcatccaggtccagggctgggtagccgtcatcctcacagctgcagggccaggtgcatggcccctctgcatctagcacagtcactgtgtcaatggacaccaggccgtatggccgatccctctcctcactgtaagctgagccccccgagttctgggctgtcggccagaagctgggcttgggcacaccgtcagactccaccagctctgctggttcttgtagctccgtgagctgcagcctcttggccgggctccgtggtgggtggcagctgtacacctccagggtggagggcacctctgggctccagggtcccagctccaggctggagccagtgaagggtgcacccacccatttctgtgagagagaaaaagagagagtcatagcacaggatgagggtaaggtgagggtttatttttcttttacttttattcttttgagacagtctggctctgctgcccaggctggaatgcagtggtgccatctcggttcactgcaacctctgcctcccaggatcaagtgattctcctgcctcagcctcccaagtagctgggactacaggcgcctgtcaccacacccggctaatttttgtatttttagtagagacgtggtttcaccatgttggccagactgatcttgaactcctgacgtcaggtgatccacccgcctcagcctcccaaagtgttgggattacaggcgtgagtcactgtgcccagccaaggtgagggtttaaacagacagaaagacagacacagacacagagacaagacaaagagacatcaagagagacagacagagacatgaagatagacaaagacaccgagagacagagagagagagaggaatcaggaccacaatgtgctcccaccctagtggatccccctcctactctgggcctcagtttccctacttgtagaagggagttgctacccttagtagtgtgaccagtcagacaactggtggccccatagtccaggcagggaccaagattcctgagtcaaggagacatgggggcaggagggcctgaggtctgaggtacccctgagccatctcctgctttcccgcctccttgatgcttcttgaaacctagcactctcctggtttatgtgtccccaccagacagacacttggcccccggacataagtcttgtctcttctgtccatggctgtagccccagtgcctagcacaaagtaggtgctcaataaatgtttattaacg

SEQ ID NO: 4597 - DNA, 1625 bp, Homo sapiens
ggagcacagggcgagctctcctccgccctgcagcctcaggtaaggatccggaccttcactgctgccccaactggggctcctcagctcggggcctctaggggcttgggctgctggtctgggtggaggcgcgttgggggtgtcgaggagcttgggtgcaagccccatgcgggaagctcagggcaaagcgccttgaaaccctctctagtgaaggaaggtaaaatggctccgggaccccaggcggggaaagaggtgtccaaggaggagggctggagagtaaggcggggatggcagagggtacgcagaggctgagaagtgggaccagtgtctcaaggggcgccagcctcttcctccgcccaacatggccaccatttttgttgggatagccttgggctcctgccaggggaacagcagggcagtgagggagtcaggactttgggctggtggggaggccgagaatcaaggctctggggagtcaggactttggggctggtggagtggctggggactgaggccctggggggtcaggaccttgggctgctatggaggctgggactgaggctctgggggagtcaggaccttgagctggtggggaggctgggaattgaggccctggtgtgttcaagaccttgggctggtggggaggccagggcctgaggccctggggggtcaggaccctgggctgttggggaggctggggacttaggccctggggggtcaggatcttgggctggtggggaggctgaagggtggggactgaggctctgggcagtcaggacctcacggttggggtggactggagaccaagaccttggcaggggagctgtggctgcctcatttggacgctggagggtggctagcgtggctggaagcggccagccaggggttcacagaactgaaggtgaggcctccagaggccctagtctctacctgagtgtctctgaaactggggggatggggtggagcctttagggggaagggaagagggaactgaagaggaagtgggggagggaggtagaggaggcaagtctggcgccatgctgagtcaccgcccacaaggcccagggcgggccctcggggggccctggcagggttggggggatcttaggaagccacaaggagggctggggggctcttggagcaggagtcaggaggcctgggcagcctgaagagtacacgccgacggacagacagacagtgcagtcacccataaagtagaaagcactactaacagcactggagggtgtagtgtttcctactttatggatgagtgtactgtgggcttcggagatcacgccactgctgccgcccgctgcccgccaccatcttcctcggcgctcggggacctcgtgtgacaggtgagcaccttacggcccctccctaccctgcccagatgcctgaaaggcctccatggctttcctgcccttcctggttccggacagctggggaaaggccacagcagctcctctgctgccctgcagtctttgggggcggggagggctggacatgtggaaccctgatgcagccgcagcgtcaaggacgaggaaggggtgggaagggatggtacgtggaggggaatgggtggtgggaccagggacccaatgctaataaagactggactgtgcttc

SEQ ID NO: 4598 - DNA, 630 bp, Homo sapiens
tgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgc

SEQ ID NO: 4599 - DNA, 22074 bp, Homo sapiens
ctcgccgggtcgctcgtgggctctgccggcgccgcggcgtcctggctcccgctgggtggggcttcctgggcggaggccgccgcccctgggcggtgccggatccagtccgcttgaccttattccctagctgctgtctccggccccctgaacccgtacagggttggggaagtgggggtggctggaggaagcgcgcgcggggcaagccagtggggctgaggaggctcccgggcccggccccgcccagtctccgccccagccaggcccgacccgccctccgaatgtcttacagctgcccgccccagagtaaggcccggtcggttcccgcgcgctcccagctccgtgcccgcgagcgacgactggaagggctgtccttgctcagcggcttttggtgatctctccgccctagaagagggccacctaaaagcgggtgcgagaggagagtgggagggcctcctcttggtgtccccaggccacctcagcccggagaggtggcggaaaaccagacttgatgctttaacacgttcatagcaatcgctttttactgaaaggagtttctgtatttagcgctgtgtaattctgtggaaacgtgcatttcttgtctttgcgggagagctgttctctgtgggcggagaccttcagtcccacccctccccaggaggcgcctgcggacccttcccaacctgcagtcaagttgaccaagaactgactgcaaggtgctggtggctctgggatgagagccttttggtacttacagggaatatgactcttcccttagatatcaaatggacccaatatctagggagcagcttcttctccatccatctgaccgttccgttgtgagaatgctggcccaataacatactctttttttttcccctaaaggaataaaaaaatctgtatttttaagatgtcaaatctccagagtttttagatgttagcaactgaatcagatgtttttaaacttcatgagctgattaaaccacacagatgagctgtcagtttacgacccctggcttggcttggaggaaagagtgaagagaaattccatggccaaatcctggggcactccaatattgggagggtaatggagaaggagtctgaaaggcagcatctaggaagtcatgaaagctagcgctgagttgtggaatccctgggcagagaaggtttcaggtaggaggcatcagctgagcggtgtgataaacttgggccagagatgtggctattggattgggtcaccttgcaagtcactggagaatgtcactgatggccttggcttgattcacgtgagtatatcagggaggtggacctgaccggaatgggttaaacagtcaccaggaaagtgaggaaatggagacagcacatgtatgcaatttgagagaggttttgctgtgaagggaccagataagtttggggatagatatagaaagaaatcttttaaaagatagtaggggccgggcgcagtggctcacgcctgttatcctagcactttgggaggccaaggcaggtggatcacctgaggtcaggagttcgagaccagcctggccaatatggtgaaacccggtctctactaaaaatacaaaaattagttgggcatggtatcgcgcgcctgtaatccaagctactggggaggctgaggcaggagaattgcttgaacccgggaggcagaggttgcagagagccaagattgggccacagcactccagcctgggcaacaaagcgggactccatctcaaaaaataataataaataaaataaaagatggtagggttcccagagcatgtttatgtgccattgggagggatatggtggggaagaaagatgggtgatccaggagagaggaggcttgcttgacctatataggagtgaaatccatcagaagatataaggaaacagggagggttgaccttggagaggaacagggatgcttccattcatgataagggcaacaaaggtgaagacagatgcaagtgcaggggagagggaaggcaagtccttaacaggattgccttggtggcattgggtactcatctgaggtttgtgatcatgatgttaaaggtaaaccagttggcccagtgtgttggtttttctccaacattcagctgcttgggtacagacatgaagaaaagggatagtacagcttctcaacaccaggacccaatttttctcatttcttttttttttttttgagacggagttttgctcttatcgcccaggctggagtgcaatggtgtgatctcagctcaccacaacctctgcctcctgggttcaagcgattctcctgcctcaacctcctgagtagctgggattacaggcatgcgctaccacccccgactaattttgtatttttagtagagatggggtttctccatgttggtcaggctggtcttgaactcccaacctcaggtgatccgcccgcctcggcctcccaaagtgctgggattacaggagcgactcaccgcgcccggcaagttttctcatgtctaatcccagttacttaccttatacaattagatactattttagaaatgtgtgaagtatttgaaaaatttacacgtgacccttctttttctagaaaccaagttatcccatttgcctcttatgtacacattaggactcagacataaagaaaagacaaactcagaggaaaattaccaaacagatgcttctggaatatttgcattttgcattctcctcagcccaaatagttcctggtatacttaagaacttatgtactagaaacaacaaagctgacatgcacatagggagaccttgtttatacaaaaaatttaaaaattagctgagtgtggtggcgtatgactgtagtcccagctacttgggaggctgaggtgggaagatcgcttgagcccaggaggtcgagactacagggagccatgtgtgtgccactgtactccagcctgggtgatgaagcaagaccctgtctcaaaaaaataaaaaataggccaggcacagtggctcatgcctgtaatcccagcactttgggaggccaaggtaggtggattacttgagcccaggagtttgagactagcctgggtaacatggcaaaagcccatctctacaaaaaattagctgaacatggtggtgtgtacctgtagtcccagatacttgggaggctgaggcaggagcatcacttgagcccaggaggttgaagctgcagtgaaccccgattgcaccactacattccagcctgagtgacagagcaagacattgtctcaaaaataaaaaaaaaattaaaagctgacttgcatttaaactttagattttctttctagtaacattaataagctaattagttcactttctcaagattttacttcaaatcaccttcctttttttttgttttttgttttctttttgtggagatgaggtctcactgtgttgcccaggctggtctcaggctccagcaattctcctgtcttggccttccaaagtgctgggatgtaagccaccacacctgtccccatcttctttaagagtagactacaggaacaccttctaaagcttttatgtaggcaaatatgaagcagtggatttatttttttattttattttatttttagatgtaatctcactctgtcgcccaggctggaatgcagtggctcgatctcagctcgctgcaacttctgcttcctgggttcaagcaattctcctgcctcagcctcccgagtagctgggactacaggtgtgcactaccactcctggctaattttttgtatttttagtggagacggggttttgccatgttggccaggctggtcttgaactcctgatctcaggagatccgcccacctcagcctcccaaagtcttgggattacagatgtaagccaccacacccagcctgaggcagtggatttagagggaaaaaagcctcaattatatttatgattatatttacaactatatattaattatatttataactctatgatctctgaggcatcaaaagccaggaatggggtccaagtggccttgaagcctgctttctgaagacaaggaccctatgtactgctctcacatagggctgagaaaatgcgaaggatcactaaggaaggaagaaaagaaaatattttctggctgggcgtagtggctcacacctgtaatcccagcactgtgggaggccgaggcaggcggattacctgaggtcaggagtttgagatcagcctggccaacatggtgaaacctcatctctactgaaaatataaaaattagccaggcgtggtggcacacctgtaatcccagctactcgggaggctgaggcaggagaattgcttgaacctgggaggtggaggttgcagtgagccgagattgcgccactgcacaccagcctgggcgacagagcgagacttcatctcaaaaataaataaacaaacaaaatattttcttgtctttatggtaaatcttgatgtgtcctactttatggagtcagctccaaagatgaaggaacagaaggccaaacaaaaggaatagaatgtttgaggctggaaagaaacaagctgagggaaaatatgatgacaggctgtgaaacagttgaggtgataaaaataaggctaggctgggcacggtggctcatgcctgtaatcccagcactttcagaggccgaggtgggcggatcactaggtcaagagattgagaccatcctggccaacatggtgaaatcccgtctctactgaaaatacagaaattagctgggtgtggtggcgtgtgcctgtaatcccagctactcaggaggctgaggcaggagaatcgcttgaacctgggaggcggaggttgcagtgagcagagatcgcaccactccactccagcctggcgacagagtgagactctgtctcaaaaaaaaaaaaaaaaaagatctggccttgagcctcacgtacaggaccagaaacccaatgtggtttgtaccctaagagcagattccttcctcggggatttgtcaggctcacaggcgcttgctagataagcagagtgctgttaacaacgggcaagtggaccagtgtcctcgtgctggcaaaaggcatattgatcccctataggagagcattcggggaagccaaattactagaaatatttgatgagcagttaattagattaactagtgttagttatgtaacttaaatgtttaatgtcaccctctctggatgctagaattagattgttcgggattcaagtctagtcttggttttttattagccgtgtggtctctgttgaattcgtaacaactcaactatagatttctcttctataaaatgggatgataggttgggcgtggtggctcatgcctgtaatcacagcactttgggaggccaaggcaggtggatcacctatggtcaggagttcaagaccaaaaatacaaaaattagccaggtacgatagtgggtgcctgtaatcccagctactcaggaggctgaggcgggagaactgcttgaatctggaaggcaggggttgcagtgagccgagatcgcgccactgcactccagcctgggtgacagaggagactctgtctcaaaaaaataaataaataaaatgggatgatcattgtgcttgatacagccataaggattagacaagaaataaagcagcttttttttttttttttttttttgagacagggtcgcattgtccactgttgcccaggctggggtgtggagtgcagtggcgaactctgctcactgcaacctttgcctcagcattctgagttgctgggactataggcgagtgccaacacacctggctaaggttttttgttttttgtagagatgggggtcttactatgttgcccaggctggtctcgaactcctggtgtgaagcaatcctcctacctcagcctcccaaagtgctgggattacaggcatgagccactgcacccagccagaaatcattatcctatgattctcaggagaacagttgtatttccaagatcttccttggctcctattgttacccctgtaaagcttgcaataattatgatcatttacatgttttttaaaaactctttaatcaagataatcaacaaacgaaggggagacatattgattttctaagacataatgagcagggaatcttcctgccctccttggggtaaggcctaaagttacatgtgaacactctggttttctctatacctgttgagaacatgtgtgagacatgatgcagctcatcaagtaattattgaatacttggtgtgtgtagcttcctgttctaggcactggagattcaaagatgactcacgatgtgtttcctgcccttggactcaaaatttaactagtaaaactggttaaaacaaacacacaaaaaattaatgcaataactgttatagtggaaagaaatgagctcacagctaaaggagtaaatcactccaggagtatctcatttcagctgggtctaaaggattagcaaagcattaacaagtgacacgaagacatgtaaggtgaagagccatgatcaaaggcataaaagtctacaagagtatttgggggacagcgagtcatcttacaccattggatgagggtgtagagtagtgatgctaaacctttaaagacatttggaaagctttcattgtctgccaacatcaactgccaagcctaaccacttctaacatttaaattttttttttccccaagatggagtcttgctctgttgcccagcctggagtgcagtggtgcaatcttggctcattgcaacctctgcctcccaggtttaagcaattctcctgcctgaacctcccaaattgctgggattacagacacgcaccaccatgcccagctaatttttgtatttttagtagagatgggtttcaccatgttggccaggctggtctcaatctcctgacctcacgatctgcctgcctcggcctcccaaagtgctgggattacaggcatgagccaccaagcccggcctattctaacattttaaagactcatccttccatatcatctcctgcctagactgtaggagtttttttccttattaatgtctgctttcttcagacccctgtgaaagccttatttatttatttatttatttatttatttatttatttatttatttattttgagacggagttttgctcttgttgcccaggctggagtacaatggcatgattttggctcaccacaacctccacctcccgggttcaagcaattctcccgcctcagcctcccaagtagctgggattacaggcatgcgccaccatgcccggctaattttgtatttttagtagagacggggtttctccatgttagtcaggctgatctggaattcccaacctcatgtgatctgcccacctcagcctcccaaagagctgggattacagtcgtgagccaccacgccggcctatttatttatttatttattttgaggtggagtctcgctgtgtcgctcaggctggagtgcagtggcgagatctcgactcactgcagcttccgcctcccagattcaagcaattctcctgcctcagcctcctgagtagctgggactacaggtatgtgccaccatgcccagctaatgtttttgtatttttagtagagatggggtttcaccctgttagccaggatggtctcgatctcctgaccttgtgatctgcccgcctcagcctcccaaagtgctggggttaccccggccagccatatttattttttacctctcagctcaaatgactgctcttaaaggtataaaggactgttgctaaacctatatccaatgttttagaagttgattttgttttctgtgctgttacttacttttccaaacatgcatggatcaccctttataatccatctctatatttttcattttgcaaaacaccttcatgtctgccttttcaagtgatgctcacagctctatttgatcagccaggcagttttgtcctaaattcagaaatgaagtgacttgctcagggttgtccggcaacttgttggcaaaatcagaatgagtacagtagtctcccccttgttcacagcttcactttctgctattttctgctattggttacacatggtcaactgcagtctgaaaatactaaatggaaacttccagaaatcatgtttcgaattgcacaccattctgagtagagtggtgaaatctcacaacatcctgctgcatactgcctggaatgtgactcgttccattgtccagcatacccatgctgtatatactacccacctattagccacttagtagccatctcagttatcagattgataacacatactatatataggattcaggactatccttgatttcagacatccaccagagagcttggaacatatcccccataaaaaatgggggactgtaggcttggtgtgatggcaatcacggcctataatcccagcactttgggaggctaaggtgggtggatcacgaggtcaggagttcgagaccagcctgaccaacatggtgaaaccccgtctctactaaaaatacaaaaattagctggttgtggtggtgtgtgcctgtcatcccatctactcagcaggctgaggcaggggaatcacttgaacctgggaggtagaggttgcagtgagccaagattgcaccactgcactccagcctgggcgacagagcgagactctgtctcaggaaaaaaaaaaaaaaaaaagatgggatctcactctgtcacccaggctgaagtgcaatggcgtaatcatagctcactgcagcctttaactcctgggctcaagcaatcctcctgagtcgctaggactacaggcacatgccaccatgtctggctaattaaaaaaaaaagaattatttatagagacagggtctcactatgttgcccaggctgggaagggctttaattgtggaaacttcaggctctcaggcagacagcagaggtatttaggtgatgacttattaatctacaagtatgtcctgaataactgcttaggacccaggtctatgttcaaggttaggtactaccagagatagatagaggatgtccctagccctcgagtgccttctatttcgttttatattagtgtggaaatatcagactaaaccttgagtattagaaggtaaaagtcaaggatgaaaagggaagtgtaaaggtataggctacaggtgtggaaggaatggagcggagcagtcactggacatcacagtagtcatatgaaaccgcatgctaaagcgagcatgactttcaagcctctgcttctagcctttacccactctggcccaggctactcttgcttcttttttttttttttttttgagatggggtctcactctgttgcccaggctatcaggcagtggtgcagtcacagctcacgcagccctaacctcccaggctcaagttatcctcctgcttcagcctcctcagtagctgatgctacaggtgcacaccaccgtgcccagctaatttttgtattttttgtagagatggggttttgccatgttgcctaggctggtctcaaactcctgagctcaagcaatccacctgcttcagcctcccaaagtgctgggattataagcgtgagccaccaggcccagactcttgcttcttctaatgtaactgcaggctcctccctgcttccggcctcctccctctcacagctgccagagtgaccttcccaaagcacacacgtgatcacaaaacccccctgcttcaagcccactggtggctccccggtaccctgggataaattccaaactcagccactccacaaggcctcccatgctcaccaagcccctgctcaccccctcagcctcatctctaactgccccctctggcccctggggattcagcttgcttgcttcctccaccagtctgacctcagtcctccctccctctgttgtcccctcctcaggcttctgttccattccttaattgggatcctggtggtgaaagtgcattctaaagcgctatgccccatgggggggactagggagagtgtttgagtttccaggcttcttccacactgaacatatggtactttcacactcaaagtgcttttcaggttgcttttgacataagacaaggccatcagttggggaggtgtatgtaagggaaaccagagctagagacaggttttagaggtattcatcagaagatatttctggaccacttactgtgtatctggccttgggtgctgggcatagcaaaggcagatgcagcctgaacaaatagagaattggctggccctacgccagatttgctgaattggaatctccagggaagttctcaggtgaatcttagaactgggtaagttggaaagccctaacctgatttcatttgtaagacatatccaggataggcaaatctgtagagacagaaagtagattagtggttgcctgggggtagggtggagaatatggaagcgcagggatgacagctaaggggtgcagggtttctttttgggttgatgaaaatgttctaaaattgtggtgatggctgtgcaactctgaatatactaaaagccattgaattgtacactttaagtatttatttatttttttgagatggagtctcactcttcacctaggttggagtgcagtggcatgatctaactcaccgcaacctccacctcccgggttcaagagattcttctgcctcagcctcccaagtagctgggattagaagcatccactaccatgcccagctaatttttgtattttttaagtagagacaacatggggtttcaccatgttggccaggctggtctggaactcctgacctcaggtagtccacctgccttggcctccaaaagtgctgggattataggcatgagccactgcgcctggccaaattgtacactttaaatggttgaattgcatggtaggtgcgctaaatctcaaaaagagctgtttaaaaaaaataaaaaggctgggtgtgatgcctcatacctgtgatcccagcactttagaaggccaaggtgggaggatcacttgaggccagcctgggcgacatagtgagaccacctctttagcagggcatagtggtgtgtgcctatagtcccagctacttggtaggctgaggtaggaggatcccttgagcccaggagttcaaggttacggtgagctatgatcataccactgcactccagccaggacaacagagcaagaccctgtcccaaaaacaaaacaaaacacttggaccaagttctagagggaaggcacccacctcagacctgggtggttacccagtaaaattgtcagcatatattatgaatgtatgttccagagggtacaaagtaaataagcaattgcaggccaggtgcggtggctcacgcctgtcatcccgcactttgggcggccagggtgggtggatcacctgaggtaaggagtttgagaccagcctgaccaacatggagaaacgccgtctctactaaaaatacaaaattagccgggtgtggtggcacatgcctgtaatcccagctactcgggaggctgaggcaggacaatcgcttgaacccaggaggcagaggttgtggtgagctgagatcacgccattgcactccagcctgggcaacaagagtgaaactctatctcaaaaaataaataaataaataaaataagcaattgcaatgaagtgtgattagtcttatagaagggaaagcgcaggctcctgtgacaagagcaggtgggcatgcagcttgctaaagaaatatatgggccaggtgccgtggctcacacctgtaatcccagcagtttgggaggctgaggcgggtgggtcacttggggttaggagttagagaccagcctggccaacaaggtgaaacctcgtctctactaaaaatacaaaaattagctggttgtggtggcgggcatctgtaatcccagcaactccagaggctgaggcacaagaattgcttgaacccgggaggcagaagttacagtgagccgagattgcgccactgcactcagcctgggcagcagcgcaagactccatatcaaaaaaatatatatttagggcatttaattgggaggattctgatggctgggatgtgggtacagaggaaagagtaaggatgaggctctgttatatggcttgggtacctgggaaattggtaacccctagagctgttggaggagaaacaagttttgagaagatgttgagtctgattttgagcatgttgagtttgaaatgccccagatgttcaaaaggaagtgtccagtgagcagctggatgtgggggtctggaagcaagcttggaatacatgaggaagaagagtgggagacaggaggaaaggtaaggttgggagagggcaagaggaaaggaggagagtagagggaacactccatcgattgccagcacaataaactgtatcatggactacttcagcctggcccctgctttgcagtgtgcgtggagcagtttcctctgggcagagtctcagagatgatggccaaggcgactgtggcctcaatggacttaactgatagggcacttctcagtgtgtcacaggccttggaggcccacttccatctgtcccctcagaggctgggcagacgctttccctgccctgatacctttgactcatgatggtatcgtcaactgcccatcacctgaggcaaggggctcccaactgtcctcagtcccaaacagcaggaacacctgcctccctgacccacatgacagcagggtagggggtgggagaatgctatgggcaggtttgccctgtgggaggcccctgtgaggcagagggggtcaggagagatacagaggtgggaggacaagggttctctctgcccctccaccatctcaggaacctgggcatgggcctgggtgtaggaggccatccagcctgccttcaagccactgatggagagaggctgactggctgtcctggggttgattcatgctgctctgagccagataggcatcatgtgcttcacctggctgtgctcacagtgccctcattccagctcctgtccccttccgatcctcacacccacccctggctagagctgaatactaggctctggcctcaggactctgcagagcacagagtctagggtctgtcccttcccagcattggagagcagggattcttagtgacaacgccagtggaccccttggctgggatgatgacatttttccatcctccatttcttgcccaagccctgctctctcctgtgtactgagctgtgagctcatgcaggctcagtcacccccatctgcactttcccaggacctggtcaaccagtgttcacttcctcttcccccaccatgacaggctatgcttttgatgcaggtggatagccctgctctaccaatgggcctcttgtgggggcctcaggactgagggctgctaggggcggttctgggattgccggcctcctccagggacccctggggcaggccccagctgtggccagccttgggtgctggcctggtctccatcatttgtttgcctcctctgccccatgctgctccagctcaccaccccaaatactgagctgcaccatcccgtgccacccttcgttacccagagagcaaagagccgcgccagtgtgcagagggctgcctgcctgcccctgcccaccctcgccccagcgtctggaatgagccacttgcatccacacaggtgcttcctgtgcttcttcctgttgccgttttttctgctcagcttggcttccccagcaggtggttaaagccccagccaaacctcttcatacctagctctaaaacactggggggcagggctccctggggatctgggtcaccctccagaggactgttggcacttcactggctcttcctgagggcaggctccccaacgtgacacgtcctgcacaggccaagctgctgccacaggtactgggacatcagagtggcctcaatgagtcagggaagtgctgcgtatgcaccacctccttgcccctggatactggaagtgctgagggagaggggaagggtggagagcctgtttctctagccacgggtgtgggcctccctcagcccctccttagaacaggcctgccatcctgaagtcccaccccacactccagttcctcacgcaggactcagccttctggggttaacacattcactggccaggcagctctggggcaaggcgaggcggggcaaaggcaagccctctcctgggatctctgcttcctgaagcagcacaggttggccggctgttggggatcacagagttcaggcacgtttgttattatagagggggagacagctggagagggaagggacttgctgtcttgggtcacaggttagccatccaggtctcctgcctcccaggtcccagctcttcccctccgcaaggagctcctctcccctgccatccagcttcaaggagctccttcagccccctctgcagaaagctgcccaggctgcagaagacccaaacctggcatctgctgacgcggatctgctgccccctggtgggcagaagctccagccaccccgtgcctcctttcccttcctgtttttcctttcccttcccctttgctcccaggccacagcctgggattggcaccctttggtgttttctgggccaactccagtttagctccaccttgggccgtagttcccaggcccagggtaggccccacctgcaggctgaaccacccttttcccctgctctcttctccaagcccagttccagcctctgggctttcttccacctgaatttccagggcaagtgcacatggcactgtcacagctgcagtgtgaacacaccagtgtcaggcagggccacagccagagggtgttggagcagagggtcaggagtgtaccaggccatgtaggaaagacattttgcttttttattttctgtaaaactctgtaaataaaatacaaaaccaagggatgtggctgggcagcggcagggtggccaagccccagacactgatttgtggcaagggatgtgctgagccgaggctgggaggcacttgactgcaggcactgactctccaaccccaggggcaacagaagaatatattagattttcattgctaggaatctgtgggggaggggtatctggagccagcccttaccctccctgccagtgcctggtgagccctgaaagtggggggaaaggggcaccaggaacccatgggtgaatagtttagaatgctgtgctggccatgctgccaggcccaaagatgcggggcagggcgtccagggactcctccagccgtcgatgggcagactgtccctcttctcctgtaatgagtgaggatgaggtcaagggtggccctagccccatcccactctcccacccctggcgccatctctcctactcccatcagccaagatgtcccagaactccacccatctcttccatcccccagcctcaccacactgctgtaggctttgccgggcagcttccctcacagcttctgtgtcagtttggcagaggtacaccaggggctcaatgccctcgggagcctgtcaggggagggagcattgaggtgggctcaggggagcagatgggagggtttcaggggtgggggtgccggaagcggacagaggggtgggagggttggcaggggtcaccttgatgcagcctagggccaggcagccagccactcgagtctgcacgtcctcatcctccagctggtccaggaagcacaggagggcctgtggaagggtgggaggacagacttagccagacagtgggagtccaggaccccagccctcgccctcaagggagccctgtccaactcaccctctcccggaaggtagggcccagtgacaggctccggagctgggtgctgacagcagccatgaccttgttgttgccatggacgagcagggagctgagggcccgcagcccgtcccttcgcagacgcccctcgggcgccaatctcagggccttcagcacaacagcctgatcatccgagttcagattccgcaccagtagcactgaaaaaaggggatatggtgggtgggtgggcaaggtggcagggtgaggagcccccgaggttggggagggcttgtcctcatgtcctcagaccccaagaggccactatgtgatcagggccaccgcctcaccctcctcagcggtctcagtcacgtaggcctccatggtggggctgtccaaggtttccacaaaactccagaactggaagactgtgagctgctctccaggccctggctggggccttctgggcagcttctgccccagggcatcctccaggaacttcacacacactgcaggaggcagtagcatgggcctcagagtttgggtgaacacagcttttagaggggagagatgctcctatcccaggctcaggtccaggggccccctgttcaaaccccacccatctgggtccttctgctctaaggcccaagtctttgctggtctcctcggtgcccagttcgtttatctgtgtgggctgacctggcttccccgagcttcctgtcactgggaatctgagcaagggtggaaggaggaagcagcccactcaccagcctcagccaagcctggctggcgcagggagaggcgggcaccatactggttgcagaaggtgagaagcacccgctccaccgggcagaggaagcagctgagtctctctgtgcactggtcccagaaggtcaggaagccaggccgagaggccgagaactgcaccactgtgagggggtgagggaaaccgtcagcaacaggcaggcaggtgagtagagagcatgcagatggcagtaggctgaggtaggagcttcaaggcagatggcagagcccgaacccccagggcctttaccttcctgggcagagctggccgggatctcccaccgcctgctgaactcgcatactgcctccagtactcgggcttcccgcagcagccgctccagggcccatgcctcctggcagcgcaggggcccaaatgtgcccagtttctggagaacatgggtggccaagtagctcaggcctcagggtagggctcgggaggatcgtgctcagggacaagtcccagcatgcactgggggaggttggggttgcagagttgggagatactccattcagcaagggccagatgccaagggccctggggcactggggtgtggcactcagaggaggtatagaggaccaggatggaagggcaggactccctggggttaggggttacaaaggaagggtgggggaacaccatcagcctcaccagcaggaggcgactgcagtggtacaggtgccggaccaaggcagcatccagagctggacaccccgtgctgagggggcgggcactgggtgagtctatgctgtcctcagccccagcctccgggctgcttggaggcctgagggaaaaatggggtccaccaccccacaggcacacatcaccacctggtcaccagcgtttatttttattaagcttcccccatgccagaaaggaagaagatgatgcaccgacagcagacagtggggtaagttcatggaggatttccagaaggaggaaggggctgggaccagcaggtggtagtagggatctctggagtcagtctgcgccatgctacctccagctgggaccactggggatggcatgggtaggagtaggctgcaggcgggatggtttatgacaagtggactgcaaagggtgcagggcatggggctgtagcctgggcagcagcagaggaaggagggacctggcacaactctcaactgggaaccagcaaaggccactccaggactgacagttgaggggccagggcctctgggagagtcggggttgagaaggagtggggcagtgctggggtcccagggtgcacggcgagacactgagagagctccttaaagggcaggtccaaggtgaggccaaggggaagaggaggggctggaggcacccaagctgatggggaccggcaggggaggcagacattgcagagatgaagagggcggtcagaagcactggggacacacgtagggttggagacatgggcatgaaggacatgggaggggtggacacaggtgcacctgccagcaactcagtcctcacatgctccacctggccctgcctcacctgtcctgtcctttgactttctcccaattcacctgttccaccttcccctggtcctgcctcaccttttccctctcacctagcctcacacccatcttgcctagccccctcacctgtccccaggaacatcattgtcttcatcttcgtcttcattgaggaagctgaagctctccaaggcatgctccacagtgatgctgagactggaggcccggctgcgagtcagaccttgtctctgctgaggttgtgaagggcatcagagcggctgccgccccctggctgccctccctggttgccctagcccagcccagccctcctcaccatgagcagactttctaggcgggtcacctcctgctccaggccctgcagctcaggaaactggccacggtagtcatccagggcagccattagggcccccagtgcctcctccaggctcctgtccccagaccctccggctgccgttgggactggggtctggacagccatggccaggcaaaggtctgaatgctggggtgcaggggttgggggtgagggagtggggcttagactctgaaccgtagactctgagggatctggggcagggcttgtgaggggtttcctactggaatgggcaggacttgggtggggagttctgggggccatagggtctgcctgagtgtaggaattggagactgggggactacagggaagggagtcagtgcctgggagggtggggtctgagtgtttggaggggctggagagggtagcaagttctagagaagtggaagggcttacatttataaggatggggcttgtggtgggatgggtggggcttgtggtaggatgggtgggacttgtggcagtctggactaggcccataccactgggggtaggacttgtagtggtgggaggtgacatactggttttgtgggtgggacttgtgggggtatgggtggggcttgtggaagtatgagtggggcttgctgtggtatgggtagggcttggcatagtgtgggtggggcttgtggtagtctggactgggcctatgatattgagggtagggcctgtagtagtaagggtagagattatgggcttgtgggtggagcctgtagtagtgtgagtgagggggcttggagcactgtgggtagtggtaatggcactataggtagagcctgtagtggtgtgagtggggcctggcagttctgaagggccagagtctgtggacttatgaactgagtctaggtgtgcagatggggcagggtctgtagatgtggggacagagcctgttgtaccgagggtagagcttgtggcagagtggccagggtccagggcaggaggaacaggactggggtgctctccatgggtgggagctgggtgtgtaggtgggctaggtccccaggctaggctttctgggccaacggcctccactgaagcctcagccaaggcagcatctacactagcctcactgatgtggctcagagtccgactgtagggtgcatgcccatttgccaggactggggccacggccccctcctcatccaagggcccagagctgggggtctcaggcctgcggaaggcaacttggatgggaaggggctcgggctgctgcaccaggggcctaggggctggtgagtggcgggcagtgcctgagagctgtgggctggatgagtcgtctgaagattcagatgacagggaccatgctgtcccattctccagctcctcctgccgtcgcagcatgttctgagaaagaggagagggcatttcagaaccacccccagggagcctctgggggatggtgaggcctggacctgggctatgactcacatagaaagcctgttcccgaagtgagggtgtgtccggtgggctctggctataggtggagaagcgcttggtgactgtggaggccttgttgacagaagaagcagctgagggctggtcatccttgtcgaaggggctgggaagggaagaggctgttggcaggtgccacagccctcctggccctcctccaagcctctcagccccaccaacctccatgtgacttccaggctgagcttgatggtaccaaggtcattgatatccacagccacaacctggggcagggcggcaaacaggtccttggtctcacaggagacactgcccacaaccacatggttggccaggcccttcagttctgtcacctgtagccaagagtgcatggtagggtcacaagggtgcaggggctatgagatcatgggaaatctgaggtctgaatttgcatagaacttataaaatggtcatgggaggctgaggcaggaggatcacttaaggccaggagttcaagaccagcttgggcaacatggcaagactctgtctcaaaaaaaaaaaaaaaaaaaatttttagccaggcatggtggtgcacctgtagtcccagctacttgggaggctgaagtgggaggatgggttgagcccaggagtttgagactgcagtgaggtatgattgcactgctgcactccaacctgggtgacagagtgagacccgccaactcctagatagatagacagacacatgcatgctcatggagccatggatgcttgaagcagcctgggagcatgggaatcacagaggtctgcatggtagggtcactgaggtcatagaggtcacagcctcatgggagcttaggaggtcaaatattcacagggtcagaagatcatgaggaggtcacagggtcaggaagccatgatgtcctaagagtcacaaagattgttcctctcagggccacagagatcatgaaggtcatggaatcatatcttcacagggctatggagctatgaggggatcacaggagtaagggactcagggtaatgggggtcacaaggggttcacagggccatggtggcctgccgtcctgggcagagacatcaccttaatagacagaaattccgtgagtagagggagaaagatggtttcttcactgtcccacacctgctttccactaccctcaattcggccccgtagtttccagcgctgacgcccatatttcatgcagatctgggggaacaggtaggatgaggcagcctaggtgttgggaccctaccgacccagcccttccctgcacattctcatacctcatactgatcgcctacacacagcctggcgaagccagccagccctgagttggaggagaaggggagaagtcggtgagccatattggggttcttcagcatactccctccagccccccacctgcccccacaactcagtacctttcattcggagatgaaactcgcccagctgtgcctccagctcgctctccagcagacacatgctctgggagggaggggcagggacaggagggggtcaagggccagccactagccctgccacaccctgtgcctctgcctcatgggcccccatccctcacctccgtgtactcgcgatgcccccgagtggcctctgccaggctgtcccgggcctctcggcttcccggggacccagtggtgtaggcacggaccatgttgtaggcaccatcccggagacgccgctggacacagtatgcctcatacagctcatcgatctgggaaggtgagtggggtgacagtagggggactgagactcacctctggggttactcacctctaaggttgctcacccagggcctggcaccacccctcttctccctatgatatccaaccccccaccccactctgcacacatgctgcactcgtaccttgctggcatggaactccagtcgtcgcaggaagcgttcaatggacttgacttgctgggggagaggtgggtcaggaggggcctgaggcccagggtccttaccctccctgtgagccaaccccttccagtaccattccatgcatactcaccttgtccagatcatacaggaagccctgcaggggtggggagaaggggcaaatatttaggagggatgaggaggactccagcagaggcactcagactcgtcacagctcccctttctcacaccacagtccacaagcactcctgtcacagtagcaactgacgccccttcctgctggtctagcccttggtggatgctggtagcacagatctggtcccttcagccccctccaggacccctccttccacctcttccctgggattccttttcctgcagccgcctggggagagctctctgcttccttgtgcaaggttccctctg

SEQ ID NO: 4600 - DNA, 729 bp, Homo sapiens
gagaggtccagggctcgctgctgggagccaagcctgttctccgctcggcaggtgtagcgccctgaatccccagccttcaccccgggcagctccagccccaggggtctagggccccagggatgggacgaggagaggactctgttctgcaggacccagctcagtgtggcagggggctggctgtcagcagcacagaggagccgcaggaactggcctttttgggcttccagggctgcggcggcatcctgggaccccacagcttcctctccctggatgctcctgagctgggagccgctcactgtcccactgggctcctccacctccccacccaccggggctgtctgcacaccccaccctcccaggccacactcacaggccacacggagtcggacggtcctctgtgcgctcacaccctttctggagaagtccacatggcagcttcctctctccacccgaaagaagtactgtgactcatcctgcatctgcgcgtctctgatcaccaaggagcagttccccttggcgggatccccagtgagctggaatcggccccgggtgctcatttccacctctcgactctggtggtttgtggccacaggagcacccttggttgtctcagtcactgctttgaaccagtagccataagctggggtagaccctgtccagtcctgtcgggggtaggagaaagagcagggcacagagatgcacaggccctccggcaccatcactgactcc

SEQ ID NO: 4601 - DNA, 4904 bp, Homo sapiens
gtgtcacaggccgcgcgctttttccgggtactagaacacagtcccgcttacagggcctcagcctaaagcgggtggaaaacttgtatcacccccctacacacacacacacacacacacacacacacacacacacacacacacagcccagtcctaccaccaggcgcgaccgtcccctccctctccagacggaaggggccaggttaacgcagccgcgcgcccgccgggcaggttaggttctcgggggcctagaagggaaaggggttaactaatgtgtgcgatgcgtgtgcagatgacaaaatttagggcacgtagagtttgcccggccccaccgcgtccgctcgcggggaccctcgggggccgggccccatggggccggggcagcacggtgtagcccctcctccggccgggcgcgagcgtctgcagaacaaagcctggagtccagccccggccccggcgcggccgcccctcaaccaacccccaggcggcaaggccctctccacgcgcgctctccagcctggcggggccctggaagccgggacacgcggaggccgggagggtcatcggcgtttaaggcagcctcccacaccaagtgcaccgcccggatcccctctgcacgagggctttctgcttattgctcttttccccagcagccagaatcgtcaccgtagcgcgggaaggggcctcgcgggccgtctgcagcaggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcagttgggtatttttttagctagataatttaaacgcgaataattcaagtctgactaaatgaaagtcacataatcagaatgcaaataattgaatttctactgcattcattaattcagtgtggaggtgtgtgtgaagactactatgatgagctgtcacagctcaataaaatctcagtcaattaattttttcattatcttagtattatatcaacaaaaaagtgaagtgtgtatatatatctatacacgtgcatatgtgcatactatgtattatataaatacatatacattaaatcaaaatgcaaggaaatacctttctgaatcataatctatatcattttctttttttccttcttcatcttcttcagggaaacgtctattcattaaggcaaacttgtgaattgcttcttccacagagtacttagtctgcccagaaacacacgcctcaatgtcttctgaattcagatggctctgtaagaagaggtgaaggctgctatctgaaagcaaaagtgcattctgtaggactctatattaaaaaaaaaaggaaaaataattggtgaacaggatggtcagtgatagggtagaagaaagaaaaacattagaaaagtaccactgaaggtaatttctctactgtggtaaactttgtatcaattatgggctctgcccattaaggggaggaaagcatatgttaacttttattcaattatttggaaatttaggtgggtaaaaacatgaagctaatagttaagaacatctgttaaaagaataacttcaaggacatttcttcaatttacccatctcttattaccatgtggattaattatggaaatattttgcttatatagtcatagaaagttattctactttaaaaaatttactgccaacagcatgtcaattcagtgatctttatgggataggctgtcatgaaacatcaaaactttcaactactattaaaaattatatgaagaaaatacaattctcagcatattttacattttaaaactttacagttatatacttaagggcatgtttacgacagctcatgagagagatggctttttttaatacttaaggttaactgtaaatttctccaaaatctttaggagcactgaatctctgtgttgtcaaaatgagcaaccaaataaaattgatcccagccaactttaccatatatataattaaaatatgataattttgtgatgaatacatactgctcttcccacatttaagatcaaagtttacaaagacagaacagatttcaaccagggcatcagaactacatggaagattaaaaactatcctgtagcaaaatctacagatgctcaaattcatattagtgaatgtgttttctctgaaatgcacatcttagaatatgaaatcaaatcaaagtatacctttatatttaaataaaaactggtttatcttttagcaaagatgttgacatatgatcatttagtctctactgatagttcaataattatgtaagaggagacactaagaccagatacaggggacaaaactaacacactaaaacccaagtagaattttgtccaacataagatttttccgatataacgatctgtgaaaaatagatcatgtatttcagaccaaatgaaccttaccttatattctgcttgtttaaacaagtaataaggaaagtaaatctcttttggccattaatatcaatttagtgaaaatccaaggtcattataataccaaatccttttctacaaaataaaacaattatttcttaacaaaggcaaaaatgcctaaaaatgcacagtattaaaaccaaaatctagctgtcccctttgcttcagcaggtttacagtttgagaaaatattctttactggtctattagaaggaaaagtaaaacctttgtgctttttaaaaggcaaaacctcaagcaaagcagctaaatccttctttttccctctgtgtcctccgccctgggtcctcccaaaagatgaccatgtcacatgataatgattaatttaccaagtacaagtagctaagtagtaaatccctcttactactctttgagatttattttctacatttacaaatattcaccattcttgtttttaaatacttcagattaagagaagagttatagagcaacaatccattaatacgaacttggatcgtgaagtctgtgaagtctgagcagagtgtttcctgtggcctctgtcagcggtttcctgcctgccataagtacaaggaactgttcatgggattgtactcgtggctttgtttctgttggaaatgtgttttattttctttataaaataatgggtaatctttaaaattgattttagatggtttgaggcattacaccacaacagtaatgagcactaatgccaatgatattggacacaaattcattttagctttatttcatgtctgaagcaattctactgagccttgaactgctcacgtgttgttattaacttgctagtaacttaacacatgggtacagcaaacaaaagtgatcagagtccaggttgatcgggacctcaaggctactgtcctttttcttgagctataattcaatttccaattttactgtacattagactcattatttcccagcgttttctttttctgctcaatactgccatctggaggacacacagatgaaaagagaaggagccaggctcacccagctcacaattccaaagagccagaaagatgtggctggggaggggacatctgaacactcccccaggcctagagttcaaaccagtgagtcggctaggtacagttttggtttttggaatctcctctgtttctctggctaaattcatgccaccatactccatgagttttaaataagcaaaaataatttttaaatgtatttatatgcttattttagtcagatagttcattctgaaatttaaaatgaaaatttttgagagtgttttcccatctggttaggtgagcataattaatttattttgagtactatttggcttactatcagagagggctgtgactgccaccatcataatattaaatactattttttccttagtcatgtttgtgccatattttccacaaacaaatctaatagcccaaaatcaatttcaaacctaatataaagagtactttgtaaaacagtcaataaaatgtcatttgtagaaacctccatttaaaaagtatatgattttcaaacctttataaaaggaataaaaaatagcctctaggattttaaaagaatttctagaaagatatttatagtgcaaatcagaagttattcctttccccataacagttttagactaaacaaagcaaaatctgttttttttccctaaactggacacagttgaaaagcacagttttcctcaacatgattttattagatgtattatatgctggtttagctgagaatatatagctatgcaaaatcatttcatcctaactaaggatgtcctgggtctgctgaacccaatacaatgatatatatacataactgcatagtacatggaaggttagcagtttgatgtagaaaaaaaaaattaactcagcctgtttagctcttactataagaaaaaataaaacctacaaatcttcattgaagacattcatgatctatgctgtggtgccctctattgaacacaaagacataaaaatcgtgtgtgtgtaaaactagctgtcatggttcaacactagccttttgtaaaaaatctttaatattccttaatatttgaagaaatacaaaaccatgatactaaagtctaaactgtagggtaaatgtagttgtattaatgggatgaattcagtaaagaagggaagcggctcccagtcatgaacaaatctattcaaacctaaattgaaaatcccattcaaacctaaaaattagtaggaattccatttttcatagttagagacttactgagtttatattttttagcctataactttcttttcataactattagaagggactttaagtttataattactcaggggcaagaat

SEQ ID NO: 4602 - DNA, 1301 bp, Homo sapiens
atgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgcccctgggcttccaaagttggagagagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacag

SEQ ID NO: 4603 - DNA, 4924 bp, Homo sapiens
accctggcacctccccacagccccgcatcggacccaaggacagtcccaggagacgtgggggcgctcacccctttcgtggacgggaaactgaggcaggcgggtgaaggtcggctcacatgcggagctcaggtgggtggggaccctgggccaagaccctgtctcagtgcctcagtggggactgggttggatgggaggggggatacggtgcaggaggaggggacttagaaccagggggagagcggagagcctccaggatgaactaggggagaagggaatggcagcagcgttcgctcctattcaccgaacccctggctggctgacccgggaaaaacagtctaccaatttatctcataaagtaaccctaaaatacttctgcaggcatcaccctatgttccaggtgagccactgaggctcagggaggacagaggtgaaggatcttgccccagtcacaggaggaatcacaggcagaaagggggagatggaaagaggtaggagggagagcagggaaggagaggagggactggagggggcagaaggaaggggaggtggctgtcccaggatggagtcaggggccatcctcaaagtccagcttcagcttctccaggtttttgcccacatcctgggacagggggctcctctccccctggacatactcatccggtgggcagctgtgcctgctaggaaggccttctacccacctcccagacatcccacagggaagcaactttcactcccagaccgctggtgctcccctgcctcccaggcctggggtgggtgtgggtgaggacgctgcaaggtagtggtcaggacacaagcatcagcatcggacatccctggttcaagtcctactcagagtgggaaggacacagactttgcagtgattccttgtgtgtgactcccagcttcaccactcctggttgtgcaacctcagacaaatgccttgacctcccctggcctcagcttccttatctgtcaagtggggtattcctagtctccccaggccactgaggggcatggtgggaatggataagaatgtgggtgtgagctgtatgcatgggagggattgattatgttccagtatgtgcctgctaggaaggccttccactcacctcccagacatcccacagggaagcagctcatgttcactgagcactgacgggatggctggtcctacatgaagtcccaggaaagacctgtgcatgaagtcccagggaagaccctgacccgctccctgtgcaggcagggtagacagacacttgaacaaataaccacagtccaagacacaaatgcagatcattttcagatgcatttaattctgaacagccctgtgaggagggcaggacaaagattattatcccattagacagatgaagaagctgaggtccagataaatcaagtgagttgctgaaggtcacacagcaatgaggggcagagctgggtcttgaccctggagcccttttcactctgggggtaccaggcctgccagaaaggttatcaccaaagggttctggaagagtgacctcctcaaactttccctgtcctcagactggcttgtggcctgagagtccgctatcagcacatcatacctttggctaaaaatgtgctaaaaatgtgccagcccctccagtgtcaatcaaatggccatcagtcatttacacttgagtgtggagaagccgatcagattttatgggttggagatgagaaggaatcttgagtgtttggacttttgggtgggaaactggagatatgagaggaaagtttgacagcagagagaactcaggaggtgggtggggagggagtcatggttaactggaggatggagtgagtccgcatgacctagacacctctgtgtacctcacctccatgaagtataaccaatgtctggcactcgtggagcacttaggatataccagacactgtgctctctccttttttttgagatggagtcttgctctgtcacccacgctggagtgcattggcatgatctcagctcactgcaacctccacctctccggttcaagcaattctcctgcctcagcctcccgagtagctgggactacaggtgcatgcccagctaattttttttaaaaacatattttagtagagaccgggtttcaccatgttgcccaggctggtctccaactcctgagctcaggcaatcagcccgccttggcctcccaaaatgcagccgctctctcctttaatctttttgtttgtttgtttttaagacagtctcactctgtcgcccaggctgcagtgcagtggcacaatatcagctcactgcaacctccacttcccaggttcaagcagttctcctgccacagcctccagagtagctgggactacaggtgtacaccaccatattcagctaatttttttgtatttttagtagagatggggggggtcaccatgttggccaggctggtcttgaactcctgagatacccctgcctcagcctcccaaagtgctggaattacaggtctgagccaccatgcccggcctctcctttactcttcatggcaactgttatctttctttttacagatgagaaaagggaggcacagagaggctaaataatttggccaagatcacacagaagcagaggagcagaagggtggacccaggcaggccagctctgcagcccctgctcttggccaccatgggctcctcctctgggctaacccagcccttgccagaatcctacatggaaagtattatcatcccattgaatagaagaggaaatggaggcacagaggggccccaggatggcagaattagtaactggggttggggggagctgggattagacccaggtctgaaagccaggccttccctctacccttcctatttgccaaacacccgggccccatcctgcccaaggtcagcagcccaggtggcaggatgtgcttctgcctggtgctggccttggggagcacttgtttttccccagaggaagcagcaggtgtggccttctttatggaaatgatcctaactgggttggagccaggattccccccaacacacacccaggccaggaggacttcaataggactaggtcagagcttctaggcttggatggaggggctggaatttgggagaggggctcggaggtcagtcccattttggtaagcctctcaccctctggactccatatctcctgctaatcgcactccttggatgagacagtgacatggaagtgcctcccagctcagccctggggagacctctccaaggtcactgaaggaagctgggggcatgcccctacccttctttctggagcagagccctgggaccttctggagtcccagtcaggctggggtctacaagggttaagactccaagtgacttctctgtctgcccctcatgcagataaaagtttccattcaaggaagagctgccttagggctgccaagttatcctgattctgtcattgtagcatcaaggtgggggccttgggccttcccagcctcttcaaggggacattcttgggtgggatgtggctcctaactggtgtcaccacctcaaaggccaatatcccaagacccagaattcccacgttggactcagggactggcgagatcacactgactccttctgccagggccctttaagagccgcccatcccgcccatgatgctcctgcttagtgagtcagacacttgcattaggccccaggggaggaagagaaacaggcctcagaaagcacttggaagggcagggaagggctgggaagaaacctggctcagaagatggtgccctcccctcacatattcccagactggaaggggcatcttacttctgagctccccacagccccagcctcctggctgtctctcctggctgctgaaataaaggccaagcccttttatcacctttgttatgtgaccctgcctgctggttgggcctcatctctcgcccctagttctttgctttcagggccacaccagccctcttgactgttcttgaatccatcatgattctttctaccccagggaccttgcactagccagcatcttgctgcgcttcctcccgtctcaattggctaatgtgggagaggcattttctttacacacccagagaaaatagagcctgctaccttccaagactgagagggttggaagaaactttttgtattgtagcttgagggtgggaaggagaagacacaatttgagcataagaaggtgagctggaagctgggcacggtggcttatgcctgcaatcccagtgttaggaatgcttgttctccactgctgcaaagaaatagcactcaaacataaatttaattttctcagcaagcaatttttagtttctgtagaaagggtgctcctcatagatggaacaatggtgagagcacagttgaacaagggaggggaaggggttcttattcctgacccaggtaatccctgctgctatgttgttcccctgttggctaaggttggaccgcacggtctaagctaattccgattggctattttaaagagagcagaggtatgagccagagtggcgaggtgagtagtttggcaggaaggacagttaggaacgggtaactaaaggtgacttacatcagagcaggtgaccaggggtgactcaggtcaaagcaggtgactgggatgagtcaggatggagcaagtgaccaggggaacaggtgtgaactactgaataaaactgatggaaaaggttgtttactgaaattagaagcaagggggcgaagagaaccaggaagttaaactttaaaatggagaatcaaagaataagagagctgaacatacagacatactgattctttgaagaaaaacttggggttcaccatatttaacatgagcactttggggggttgaggcaggtggatcactgcaggtcaggagttcgagaccagcctggccaacatggtgaaaccccgtctctactaaaaatacaaaaactag

SEQ ID NO: 4604 - DNA, 3982 bp, Homo sapiens
aaatgattagactattggctctgtaatgctttagtagattgaagtgattagactgttaatcttttttaccggaattttttaaagactgcgtaatttattcaaattagaagtgcatatatctgagaacatacatacagtcaaatgctctacccctgagttatacccctgagaacatataaatattatcttccaaagcaggcattgtaaatgtccagatctttttaaaaaatattttatttgattgaataatttccttgttgagattaaagaatctaaatgtttggattttttagtttagattgtatcactttgaaaattagttggaaaccccaattttaatgaaatttattttctagagcaagagtggggtggatttttaatgctcagtgttttagactctcaattgccatatttcttatggcagaagtgcacacagtgtttggggtttgttttgaaatgtaaagatgtaccatgtgtatacacttgtgtacatacgaatatatgaaagaggagaaaagggataaaaatcatgaaggtgaaaaatataaacaaaagtgaactttatgtgtctcaactcaagcaggtgaccagtttgtcaagttcttctctgattttccctgatttgggaccattatattttgctgaattttatttattatgtattccatgtcttttaactagcactgttcattagtgcaaaattaaatatttattctatatcttctgttgtcaaacacgcactatggacacatagaaaattttgcccttagatcacaaactaatggaattcacacctattttgagtaatctactttttaaaaagtaagaatatctgatttaactcagagttcgatttttctaacctccaaagcacctcccgtgactgtggaataaaggacatcttggggcaagtgagaacattgattgcctttatagagactaaaatgttaacattgaagattcatggatgaacctagatttgaggtaatcactgttttctaacaaaatgtttggagatgacttttctttttttctttctgtgatcatcaacttagaggcaagtcataaatttacagattttggcctttgatgtgcacttcaaaagaatactgtacagccaataattctgggtaacccttaatttatttggattgcaggtgagaactgtaaaagcaaaatttttcaaattttatgtttttgtacaataatttatccagttaattttctcagggcatgatcagtgttaccatattcattaggtgttagcatagatgagatatctaagaattaagcattgctgtttttcagtttatatgcatatagccatacatatgtatatttgtttcatttaccactcttcatggaaattacatttgtaggacatttgaatattatttactaaatacccacttaaaaaaaatactgtactgtaaacaattcttccaaaggaagccttaaaacaatttgagttcaacaagagtttgcttgtgcctgtgtgccttggcagttattttatagcttttctctactatatactattatgtgtccaagagcaaattttttaaaacaatttgtattactaccgttccatttgggccacaagttaaattgagtgttgttaagcacctacgtttcttttaaacctttaaaaacttgttatgacaatgttggtaatcattttttacacttctttagttttagtttagtttgtttatttaaggatcagttgtgtattattttagacaaataagtgaatctcatgttccctttcctgattctttggtttctatgtaaatctaactttattttcagggaatatccagggcaagtgaatgagttatacattgatgcagcgtcatatcagcattgaaattataaccttagtctttcactccttaatcagtattctttctactccactgtattgcctcaccatctaaaacatgatgtctgcactaggctaattgaaataggctagccaggtgaaagctgataaagtggggctttgactaaaataggctaaccaggtgaaagccatatcaaacacaacttttctcccattaatcatctaacttgaaaaagcatatattgtaatagccataaatttgattagtttcacatttctttcctcctcatccttttaaaccaaatgcaagattaaagccacaaagtgcaagacttaagtgtataatctataatttgcatacttaattgctgttatttttgtttgggatctttcatgtttatagggagaatatcaaatacaatttttgtcttggacaatgactttagagttgtagtttcaaaaaaattacatagactgccgcctttctcttaggaagataagacattatcccattttaaagtaaccaaatcaaaaggtttttaagccgactgtcagataaacagtataggggtactggggaccacctctcctagtatagtattcttttgattctatcacattgactgtgattttgtgacttggtgatgctgctttagccacgatcacattctcttttctgaaaattcagctttaggagagattggagctgtgcatgcagcattaattaagaaagagggcctcctggctagccaatctgattggcttagatgaatccagggggaaaaaaggaatgacaggtattgcagccagattgcatttgttccaagaccaaggaagccaggtgtcctgcaatatatataaatgcaaattaaaagttaccacagttgtcttttgtagtatggttgatgtatgagtctaccattcaagttcattttttttttctatgactttcctaggaaagtctaagatacattttttctttttctttctttttttttttttaaatggtgtcttgctctgtcatccaggctggagtgcagtggcatgatcatagctcactgcagcctccaactcctgggctcaagtgatcctcccacctcttgtctcctgagtaacggggggactacaagcacacactaccatacccagctaattttattattattattattattattattattattattatcatcatcatcatcattttgagtcagggtcttgctatgttgtccaggctggtctcaaactcctgggctcaagtgatcctcccacctcagtcttctaaatttcaggcataagccactgtgcccaactggtattttttatatctcgtttcttaggaagaatcagtgtgtatatcattcagcaaatacctgagcactcaccaacatgctgagcgctgatttaggtgcaggatatgttagcaaacataacagaccatagttacattctagtaaggcaagcaaaagataaatatactaagtaaattttatgatttattaaaggttgataaatactatttgtaaaaaaccaatggacttctggtttctgatgcagcatgtaaggagcttgaaagttgtcactctgtcctaacaaatagctaaacaaactgaaaatcaacaactcttcttagatccatcagagaatggaggtcacagagcaaactgaagccccccaaattggagaaagacacgtggatacagagaatcacaacttactgggaacaagcagaaacctccgtgggaacaaagggcagagtaggaaaaacctaagctataattgataaactgctggaagctcaatgtgaacaaatctgagagttaacttgttgtgggggaaggtgatggatatgttaatttgattgtagtaattatcacacaatatatgtatattaaatcatgtacactttgaatatattcggtcttgacgaatactttaaaaacaaaaccttggaggggtatcaaaaatggatcccctcccttttctgagttttatctctaggagccctaccaggttctcatagtgaagattgagaagaaaaaaaccaaaatctcatgtttccagcatggggagaggaaaaggaaccattttgaaatacaccagagcattctgtatttcttaacaaagcctggc

SEQ ID NO: 4605 - DNA, 1582 bp, Homo sapiens
ggagcccactggaaaagggaggataccacataccctcggaagtgaggcgggagaagggcttaagcagctccgcgaagctgaggtgattgagacgagtgagccgctcggcttcgtcgctgcacagcgcagcgacacaggggacgaaggagtccgggattagctcctgcactgattgtacacactgggccatcgccgcagcacaggcagcggcggcgcccgccctccggcccaccctgcgaggttatcctgcggctgcagcagctaccgccgccgcccgccggcctggcccggccgggcggggccccgaacgcactggagcctagaaacaagaaggaacagacgccgccgcttcggtttctggggcacaatccactgaccccccccttcccgtcaccgccgcttctcagcgctcgtccccgcgtgctcgcattccaccccgataggtggagacgccgacagtcaccacttagtccttcggacggcaaaaccttggtcactgcccggccggaaccgccatgttgaggccgaaccctgaccaaccggcagtactactcccagctgcccccgcgcgcgtccctcacgtgactgtgttaaaggagacggtaggggcaagggaagagagctgaggagagggaagtgaaaaacgacggaggccggttgggaggctggagccggaagtgttgtgacggaagctccctgggcggggcggggctacaagtgcggtgggcgggggcgggggcgggggcgggggcggggggaggtgcacaactgtaggccgggttctcaagctcgcccttagcagagcagagctgagagccacctactagcggcaggtggagcctcgagacgggtgctgtcgtggtgatggaggcgcacgctcgcttcccacgcagtttggcctttttgacgtccctggctgttgtgggcaaccgatttggttggtcgcgctgcttcctacgctcgccggcggagcagctagtggcacctgctcggagagagggagtggatctctcggaagtgcttggggtttcgctgaagcggacctgaacagaccatgtgtcctttaaatacagccatgcttttagaaacggactgtcactttatgtggactcaaccattgaacagaatgtgtgcttttgtgagtgctgcaattccttcaagtgtaattgcgctactgcatttttgttggtcgcagggaaggggtgtgcctgcaaatgtccgcgtggttcgtcctcagcctcttcctttttacactgtgctaggatgtttacttgcttgtggtggaggtaggggaagccagtatttgtgtactgtgtactgtcctgaaccggctttcattcctaacttttcaaagattgctttaaaggggggggggcgcgggtcaaatattgttttaaagggggggacggggtgaggtcaatggtgtgtgccttgtaagtagaaatgaatgaaaggaattttactaatgtgtcactcaattgtttgagctccttctgttttgcatgccaaaaatataaggcaaggaaaaatgtatcattctatcatgattttatggtgctctaattaaaggtgtcttccccaa

SEQ ID NO: 4606 - DNA, 2802 bp, Homo sapiens
gagcctcagcccctcccacgggccgcccacggattccaggatccggaaactcttcctgctgctgcgtcaccccaggaaggcagcgcccgcctctgggcagttctgatggaaactggcttcgccgcccagaggaaaacccacaactaaggggccaagaaaaagcctccatggtcccgccctttcagtgaggatcctaatttataccccgagtgtggcccccatcaaagtctgcagtgacagccgagcgcggtggctcacgtctgtaatcccggcactttgggagaccatggcgggcggatcacttgaggtcaggagttcgagaccagcttggccaacatggtgaagccccttctctactagaaatacaaaaattagccgggtgtggtcgtaggcgcctgtagtcccagctactcggaggctgaggcagaaaaatggcttgaacgcgggaggcggagcttgcagggagccgagatcgcgccactgcactccagcctgggcgacagagactccatctcacacacacacaaaaaatgtagagtgacgttcactgaaatgatactagaccagcgggagggacccagagcgctgcggttcacagaatgcggtgacagcgccgcctcgcgtcctttacttcaactgccccaggcagacgtggtcacgtgtgttggcctggaggctggaatacaccggggtcaaatgcagagtggagaaaggagggaaggatgggaggacgtgttgaagaaagacagtaagagctagcgctatggttcatatctgtaaaactagagttttcggaggcgaggcaggaggatcgtgtgagaccaggagtttgaggtcgcagtgagccgtgatcacaccactgcactccagcctggacgacagagtgagaccctgcttttatatacttttcatattttctgtaattaagcaagttttgtgtccggaattggtgggttcttgatctcactgacttcaagaatgaaactgtggaccctcgcggtgagtgttacagctcttaaggtggcgcgtctggagtttgttccttctgatgttcggacgtgtccggagttttttccttctggtgggttcgtggtctcgctggctcaggagtgaagctacagagctttgcggtcagtgttatagctcttaaggcggcacgtctggagttgtttgtttctcccggtgggcttttggtcttgctggcttcaggagtgaagctgtagaccttcacagtgagtgttacagctcataaaagcactatggacccaaagagtgagcagtagcaagatttattgcagagcaaaagaacaaagctttagcagtgtggaagagaacccgactgggttgccactgctggctcgggcagcctgcttttattctcttatctggccccacccacatcctgctgattggtagagccgagtggtctgttttgacagggtgctgattggtgcgtttgcaatccctgagctagacacaaaggttctccaagtccccatcagattagttagatacacagtatggacacaaaggttctccaaggccccaccagagcagctagatacagagtgtagattggtgcattcacaaaccttgagctaaacacagggtgctgattggtgtgtttacaaaccttgagctagatacagagtgccgattggtgtatttacaatccctgagctagacataaaggttctccaaggccccaccagagcagctagatagagtgtggattggtgcactcacaaaccctgagctaggcacaaggtgctgattggtgtgtttacaatccctgagctagacataaagactctccacgtccccaccagactcaggagcccagctggcttcacttagtggatcccgcaccggggctgcaggtggagctgcctaccagtcccgcacggtgcgcttgcattcctcagcccttgggtggtcgatgggactgggcgccgtggagcagggggtggtgctcgtcgaggaggctcgggccgcacaggagcccttggagtgggtgggaggcttaggcatggcgggctgcaggtccccagccctgccccgcgggaaggcagctaaggctcggtgagaaatcgagcgcagcgctggtgggctggcactgctgggggacccagtacaccctccgcagctgctggcccgggtgctaagtccctcattgccaggggccagcagggctggccggctgctccgagtgcggggcccgccaagcccacgcccacccggaactccagctggccggcaagcgcggcacacagccccggttcccgctcgcgcctctccctccacacctccccgcaagctgaaggagagggctccggccttggccagcccagaaaggggctcccacagtgcagcggtgggctgaagggctcctcaagtgccgccaaagtaggagcccaggcagaggaggcggggagagcaagcgagggctgtgaggactgccagcacgctgtcacctctcggttttactttattttaggataaaatatctattgtgaattttaaaaacatgtaaaataaaattttaattaaaaagcctaaatgttcttttcctatttatcctgaaggaaattcctgttgatggcgcatttaggaacttatttatcccctgaagacctgagccctgcacatatcaaaactgtacattccttgtggagcagtcttctcttttgaaatgtagacactatttccctaatcttcaagccagccattgtcactcctagtgacacttccattggataagctccttactctcactgaaattggcctcagagttgcagccaa

SEQ ID NO: 4607 - DNA, 6716 bp, Homo sapiens
aaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctgagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacatatcaagatgcatttattaggaaggaggagtttagagagcaggctatcagaataaccactcagtaagtgttttcttaattgctatgtgataacttacattactcttaatgaggagaaaagtcgctagatatggatcatgtttatgttttaatgttttttaattctaaattttgatctagggagccctcagacataaggagaaaccaatatgttgaatgatggggtattacatacagaaggaccaagaccttattttctcctacttaagatggaatcttgttaagatgaaaggacagctttttaaaaggagaaggtcataagacagtttgaggaaggcattggaagaggaagaggggcaatgtctcctttgttttattgttggtatataaacttaaaatctcagttctttttatggcacttgtggagccacttcctctcctcaccaaaaaatgcccagtaccctgaatccgatcaaattactctcctaaagtataaggcttagtttctgtgtgctgcttcgcgagacagttcccacaaatcgagagtgttaatcagacttttgtgttttcttttttggattgctgttgtttgttttcatttatcatttgtctttgcctaagccaggctcatcaagaattaacagccatcaggctgccgatgtgctgacagcagacccacttagagtcctgtgtttgtaattccatgcatttgttattttacctgttttgtccctgccccttctagtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaat

SEQ ID NO: 4608 - DNA, 448 bp, Homo sapiens
gcaggaattactgataactgttattataaccaatgcagactttaaaatcccacctggacatcgggtgagaggaggagggcaggcagcaaaccgacctgcagacctgcagaggggagccgtgtccagggccactgcgtccccaccagacaacagctactagaagaggaaagtggccctcacaggcagggtgcctgccaccaagcagtcagacaagggggtaaccaagagctcccagccagaaaaacatgggggcagggaggccaaacaaaaagcactgaaaataaagagaaggctgggtggtggcagcatcggcccctccctgtgcgccccaattccaggtgccacgtagaggcgagaggtctttccaacacggcgggggacttgtcaacaggattaggcgtgaggagccgctctgcgtttccagtctggagactgcattcagcctgca

SEQ ID NO: 4609 - DNA, 592 bp, Homo sapiens
aaaagaagaggggcaggactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttgtccatggggctgctagactagtggaaggggatgcggtgcgtcaagggaaaattagg

SEQ ID NO: 4610 - DNA, 3073 bp, Homo sapiens
taagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtg

SEQ ID NO: 4611 - DNA, 9488 bp, Homo sapiens
gttgtgggggcggccccaattcgctggctgccgcgctgctccggagcagctcggccagattaagtggcccttatcactggaaccgctcccatccccacgcagagattgattcacggacctgtgttcgagtcttcactcgtacattctacttgctttgtgtctttgggcaggtcgggaaacctctcagcctcatctgtaaaatgtgatcataaataccgggtacctggaagtgctcggtaaatagtagtttttactattactctctcatttcagcaggacactgatctttttactcctagtttacacgtaaggaaactgcccgtgaccctgctggttccaaagcctgctctttttccagcgcggggctctttatcccgtctctgtctacaatctttcacacacgttaagtcagtgctttctgggcctccaacaagaaagcaaacgctaggacccttcaaatatttcaggaaggggcgagttctagtcactgcctgttcttctccgagccccaatcagcaatttattattacaattttttttttttttttgagacggagctatctcccagactggagtgcagtggtgcgatctcggctcaccgcaacctccgcctcccgggtttaagcaattctgctgcctcagcctcccgagtagctgggattacaggcagccgccaccacgcccggctgatttttgtacttttagtagagacggggtttcaccatgttgtccaggctggtatcgaactcctgaccacaagtgatacaccggcctcggcctcccaaagtgctgggattaccagcgtgagccacagtgcccggccttctttttcttttttaaacagagtttccccctgttcccaaagcagagtgcagtagcatgatcatagctcactgcagcagccttgaaatcctagactcaagtgatcctcctgcttcagcctcttgaatagctgggactacaggcatgccaccaggcctggctaattttttttttttttttttttttttctgtagagacagatctcactatgttgaccgggctggtctcaaactcctggcctcaagcagtcctcctgcagcaacttcacagcaacactggaatgacaggtgtgagccactgtggcaggccaatctcctggttgatttcaatctagacactttaatgagcaccaaacatgagccaggcagtggactagactcaaggatgggttgaatgtgtttcctgtccttcaagcaagcagagggcaaataagacccatgtattagtagccaacaataacattgggtggctcacgcctgtaatcccagcactttgggaggccaagactggcggatcatttgaggtcaggagttcgagaccagcctgaccaacatggtgaaacctccactctactaaaagtacaaaaaaattagccgggcatggtggagtgtgcctgtaatcaggaggctgaggcaggagaatcacttaaacctgagaggcagaggttgcagtgagcggcgatcatgtaccagtaaagcacctactgcatgccagttagtgttctgagtgctttgcaaatattaactcactcaatcctcgtatctccacaatgaccctctgaggcaggttctatcttttcccacttgcagatgaggaaatttgcccaaggtgacagaaatcaggattcaagcccaggctgctggctcccaagaccatactctttctccactattgtctatggcctccacatttttgttgtatttttggcatttgttgactttgaagtgtgggaaggatttgagaggcagagaaaaggcactttgggaacaacgtgaaccaaaacacgagaggtttgcagctgcataatcataatagctcctatttgtgagggtttagtgcaactagccttttaatgtataatttcaaccccagcaattcatattatgtaagaatttttttttttttttgagatggagtttcgctctggttgcccaggctggagagcaatggcgcaatcttggctcaccacaacctccgcctcctgggttcaagcaattcttctgccccagcctcccgaggagctgggattacaagcatgtgccaccacgcctggctaattttgtatttttagtagacacggggtttctccatgttggtcaggctggtctcaaactccggaccttaggtgatctgcccgcctcagcctcccaaagtgctgggattataggcgtgagccaccatgcccatccttatgtaagaactattatagctccgttccacagatgaggaaaccagggaccagaggaattgttgtgcaaagtcacggctaggaagtggaggagaaaccgggactcaaacccaggccacccagtggcctagtctgcactgtcaccacagcactccactgcttccctcctttgtagctgggagaagatggaatttagtaactggagaggtgactgggatgaggtgcagctctagaagctgcaccagaactcacaggaccccagagctgccaagctagaatgccctcaaagggctcgtggttcaagccccagaggcgtcaccccatgggagtttcgctgaggagcctgtctcataggtggttctccctctgatctttcctgctgtccagtcatcctaatctgttgttcaggcactcccagggagagctttttcagccttaaccttggctttttgtcctgccttggcccaaatccacactcctagcctgactcctaccgtgttttcttctcctcctcctgctctcaagacattcaagattctgtgcccttgtcacctcgtctcctcactgggttctctcatttctgcaatgagtaagaaatgtgagtaggaagaagatgctctcggaaactcaagttcaaatattcctgtttctggttagctctggggcctgccatgagtcactcaacttctcatcctgttttcctgtctgtaatcatattcatacccacctaagcaaagcctttagatgagaaatagatgagatgatgaatggaaacaactagtcatgaattttaaatatattattaataataatatatatatatatatatatttttttttttgagatggagtcttgttctgtcacccaggctggaaggcaatggcatgatctcagctcactgaaacctccacctcctgggttcaagcgattctcctgccacagcctcctgaggagctgggattataggtgcctgtcaccacgcctggctaatctttctatttttggtagagacagggtttcaccatgttggccaggctggtctcgaactcctgagctcaggtgatcctcccgcctcggccttccaaagtacagggattacaggcgtgagccactacgcctggccagtggtattatcagctagtgatattatattaataaatattattgtccgggcatggtggctcatgcctgtaatcccagcacttttggaggccaaggtgagtggatcacctgaggtcaggatttcgagaccagtctggccaacatggtgaaactccgtctctactaaaaatacaaaaattagccaggcgtggtggcaggcgcctgtaatcccagctacttgcgaggctgaggcaggagaatcgctggaacctgggaggcagaggttgcagtgagccaagattgcgccattgccctccagccggggccgacaacagtgagactcagtctcaaaataaaaataaaaataaaaataagtattattagcagtgtgattaagaaggcaaaaaaagaattaatgaggcaccaattcagaaagtgtgagtgtggttgcctggtaggggaagacttgcctgccggggtcagagttgggcaataactgggattctttggttgggaagccaaaagcatctgcaccactggccttggaaaggaacttgggaaccctactttattcccttcaccaaacccctctgcctccagaaggaatcttatacctccttggaattctgatgaactctgaaatgcctcacttcctgaatatctacctgagatttatttatttatttatttatttatttatttatttatttatttatttattttgagatggagtctcgccctgtcacccaggctggagtgcagtggcgtgatctcggctcactgcaacctctgcctcctgggttcaaaccattctgcctctgcctcccaagtagctgggattacaggcgcccacaccacgcccagctaatttctgtatttttagtagcaacagggtttcaccatgttggtcaggccggtctcaaactcctgacctcgtgatccacccacctcagcctcccaaagtgctgggatttcaggcatgagccaccacaccgggcctacctgagatttattatgcatgccactgagctactcaactgcaaactccttgaggatgggcacttcatcttaactgtttcatacacccccacacacgaacctgcacttaggatgatgcctttgcccttggtagactccctgagtccccaagtgtcagagctgggagagaccttgagaattctccactacaaatccccactcacctcctgccacgcacgattcacattttacagatgaaaaaactgagaggaaccattcaaaagggcagatgaggctggtccaaaggtagtgagttatctcaactgattgttcacagtcagttacagatcgagctccttgttctaccctttcccaccttctcactactgcactttactagtctttttaaaaagtttttttaataaataaaagagcagatgaacaagagactagatttatcagaggtgatccacagggaaggactccaaagtcagggcttcctgcatcagaacagaaaggcaggcagggcacagtggctcaagcctacaatcccagcactttgagaggctgaagtgagaggatggcttgagcccagaagttcaaggccagcctgggcaacatggcaaatccccatcactgcaacaaatacaaaaatgagctggacgtagtggcatgtgcctgtggtcccagctactcgggaggctgaggtgggaggattgcttgagcctaggaggttgagtctgcagtgagccatgattgcaccactgctcttcagcctgggttacggtgtgagaccttgtctcaaaaaaaaaaaaaaaaaaaaaaaaatagagagggaggggcaggaaaggaagattgaggaagagaatatgggaagttatacctgccccattgcaaggaccccaaaggctttgcagccagaagccggaattcctgggcagagatagggatccatttagtgccaatcacagcattttgaatctgggaagaagcttaaagcctatcaaaccgaagaagtttcttgaatgccagtaaagagagtaaaccactgttttttgccctctactaatttttttttttaatcttatctctactgaatacaggacaaaaagacatttgtcagggttgattcttgggccttctgaagttcggggcacatgcaggcgagcattacagatcctaagaataaatcagctgggaggggcttagatcccagtggggtcccagcacgtcctgtgccctccccacccctcccagcaagcatcctgaaggaccccctatacagctcctcaccagggcactgccgtcttttcctaccctgtagggagtaagtggggccactaagtcctgcttgctgctaggagtgtgggggtgtcagtggaggatctgtactccatgccctcttagcaggcatccccccagccaaggcgctcattaatgatggactccagtgaaggaaatcataactgggccttcatctctgcctgaggcctccagccagcccctaaagcctgaactctcaggacagaaagcctccccttgtagagcagtgtttgattcctcaggccccagggaaatttccaggactcttacagctttccaacaacaagcttgttggtcaaactgttacaaaaactcagataagggttaggcatggcggctcatgcctatgatcccagcactttgagaagccctggcaaggggatcagttgagcccaggagtttgagaccagcctgggcaacgtggcgaaaacctgtgtctacaataagatacaaaaattagccgggtgtggtggtgcacacctgtagtcccagccactagggaggctgaggtgggaggattgcttgagccccgctaagttatgattgcactgctgcactccagtttgggtgacagagtgagaccctgtctcaaaaaaaaaagaaaagaaaaagaaaaaacactgagataaagaagctaccagaaaaaacaaaacaaaacaaaacaaaaaacaataaagaaaaagaagaagccaaccaagagtcacagcccttttaccctccactgccccttaggctaataaaggcctctccagccttcctttcccatttatttttttccacagaagaactccactgaacattcattgaaggcccagatttagagtgagcggggcaaaccaagttttgtgctgggtggaaggaggggcggctgctgttcagcccacaggattcctgtgaggacaccacatgttcatagttgttaaaccatcttgcaaactcattgcctgatgttcagatctcccggctcagctggtgtctgtggagtacaggatttatgtttcagagagggcatgagcccagatgatgcctcaagactcaggttctaggagagaaagcagtgcttcagggactttgactgcccccgcccgaaatgcagtcgccatctgcaggtaaacagagctggagctggtgctgccggaaaagaaagaggagggctctccggcagcctgcggcttcctcaaggacttcccaggccaggcgctgtggctcacgcctgtaatcccagcactttgggaggccgaggcgggcagatcatgaggtcaggagatcgagaccatcctggctaacacagtgaaaccccatctctactaaaaatacaaaaattagccaggcgtagtggcgggcgcctgtagtcccagctactcaggaggctgaggcaggagaatggcgtgaacccaggaggcggagcttgcagtgagccgagatcgcgccactgcactccagcctgggtgacagagcgagactccgtctcaaaaaaaaaaaaaaaaaagaacttccctgacagcacccaggtttccctgatccgcccgcattgtcagacttctaaggccaggctttagtccaagcctctttcttttttaaatttatggcactctcaaaaccacctggtgtgcgtcaagccctctgccactagaccctgtgtgaaaactgtaatggtaaaatgctcaaaccagggcaataagcacattttgacccttctgctttcattcacataaaactgatttctcagtctatattaatcttggatcacatttttttttttgagacaaggtctccctgggttgcacaagccagttttaaactcctgacctcaagcgatcctcctgccttggccttccaaagcactgtgtgagccactgagcctgacctcaaaattgtacattcaaaacaagctgacgtcctgggcacaggaggcacgtgcctgtagtcccagctactcaggaggctaaagcaggaggatggcttgaggccaggagtttgaggctgcaatatgctatgatcacacgtgtgaatagccactgtactccagcctgggcaataaagtgagaccctgtctctaaaaaaatttaaaaaaaaaagctggcagaaacttagttatttgggattgatttgcatcaagtttagtgaattgttgggagattagcagtgtgttagtccagtgtggggaaaagaaagagagatcagattgttgctgtgtctgtgtagaaagaagtagacataggagactccattttgttttgtactaagaaaaattcttctgccttgagatgctgttaatctgtaaccttacccccaaccccgtgctctctgaaacatgtgctgtgtcaactcagggttaaatggattaagggctgtgcaagatgtgctttgttaaacagatgcttgaaggcagcatgctcgttaagagtcaccaccactccctaatctcaagtacccagggacaggccaggcacggtggctcacgcctgtaatcccagcactttgggaggccaaggcaggcagatcacgaggtcaggagatcaagaccatcctggcaaacacggtgaaaccccgtctctactaaaaatacaaaaaattagccgggcgaggtggcgcacgcctgtagtcccagctactcgggaggctgaggcaggagaatggcgtgaacctgggaggcggagcttgcagtgagcagagatcacgtcattgcactccagcctgggcgacagagcaaaactccctctcaaaaaaaaaaaaaaaaaatgaatcaagtacccagggacacaaacactgcggaaggctgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtgtaagaagaaggaacgcctctttgcagttgagacaagaggaaggcatctgtctccttcccgtccctgggcaatggaatgtctcggtataaaacctgattgtatgttccatctacttagggggaaaccgccttagggctggagatgggacatgcgggcagcaatactgctctttaaggcattgagatgtttatgtgtatgcatatctaaaccacagcacttaattctttaccttgtctatgatgcagagacctttgttcaggtgtttgtctgctgacctctccacaattatcctatgaccctgccacgtccccctctccgagaaacacccaagaatgatcaataaatactaagggaactcagaggccggcgggatcctccatatgctgaacgctggtcccctgggcccccttatttctttctctatactttgtctctgtgtctctttcttttccaagtccacctaacgagaaacacccacaggtgtgaagaggcaacccaccccttcagtccaggatctcctagaagcagttgccaagacaggatgtgcaggaaatatattagaagtgtctgtgacaggaaatggggctgggagcacaggtgtgatgctgcgtaagggaaggaggaaggaaggtttggtgggtggcagcgtcgtcttagattgcaaatgcaattctggggaaaattcagcaagcctgttgggggctactccagccgaagttacccttcttcagaggggtcctcaggctcccaggaccagcctgccttcacatccttgatacagggatgctaagtcatgactggatgcagcccatgggcagcacagcatctgaatgctaggaggggccctcagccaatcagctctcttccctgggtatggtggcttatgcctgtaatcttagcactttgggaggctgaggcaggtggatcact

SEQ ID NO: 4612 - DNA, 2836 bp, Homo sapiens
atcagccccggcgctctctcatcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagagatccaaagaaatcctgaggaagcacaacaaacaaaaacactctggatcagaacttcctgtgccagcgttacatcagggttttctagcagcaagggcgggctccacatggctgaagcaggcaaccaggaggtaggcagggcccggccctgaggggctgagttgggggagtcccaggtctcgggaagagtgatctcaggctgccctgcaggtgttcctgggggatcctgggacagcatcagggacgctggcccccagtgcttccttcccatctcacaaatgggcatttgttcatcggctaaacaacactttctagactatttggggcactgcacatgaagtctgcagggtcgggggttcatgatcaggctgtctctctctcacatagtttggtaaatacaggactgttcctaaacagcaatgagacaacctggtgcacagttccacatatcgagacctgtcatcttattcagatcatatgggtgataccacatgcttcagagtgaggctgagcatgggttcccctaaacttacacagacaaaatgacttacagtgtttgccggccctccgtgccctccatgccctctctgagtcaccagcaaacattctgtgccctgaactagagaatcatcacattgtctttgccccagttactttcctggaacagataacaagcaaacctctctctggttagttgcttctcggctgaatggttagggatcctgtgctgaggtcaggtctgcaggggtgagaacctgatccgacagtgggacagcaggaggccatggggggatctgaggcagggaaggtgctcaggagaggacctgagaaggaagagatggctgtggtcctggaggctcagggatcaggcctagggcctgtgttccttcggcctcagcatacctctgaagcggtatgcccagcttctctgggcaggccctacaatgtgtgagaaacagcctcagaacaccacctcttttcagggtagttacccaaaatacacacgtgggagtttgccagagttgaggcagcttttaaaggtggagcttttcaaaaagggaaactgggagcacttacagcccaggtctatgttactggtaagaagtggtttgtctcaggaataatgtaccctgtggagagtactttgtgtcagcctcactgagaacaaaaaaagcactcctttccccatgattaacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaac

SEQ ID NO: 4613 - DNA, 1318 bp, Homo sapiens
gcgaccccggcaccggcacccgttccgagggttcgcgccgcaggcgcaaagtttagggtcagccacaaacgcgcggccgctttgagcctggcgtaaggggcggcggcgtagggggacgttgtgaatagctggtcgaagtttggttgaagcacaggagggtaaataagaaggtttccagacaaagagactcttaaaggtacagactcttatgtctgtccctcctccttaaagggccagagacgctcccgagcccatctccgcccccttcttcccggggaactgtaaagtggaatgcagatatggagctgatgagtctgctttgatcttatgggtaagaaaacatactgggaatggctgaataagacagaaggaaacaaagttcctgataaccttgtagagttaaatctgccctagaccatctgattacctctctattattaggtgagaaaaaaacaaacttcgatcttatagcagtttggcctgtggcttaacatatttcacaacagaagggaaagatgtcagaaggagatttcaaaggactcaggcaacaccctaggaaagtcaattcgcaaatcacttcagcaaacaggtcagaaaatagtaactatcaaaccagttgtgccttctactccatctctaggatagaagcccagccacatcctctgagggaaggaagaggctcttattacagcacaatccaaacataaaatgcagcatgttcaccattggcctgggacaaatccttaatagttggggatacggactatttcccccaccagtaccaggcagggacattcctgtcctacctttcccctaaaggaggcaaggtccaaacttctccactcttcataattaccattcttgaggacaggccaaatccagtaaggcacggagtaaaacagctgatggggggctatgtgtgagagtcagggggttggggaggggactcagccccagaacaaaagccacagctgagaaccagagaaggagagtagagtccatgtctaccctgggtttctggggtccagggacctgaaagtcagcacctgctcctcctgtggagtacccctggtgacagagctcagctggcagctgctcatcactaacgaatcccagccaccggcacctgctgctgcttgcggatcttgttgaagagttccatgtactggaccatggtatctgctgggccgtagaccgcatcatgtctgttcccaaacactgcgggagcccctggtgtgtggctgcctagaaaactctgtaggaactcgagcagcagactccagcagtcactagctaccacacaggggccatactccac

SEQ ID NO: 4614 - DNA, 1917 bp, Homo sapiens
tggggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgc

SEQ ID NO: 4615 - DNA, 3954 bp, Homo sapiens
gtaacacacaaaaagtcacaaaataaggctgaataaaggaaaatttattgatatgagtctctcatatggatttaatatcctcgcaaggacaccaggagtcagctatactcttgtgcttgtatgatggacatgccagagctgccttgaccaatcattgaagtaggtgtcaaatgactcagagagttcactacattagaatagatttattgtttttgctttgattttctgatacccattttctgatatgaatttctgttactaagtttagttaactaataccagtgtcccaagagcactgtctacatttcagttatgaagatatattaactgtgagtaattgcataaaatacaaactttgctctctcttcagtggataaagcactatataaatgacagatgcacatcctaaccagtgaccaattgtgtcactttttaaaaaatctttaggtaattagccaatgcatatctgttattaagttcacacacagatggcaaatgtatagttgtgtcatctccttgtctcccagtgataaagccatatgacattttacaaaaatggatacttgaaagagggaaccgcctgccaaatatgaaagtacagcaaggaaacaaaaagcataatgtttgaagtgaaattctaatcaaatgtaaatgggcttatagaataaatagttgactgtgggaatgttgacacctctgctatttatgagagtctagacgtgcagtcagagaaacttagcaaaggcaactgtatcagtctaaatgagaaaagtggtcatgatggaaaggttaaagagaaaacgatgccagtgagaaatttcacatttaagagaactctcagagataattcaacgcattaaaagtagaaaggataaaatgctggaatctgattcaaacttagaaagtactatgaaaatgtgccaaggcatacaaaagatgctcactttatattgtatgtgataggagaggaagaaggccagcactgttcaaactactcttgataagtttttttttcttaacaaagaaataaaaaacttcaatcatcaatgcttttactagataggcacttagtgagagtattattttatctgtttaagcaaaataatcaagagcaggtgatccaaacgttgatgtcagctgccaacaacaacaaacagatgaagtcatgatcctttattcactttccagaaatgaggcagttctcagactcagcattgattgaagagaaagatgggcagtcttgaggaagcagtttgcagtgcctcagcaagcacagacagtagtaatttccccattttttcccagagccacttaccagagtaataatgcagtggtgaaaggggaatactatgtatttccagggctgttggataagggtctgaaatgccattggtatgttttgagagagggagtttctggtgtttgattctgttataggttgaattgtgtctcctataaaaagaaatgttggtgtcttaaccctaaataccttagcgtgtgaccttatttggagacagggtctctacagaggtaatcaagttaaaatacagtcatttgtgtgggctttaatcctatatgacttgtgtcgttataaaaaggggaaatttggacacagagacagatacttatagaggaaaaatgatgtaaagagacccagaaagaagatgccatctgcaagccaagaagagaggcctggaacaaatccctcatagtcctgggaaggaaccaaccctgtcaatgccttgatttcagacttctaacttccagaaccatgggacaatgagtttctagtgtcatagccacccagtgtgtggtgctgtgttatggcagccatatcaaactgatacaaagccataaatggagtcctggcctaagtccatctcacagtgagttcaaaggctgctgtggtcatgtactcattccctgagtccctactcatgatgaacatatttagcagagtcagaaccttcagactggttaattgatctggagagtcagagctgctactggaggaaagactgcatggaagcccttgaaatatcctgctgcctttccaacaaaaacagaaaatcagaagcaagactgcatctcaggtggaatggcagcaataagagataccctcaaagaaggattcaggggtggttgtcactatcgtcattactcttacttctggaaaaaagccagatggattggaacagaaaatgtaaacttctgaaaacttagccaagtttccagctgctcttttggatgtacatttaccagaacagatcaacacagtctcttgcacttggtgtacagaaaatgatctggagaaagtgttcttttcattctttgccagaaaaatttatcagaagcaatcttcattcattcggaagagacaaaagtatgctgagttatattaactctcttgctcttcatcactatatagtaaaaaggtaacttgaatatctaaacattctacagaaaattcatactggtctaccatttagatgacatccacattaaatggaccaggagaaggaagtcttgagtcctctggatgccttggtaagacacatacaccaaagggtgagagagaaatgctacagagaatcagaggcctcccacattggtgaaagttttagaagtattgtggtcttggtccccaccaagctagaaaagctattgtaccttctgttttctaccactgaggaaaatgcaaggtactggaaaggctggttgattagagatctggaagaagtaagatgagaagatcaattacaagaaatctgtgaaagaaaaatgtgggttgactattaggaatggacacaaagtatgtgagtctttgcatcccacatcagtacttacggtgatcatccacatcagagaaggagtagaagacaagacgggtaggatgatttgtccagtggagtttagcaagcttttcttcttggccatcccagtgtttgcacagtgggcccatgagtggagtagccttgtgcaaggagtgaaggtgatgcatgagcctggcagcggaggctccctctcaccagggctgatctaggcactgctactgcagaatggccaaactgtcagtggtaaaaactgatgctgagcccttgataggatgctgtcctctgaagacaccaacctggaggtgacagtcatttgtccttactggattgatacatattttggttataagtctaccttccctggttgagtgttgtggctcatgcctgtaatcccaacacttttgggaggccaatttgggaggattgcttgaggcaaggaattctagaacagtctgggaaacagtaagaccctgtctctacaaagaaacaaacaaactgggtgtggtggtgagtaactgcagtcccacttgggaggctgaggtgggaggactgcttggagccatggctctctagcctggatgacagagcaagacccagtcttaaaaaaaaaaaaagaaacaagaaagtctaccttccttgccatagcaccttgttctgtgccattatctgagggatcagcccatgtctgatttgtggttgtatctcacatagcttcaccttgggtcaagggaccacatttgtgccaaggagtaagcacatgtccatgaaatccacttgtcttactatatcacccagaaattgctggcttgaatgtttaaaaggccactgagaggtcaagcaaaggcatcagcctggagttgctgggtgctatctttaaagatgtggtatataccttgaattaacatatactgctatgtcttccttaggtagaacaaatgcatgtaggatccaacgcatggtagtgtaagttgcctttacatcattactctgtaacccactctgggggaaggtgtgctttccattcccacaactttaagctttggtctcgaggtctaggttcccaagggacaaattaattgtttctgtaaatataagattatagcagtagcctggtcatttt

SEQ ID NO: 4616 - DNA, 647 bp, Homo sapiens
gggcaagtaccagcacctcagcctagtcggtgcaggtgatagttatgaagctaagtcctaggccaggaacaaggcagccagtccagccagcatagttgacccctctatggactggggccagtgcagccacagcattccagtgctcagcccctcagctgggagatcagcgactgctgccacgtgcccagaaatggctcgtcctttcactacagcggaatgcaatgagggtgggtgagaagatgatgggtcggttatttcattccttttctttttacaacttcactttcagagacttcagcgttccatgtctgctgtgctgtggaacccagagtgctcttgcctggatggctgagaatcccttggaccctggaagcacctactccatgatggcccgcaggaggaccaaactggagacagtcctggctctgaggaaacaggaaggaaggagggtgaaaggaacgtccacctgcacacaaaggtaactgtcctctactcagggaagagtgaaccaggacaaagtaactgttttagagagcaaggcagctctctgggctgaaaaatgttaacagttaaagaccttgctaagtcaaagtctgcccctatctctgccctctcctgcttctaggtgaccaaaaaaaaaaaaaaaa

SEQ ID NO: 4617 - DNA, 13059 bp, Homo sapiens
ggaggcgagtctcggacgcgagagactgggcggactggctggactggcagacgctggcgggacggggtgactcaggcacgtcgccccggatgtggccacgaccgccccgccgccgctcaggtgtgcccgatctcacgtctgcaagtcggcggggctggagcctctaatcccaccgctcagagcccgaggcccggccggcccagcccgggagccgagtccctcccagcggctcccccggggaattcccgagggggcgggtgctgagccgccgcattccggggatgccttccagccggggtggcccgggcgcgctctctccgcggcggcgcggggccagcgagccccagggccagccccacccctcggcaggactgggctggccacgtcgccccagcccgagagcccccgccccgcagcgccctgcgctcaggccgcggccgaagctgccgcctcgctccccggagtcgcaccttgctggactggagctcgcaaacccccagctgctccccgcacctcgggagccgcagcgcccaacaccctacgggcccgaaggtggcgcccaagaagtgaaccagaagggaagagcgaagcacggaggctttaatggcagagggcccggtggcggggaagggaggcaggcgcgggccccgtgggcctcgggtcacagcgtgtggaggtcatgactgcgacggctcagcttctccgggtcgtctgacgccatgagggagaagtcgcggaagatgtcaagatacgtctcatctcctgggggagggaggaaaggccgggaggcggctgggccccagtgcagaagggcaggatccggcggttggggcccacctggggacctcgcgctccgagcctgggtgggaacgtgcgcgccgcgggcactgcgccagcacctatgccttgccagggcctggcacgtcgcatgcgcccaatacgcatttgttaaataacggaatgaatgcagctgggcactagggagagaggtcaccgtggaccagaagcccagagttcaggtgttgggcctggggggtggggtgggtgtattctttacctgcctgcccctgggccgcttcagcctccctcatctttgccagtcgtagcctgaagaggagggaattaagaaatgaacgacactatctttggccgggcgcggtggctcacgcctgtaatcccaacactttgggaggccgaggcaggcggatcacgaggtcaggagatcgagaccgtcctggccaacatggtgaaaccccgtctctactaaaaatacaaaaaattagccgggggtggtggcgcacgcctgtagtcccagctactcaggggaggctgagacaggagaatcgcttgaacccgggaggcgggggttgcagtgagccgagatcgcgcccctgcactctagcctgggcgacagagtgagactccgtctcaaaaaaaaaaaaaaagactatcctcacctcccccacaacttcccatcctttgagctgggttgcgttccgttcatctgcccccacccccggggtcacgtctagtgctaaaaagatgcctgacagcaatgttgatgggcgaattacgcctctcagggtgggccaagcatccttgcaccctgcccgccctcccgcctgccttctactccacgtcccagtgcacacttcgcgcagcctttctcgagcctggccccggcgctggcccagcccctttccgaggccccacagcacaggcttctgtttcggcgtcagccccgcccgcccgcccgaacgtgggtgggcgggggtggggggagtcccagcgccagccccgccccttcaggcattcttacagggtgacgatgtcagcgttggctgtttccatggcgatggtcagagggtccctgccttcagagtctcgagcccccagatcagctccccgtttcaggaacaggcaggcgagcctggagagaagagccagggtcagccggccgcccaacttctcccagccttcctccccatgccatcatccctaccccgtgtggccaagaatggttgcgtggtgcagcgggccccggcccgcactgtccgcttggttcacgttcgccccgttctggaggagaaactcacaggccagaagagaattctgcatggagaagtcgagaaggggggttgagggtggcatccctagtggtggatttcaagatgtcttagggtggcgccagttcagagaatgggagggtggagtgtggtaatcaggagtgtggaaggggttacagctaactgtaaccaagctaggcttggctctagctctttgcatgtattcatatataaatccatagtacaagcttttgaggtatgttactattttacagatgaggctgagaggttaataacttgttaaaagtctcctgtaggccgggcacagtggctcacgccagtaatcccagcactttgggaggccgaggcgggtggatcacaaggtcaggagatccagaccatcctggctaacacggtgaaaccctatctctactaacaatacaaaaaattagccgggcatgctggctggcgcctgtagtcccagctactcaggcagctgaggcaggagaatggtgtgaacccgggaggcggagcttgcagtgagccgagatcgcaccattgcactccagcctgggggacagagcgagactgtctcaaaaaaaaaaaaaaaagtctcctgtaagaggtgagagcctgggttcaaactcaggttctctgcctccaaatcacacactcttagcaaccagtctctattgttgatctctccctatgggtggaagccctagggaacaggtggtggggaaaggaggtaagggcagggcccagagtcaggagtaggtgtcagagccctagggtggggtggagaggtcagcagggctcttacagcagctgtggcctggatcagcggtgtggcattatcttggcccccattgacccagttgacatcagctccatgggcaagggcatcagccatggtgggaagagatggaggatgcccagacgctcgaaacagtagggccccagggtgcaggcttcccaggtcctcagaggggggctctgttcgggggatttggttctgttagggggaagcagctccgagtctgggaagaaaaccctcagcagtgtcccaatgctataatgggacaggtctcttctaaatgatggggagcttgggactgtggagggaatagagtgatgcaagtgtgggtatgtgtaagtatgcgtatgcatgtgtacgagtccctagggtgtgggggagagacggcatcatcacctcatctggtccaaccacacttggcctcagctctcaacccctgacgctccagccaaacccaccccctctctctctccttttcttgtgctgttggcaccccttaccctccctgcccacgcccagccccacattccttctcattcttaatgtcacactccaccgtaacccctgaaacggcagtccggtccctccgacattgtccagcggaaggcctgggcttcacactctgtgcctcccggcgctacctggcacgatgccgagcacacagcagatgctcaatgaatgcccaaccaaccctatacctggcttggatctcaagctccctggccggggcctgatggaaggctttgggggcacaggaggctgcccccttgggcgcccccggccacctcttcgccctcgaatctcaggcagcttggtcaggaacttcttctccacgtatttagcgtgaatccaggcctccttctcctgcctgtgggaggggagaagcacgcagtcttccctcttctgctccaggggtcccccattcccctgggaggctaaaccccaagctcaccgggagcagctgggccctggtttcttcactgccatggcctccacgcgggcctcatagatctggttgatgatgacatttcccagctcacacatgagcttcaggaggcccaggcagaggcagagacagggaaggtgggggtgagtgactcctcagggatcacgcccctgcaccgccatgtccttgccccaccccaagttcttgcccccaatcttcacaatacgctaagttaccttcactagttctggctcccatgagtcaagggtcagagaccggactttggagaagtgaacaccaaggctcctggagggccagagggggagggtcaggccctgtgcaggggggcagtggcctggggagctgctgctgctcctgaagacactgggaggcaaggctggcatgggggcccgtgcagaggtgctggcccaggaggcagggcagctgcggccatgtaaccgccatgtagccttgacctggccctggcaggactctgcctcgtcaccattccttcttccttagatacttgctaaggcctcatgaccgtttctctgcctagtcttcactggctcccccaccctcagcagccttgaccccacacttcttccaaccaagccaacaaattctgggtatcccccaattctggccagactaggacacagaggggctaggcccgcctgggtccaactggcaccccagaggcttgggcccaggcctggtacccagtgacaaagccagaagctaagagaggaagccaggacagggaaggaagaggggccggtgtgatgcgctctgtattggagccgcactgtggcccgaaggagtggggctcccgcatgggccttgtggagtaacctgtggatgccggaacactgaatgcagagggtgacaccaaggttgatgctggcccactccggggctggctcccggcagtcgcagcactgggcattgccatccacactctggacctgggccaccacgtgcccgactcccccaggctcccttcccctggccattccaccagagcccagggtggcagcagagcctatggccaggtgtcctgagccctgggggagagaggggaagaaagggtggccaaggggcctagggtaaagggtgccccatctccacaggcagcctggctccgcacccccaggttaaggtacctggcctggaccccgggggctgtcatcaaggcgagcctgactgaaggcagaagcaatgctgctctgcacagcactgacccacagctgcaggaggcgctctgagtcagcctggaggaggcaggacctaggtaggagggtgagggagatggcagaggggtctgaggcctgggaagcaaagtggcagcatgggcagactgacattcagccagtattcaaccagttccagttgcattgaaagacttctgtaccagttggtaatattctcctaaatatcccccatcaccctgtaccctcttccacaatggccccccagtccagccgccaaagaattaaattaaagtctggagctgcatggggggcctccattgtggtgggccctgcctttcagattggcagttgtttagatatattagagtatcacccctggggattgcactcacttgctggtggacaccacctcaaagcagaaccgcctttctgagtcagggcagagtttcactgtgcagagacgaaggtcatccaccaccacagtcacagggtcctggcaggataaggtgataaggggccagatgtccagctgcaggcaagagctgagtctccctggggcccaggcatccaggacccaggtccactcaccttgtacttcttctggtaaaccagttggttgctctgaatggtgaaccagcgtctgtaagagaaggaaatcattacagacataggcagctttaggatgagggacggaagagaggctgtgctttttgcccatgaggatcttactgagaggacagacacctgggctgactgttccacgagacattccagagaagggtggacaattgtgcagattggaacatctaaaggatgctattcctatcttggacaacccagatttcatatagttatgaagacaactttccagcagatggcagtaaaattctttttctaataaaatgtctattgctacaatttaaaaaatactatttaggctgggctcacacctgtaatcccagcactttgggaggctgatgggggtggtggatcacccgaggtcaggagtttgagaccaccctgaccaatatggtgaaactccgtctctactaaaaatacaaaaattagccaggcgtggtggcaggcggctataatcccacctacttgggaggctgaggcaggagaatcgcttgaacccaggaagctgaggttgcagtgagctgagatcgcaccactgtgctgcagcctgcgcaacatagcgaggctccatcaaaaaagaaaaaaaaagaaaaagaaaaaaagaaaagaaagaatcttgggggccaggtacagtggctcacgcctgtaatcccagcaagttgggaggccgaggcgggtggattgcttgatgtcaggagtttgcaaccagcctgggcaacatggtgaaaccctgtttctaccaaaaatacaaaaattagccgagcgtgatggcacacgcctgtggtcccagctatttaggatgctgaggagggaggatcacttgaactcaggggatagaggttgcagtgagccgagactgcgccactgcactgcaggctgggcaacagagtgacaccccatctcaaaaaaaacagaaaaaaaaaaagaaaagaaaaagaaaaaagagtatcttggggaagcagctccattttctaatttgtacagagatcccatgtgggctagcagtggccctagaagggaaaggagtcaagtcacagcatgccaccatcctgttccaaaccctatagcggctcccaattgctctcagagtagaccccaaatccctacaaaaatctatagggccctataatgactcatgcccccattagctccgatttcatctcctgcacatcctcctccctcactctgtccagacccagggccaccaccctgctcttccaactccccagctatctcagggccttggcactggctctttcttctgtctagaactttcttcccccagatatccttcaagtctttgttcaaaagttaccttctcatgaagcccacactgcccaactatttagaactgtaacccctacccagctccccacatcccttgctttatcatctttctcctatagcaagcactatcaccttctaacatagcacgtaatttacatactaggtttatcctctgtctttgctgatggaatgaaactctactgaggcaggggggttcgtctgtttttccttgcagtgcttagtgtgctattaccactcgaaaatacatcattgggtggggcgggctgattgggggtgtcctctcctcacctgctccaggtcttaaatgcgttgctggcccgtttgaagagatgtccttccatcaccaggccaccaggcccctctcttaagcttggttctggctcctccccacccagctcctggaggcacaagaggatcaaagggcaactgagatgggcagacaccaaggccataggcatctgcctcctgcccacagccctagcccttactttctgctttttgaaatactttttaaaatttatttttagagacagggtcttgttctttcacccaggcttaagtgcagttgtgtgatcatagctcactgcagtcttgaactcctgggctcaagcaatcctcccacctcagcctcctgagtagctagaactagaggtgcatgccaccacaccagctaattttaaaattttctgtagagatggagtttcactacgatgcctaggctaatcttgaactccaggcctcaagcaatcttcccacctcagcctcccaacatgttgggatgacggtcgtgggccaccgcacctggcccctcaccttctgtttcagcagcacgtgtctctgctccatgtccctcttctctcgtgctgaattcaagaccagctggtgcaactgggcacaggaagggcatctcagatgtccaaggccccccagttaggagtccctaacctccctctaccacctgctgtgccctggggccccacctgggcgcccagctcctttcgatactgggacagccggctcagctcctcatggccctgctggaaatgggtagcctgggcctccaccaaacgcagcacctgggggacaaggcgggcagtgggaaggctgaggaagaacccctctccccattcccttgtgctggcagcaggctcttctccaccctgccctcacccccgccacaactcacaaactccatgatgtcaaacttcctcttgtcctcaatcacgttgatctgaggacgtaaaagaggacgtaaaaaaccccagatcagtcttgaagacacagcaccccttcccactgcacactggagacccccaagcctcgaggtgacacttgaggctctggtaccccaggaagacagattggggcaggcacctgcagggcataatccagtgcccgtccccggtacccagctcgagccgtcctcaaagcagctcctgcctcttctgcctcctgggcccggcgcctgggaacctctgcgttgtgggtcagggcagcctccaggctctcagccccccgccagaaatcccggcgagcctctcggaaaccccgcagacctctgaggatgggaaaataacacagaatcgcagctaacacccacctgccccagcagagcattcccagggtaaagccctcatgtcctttcagttagtctctgcaacgtgggaaacccaaggtgatccctgggacggaagtcaggacaccagaaacccccaatctcacaactccgtcactggggaggctcctgtggccatgggaagagggcagcagggctggtttccgagaaataaggcccccttctctcccatctcactccccctttaaaaaatttttgttgttgttgttgtttttgtttttgagaccgggtcttgctctgttacccaggctggagtacagtggcacaatcatggctcaccgcagccctgacctccaggctcaagcaattctcctgcctcagcctcccaagaagctgggacaacagacatgtgccaccacgcccggctatttttttttttttttttttttttttgaggcagagtctcactctgttgcccaggctgaagtgaagtagtgcgatcttggctcactgcaacctccacctcctgggttcaaatgattctcctgcctcggcctcctgagtagctgggattacaggcacctgccaccatgcccggctaatttttttttttcgtattttttagtagagctggggttttgccatgttagacaggctggtctcgaactcccgacctcaggtgatccgcccgccttggcctcccaaaatgccgggatcataggcatgagccaccgtgcccggcctaatttttgtattttttgtggagacagtttcgccatgttggctaggttggtgtccaactcctgggctcaagcaatcctcccgccttggccttccaaagtgttgggattacaggcatgagccactgcgcccggccccatctcactccttgaccagggtctggatctgctgctgcagtgtgtgttgggtggcatctagaagctcctgagggaaggagaagttggtagactggggtcaggaccacaggtgacctggccaccaccccgacaatccttaccttcccctacttaccgcatggctgtccagcttgtggttcaggctcacggtgaatttttccagacactcctaggcaagaagaggcacagaaagagtaccaggcatggggtggcagcaccctcccgactcgagacccagcctgctacggctgtcatggacagcagcccagccctgctgtggcctggaacctgcagaccccaggccagccctcctcttccacagcatcacctcctcatcccagaccccttccctcccagatgcagaccctccgcataccgccatcatgggctctggtggacccaggcgggccaggtcacaaatgccgacaacgaaggcgcggctggcagcaaggtaatggcgcccactttccaggagaccagtgcccagtttcaggagctgggaaagaaggagggtaacagggagctgtgccatcatcctcacacctggtgatgcccccacacctgccccacttcctctccccttgcccagggcggcgctcccctattcctgcctggcctcactgccctccaggctcatccagctctccctgtatctaacacatacctgctgtgttcttatcgctgcgtctttgctcccactgccttgggcctgaaacccaattcctgcccattcctctcagcctgtcgccaacacctctgtcagccttacctccaaaacatctttccctgtccactcgcacatatctcttcctgccctgcctacctgcttagatccagagctccgtggagattcctgcatggtctggatgctctacctggttgctattaaattctacagtattggccgggcgtggtggctcacacctgtaatcccaaccctttgggaggccaaggcgggccagtcgcttgagctcaggaattcaagagcagcctgggcaacatggtgaaacctcatctctactaaaaattcaaaaattagccaggcatggtggcacatgcctgtaatcccagctacttgggaggctaaggcaggaggactgcttgaacccgggaggctgaggctgtagtgagctgagatggcaccaagtgcctataatcccagttacctggggggctaaggcaggaggactgcctgaatccgggaggtcaaggctgcagtgagccgagatggcgctactgcactccagcctgggtgacagaccgagactctgtctcgaaaaataaataaataaataaaatctatagtatttactgctaggagttgtcccattctgtgctcactgcacgttccctcataaatattaatccatcatctagaccacgggtcagggccaagaggaaatgccggggtactcctggggcccatcctatctggctcttttgactgacaaagagacttgataggccaggcaaggtggctcagacctgtaatctcaacactttgggaggctgaggtgggtggatcacctgaggtcaggagttggatatcagcctgaccaacatagtgaaaccccatctctttttatttttctatttttgagacggagttttgctccgttgcccaagctggagtgcaatggcatgatcttggctcaccacaacctccacctcccaggttcaagcgatcctcctgcctcagcctccagagtagctgggattacaggtgcccgccaccacgcccagctaattttttgtatttttagtagagacggggtttcaccatgttgaccaggctggtctcgaactcctgacttcaggtgatccacctgcttcggcctcccgaagtgctgggattacaggcatgagccactgcacctggcctgaccgagatcaaatcttatcagacatcaccatgggttgtctgtgacaaggtacaaggatgttcacaaatcactgtgtgaatctgaggactctgtgtctagtttttttccttaccatctcagcccctcccccttagatgagtaagaaactttcataacactggactagtgacagactgggacatctgttcaatagaacagtactcagcaataaaaaggaacaaactgttgatatgtgcaacaacttggataaacttcaagagcattcatcttttaaaaaattatgattatttttagagttgaggtctctgtcgcccaggctggagtgcagtggtgggatcatagctcactgcagccttgaactcctgggttcaagggatcctccaatcttagcttcctgagtagctgagactacaggcacacaccaccatgcctggctaatttaaaaacaaaacagaacattatttagagacaagggtcttgctatgttgcccaggctggtctcgagcttctggcctcaagcaaccctcctaccttgacctcctgagtagttgggatgacaggcatgagcgaccacacccggcagcagcattattctgagtgaggggggagggggaagccaaatctcaaagggtcacatagtgtatgattctatatatggaacattctggaaatgacaaaagtagagagatggagaacaaatcagcggttaccacagattaaagaagtgtgggaagggtgtcgggtaccactgtaaaggaattccttgtgtccattggtgtgtggtgatggttaaaggaatccatacacgtgataaagtaccatagaattatacacaaaaacaccaaaaaagagtatatgcaaaatgtaaaatcaaagtaggatctatagagtttatttatttatttagagacagagtcttggtctgtcgcccacgccggagtgcagtggcacgatctcggctcattgcgacctccgcaggctggagtgtggtggcgtgatctcggctcactgcaacctccgcctcctgggttcaagcaattctcctgcctcagcctcctgagtagctgggattacaggtgcgtgccaccacgcctggctaatttttgtatttttagtagagatgggggtttcatcatgttggtcaggctgttctcgaagtcctgacctcgtgatccacctgccgcagcctaccaaagtgctgggattacaggcgtgagccactgagcttggctagagtttattggggttttttgtttgtttgtttttgtttattgagacagtctcactctgtcgcccaggctggagtgcagtggcacgacctccactcactgcaagctccacctcccgggttcgcgccattctcctgcctcagcctcctgagtagctgggactacaggcgcctgccgccacacccgaataattttttgtatttttagtagagacggggtttcacagtgttagccaggatggtttcgatctcctgacctcgtgatccgcccaccttggcctcccaaagtgctgggattacaggcgtgagccaccacacctggccgagtttattgttaattgtaatgtgacactattaatgtcctggttttaataatgtactagtattgtataagatgtcaccactgggggaagctgggtgatgggtacatgagacctctcctcactagtctcctgagtcaataat

SEQ ID NO: 4618 - DNA, 2265 bp, Homo sapiens
actgaccacacatttcttgccgaggaaagtgaagagggactcgttctcctgcggggtgagcaacagggaccccacgttggtgaccctccgcggcggcggcggctgctgctggacggagctcatggtttcgccggcggggttgggagtccagggccgtctcctccggcgagtgggcgagagctcgttccccctctcggtgacaggggcggggagaagtggagtcagaggcgccacatctcgcagctcctccggagcggggaggaggacgaggtcgagggaagcaggcgctgacggcgagccaccttcgcgccgcgctgagaaagggaagctcccggcacccgcccggccaggctagggccggatggtcgttgtcctcgcactccggcgactgcgctaaactcccaactcctcccccaaccctcccgcagcggcggcggcggccgcacaatccaacatggcagcgggggcgggcgagaccacaggacggagggcgcgggggagcgcgccggaaacgcgcggctgcggcccgggagaaacccccccactcggcggcgggcctcgcggcgcgggcccgaagccacgcccccttccggccgaggcgcggaccgcgcggagctaagtggaatcccggttggcttggggcgcaggcttccaacttcgtactctggcctctggcgtctcggctcgtcggttgggtacccgaacccagctactgctgcttgaagagaagatggatggggactcctcgccgtcgctgcgccgccggccttccctgggcggacgtacacctttgcgaagcgtcagtgaggacccagggcccctccttggaatagctcttatttctcaagcgctgcagcgtgaagctcgctctgcgggtccgagaggcctgcgatctgaagactgaaaactgggaagagacgctctaccctgtgctcctcgccggcttcgataggagccgcaggtgcctgggattttctcaaactttgtcccaaacttcagctgtgggagtggaggaacaaacaggcctctcccagaattgtgaaagagatcgccctggtggatgaaacaaaaacaaatgcacttgacttccaccgcctgcctggcgtgtcacgcgggtttaatgtatgtgtcacatttaaattcaaagtattttcttctaagggcctggacacatttcttttctccctgtatcgtgaattggaaaataccttaggatattaaaagttatctaagataaccccctttcttctgtaagttaaatactaaacggcttaagacgaaattttggaatatagagatgatgatgcagactgcagtgaattatcaaatatgcatctcactgttctccacattaaacatatttttgttgcgtaaattcatgttaagacgtctataacaattacactttggtaaaattgttggatgttaacatctctgatagctcccaatagaaatctctgatgtactaaccagactggtaaaccattatcatgcactttgaaaatataataaaatattataattaaagctgccattaatgaaataggctgagcaacaataaatttacaaaggaaaataaaagtggatagccttgggagttctcacataaaatatggagatttcaaagttaaacttgattaattatgttagggtaaaaagtgaattaaagcaacaggactatttataaaataattagatttagaaagcagtcgtagaaatataagcctggagttgcctctgaattacatatttaacaaacctagaagctaaatcagtttgtcttttatcaaaactgcaactcctctaagttgaaagcacagtgacaagagaaagcattacaaattcttgagaaataatagaaattaaagctcttttcaaacctgtgaacaagtatagtaccagaagtataagattcagataggcccaagttgtagttcttgttatgagtcttacaaccctatggactttggacaaattacttctctgcgtctgtttcctcatctgtaaaatgaaaataatttctgtttcatacaggtatagtctaaatagggataattacacctacttcaaagttgtaaaatacacaattacaactagataggaggtataagttctagtgttctgtagcactgtaggatgactatagttaacaatattgtatagtttcaaatagctagaagaaggatattgcatgttcccaaaacaaagacataagtttttgagatgatagatatgctaattaccctaatcactatatgttatatg

SEQ ID NO: 4619 - DNA, 15189 bp, Homo sapiens
gttggcgagtgtgaagagagaggaggagcgtttgcggcctcagcgtctgtcaacagaaccctcttcacccgtggttaaaccctccctaaccctgagctcgtgctcccctcccggtggacgcagacctgaccacagaagccctgcagcactcactgggggcttgagggagcccctgagtcccctccaccctcgccgccttctcctgggtacccaggaaacgtctccaagggaggctgtgacccaggaccccgcctcgacctcaccttcttctgtaaggcgcagtgaaagacgaagatgaagaccccctggaaggcgttgaaggtggtgaagagataggccatgaccaccgactccttgttgatgaagaggaggccgaaagcccaggcgctggccgtcacctgccctagagtcccagcccacctcatactgagtcttgtcgatcccgaccaggaagagcagctcagccaggaagaggttgatgcacaggttcttgtggatggtgttgcggtcggtctgcagcccccgcaggaagcagaaggtggagatgcagatggccaagcagaccagggagatcacaatgcccacccaggtgatgaccgacagcagcagctcgttgatgcggccctggtactggggacaggaacagggggcacgctcagggcctttggttttgcacgctgggctcagccaggtgccagccacagacagggccctgggcaaggccatgggccgtgaggacctctggtgccgccaacctggcagccctcacccctctgcacgcagcaatgcgctcacttcctcatgctctggaaggcttgtggagagatgaccaacgtaacaccaacttgcttctccagagtgccttgggagacggtgggatcatggccatagaggaccagacgcatggcctcatgccccaggcaagaccaggggccccccacacccatggggctagcctcccctggtactgcccgtgatctctctaggatgccatgcaaagccaggccagcaatcgggcctgcctggaggagcagagcaccagccagcttacgatctcacggtgagccatgagcacagcgaagttggtgaggtggctgcaggcacacgtggtatgggtcttgttggactccaccaggcggcagccttgggtcgaccagtagcccagcatggaacgctccgagtagttccagaaggagcagttagcattgaagtggttcttgtcctgttgtgtggtggcaccagggtgtcataactagagtcagaaccggggagtcccattccgaccccccacacctggcaacagggatggtaccaagtatcaaagaagtgcctggggtctggggctccagttgacattctgagagctctggggacaaatggcccaagctctaaagtggaagaacccataacttgttctggaggtgagcacatggaggggcaggtacacagcctgggaacacagagggtacagggacccccatggagggagggggacggctcagctcacctccaggtgggccacggtgaagatgacagggtccatgaggaagacgcggctggactccttgttgatggatgctgcgatgacctgtgagttcaccactagagaggcgcccccagggccacccgggcctgcttcgccggccagcttcactgtggcattctccgtggacaggaagaggcccaggttgttgtagaggatgaagacaactttgaccacccctggtgagaacaggcacgtttggatgtgtcagcatcctcagctggcgcacctccatccaggcccctggcttcccagctcagccagctcctcagcccttggccacgctggccactgggacctctgaagccagtccatagcccaggcaggtgggggtcagggagccctgtccacaagaccactgctcagctgaaggcagttctaaacagcagggcagtgtgccaggacacacaagctgggcctccgacccacccattctcactgtgtgaccttgggcaagcccctgacctctctgagccttcatctcaatggccccatcctctctgagctgtgaggcccaggagccagctttgcaactgtaaggctcacccttagggctctgcagcacttcagggcccatgaatcccctcaaattttacactagcatgagaaaaggtcagcaccgctgccctctacaaatggcacagagacgctggcacagagctggggggtgggggtggggctgcttccccacccgaggccccgccggggacactgaccattgcggctgttctgcttgatggttttggcagacagctggatggagttctttctcgggtactcctcctgggggaacaccagctcctgcacctggccctctgtgttcaggactgtgacctccaggactgtggggacaggggaaggcaaggcatacacagttggggtctgttcccagtccaggggctcaggctgcagaacgagactctggcaagatgcccaagggtcggatagcccccctgtggcctccaggccagaaccccgtggtttaaggttcgtatctgagtttgccctgggtgactgtggcactcacccacgttctccttggcagccaggaagcgggcaggctccctgacattgtcggccagcaggaaggcgccctcctccaggacgtcgaggagcatggtggccgtgtgcacctgctccgtggcattcatgtccttccaggactccagagcttctggccggagcagattgtccactgtctccaccacggcctgcacaggcagagggcatggtgctgtgagccccccaacaccctctaattcctgggggtgggctctgcatgccctcttctcaacctccacccctaatccccccatcagctggagcccacggtccttacactgggaccccctgggtctcaccttgatataatccttacaagttctctctcgcttgtgcatctagaaagagatggaggtgatgtcaggccaggcctctgggtgccggttccctcaccctaatactgtcacatctggatagctctctcgtctgcggttaccactgacccagggctgggctatcagcaagacattcctcagggatccccaacccccaggaccatccggggcagcacaggagtgagacccggcagtccttggcggagaggggggggtccttcctctctgaggaaaggagtggaggtggcagcctggctgggaggtaccaggtcaggtacttcccaagcccctgggggcaggcgccctccccataccaggtcagcgccaccgccaggccccaccttgttgtagttcttgccggctgactcgcgctcgatgggccgcagggcctgcagctgggcatccaggatgtccagcagctgctccatcagcttcacagaggaggagacgtcccccgcgtagatggagccccgggtgtgtcgggccagctcgctggcgatgttggccgcgttctccccactcttgatctgcatgaggtgggggcgggaagggggaatcccaggactgtcagggaccatcctgccctccccggcttccctggcctgtgcagcctctcctatctctctctccacttccccatcgccatctgccccttcccaccccatctgtccctgctccctttgtaggccagggaggtgaccccacagtcctgccttccagacctgccagcccatgtctccccagctgctccacgacccccgctgggccctgggccctgggcccgagcacatgtgcctgcctgcgaggggtggtggctggtaccttctgggccacctggttgacccagggggaggtgcagttgctgaggtcagggccccgggggttccagagccccaaggctggtagacactggaaggaggcaattcctgcagggacagacagacaggaacagacaagggagccaaagggaagaagagaaggatgggacagagagggggaaaggagatgacagagagtgggggacgagcgggcgaagagggaggtgagggaaacacggagaaacagacatgaagcgggctggacagtcgaaagaggcgccactcacttcccctgagctctccctcctgcccccttctgtctttgcctccagagttagaaccttccagcaaggcccatcttgaacgccccctctccacgaagcacctgccaaccctcccctcagatctccaggacacacggccctgccctttttgcacttcagctggccatccatgtgaagctgactgtgcctggggctgtggcaggtcagcctgaggccgggagccaggtcacctcctgcggactccctgcaggttctgcaggtggggccaggggcactgagtggctcctgtgccctgagagctctgctggtcactggggatgacccctgccctcagaaaacctctgctccgcagtagagacccccacccacacatgcatctgtgctaagctgctgggggcatggcccccatccctcccctggctgcagcctctgtactcacctcgagtccccttggggcagggcctctccaccagcatgccctgctgggtggccggccactggacccgccgtacctctcggggctcgcagaagagctcaggggacacgtgtagattcggggctgggggccgccgggtgctggggactggggctgtggctggaggcagatcaggtcccagctggttgatggcacccactgggtgcgtggtgaggggtgcccggcggagcggggtggtggctgcgggcgaggctgtgctggtgaggggcgtgggcctggctgtggtggtcgtgctgaggggtggggaagtggctgggcctggagaggggatacgagacagggtcatccccatgctcagggccatgccacagtgtgcttgggcagggggtcccaggccatcttagcatcttcctcatctactgaagtggaaacacgtgccgggccccactgggtctatgagttgatctcccctggccgctctgtgcccaccaaagtcccttatgcccatgggcccatataaagtagcaaagagtggtaaaaatccacgatgtgtaccataaggtctgagagaacggtcaggggagaggcagggacagaggtgtctgggggacaggaatcctcccaggttgagcccgagggcaggagccctccccaatccaggtcagccccgccaccaggtgggggctgaataccaccgccccccatcctcgttctagctgactttggcttatgtaacctggctatgctccttccttctgggggcctcaactcccccttttgcaaacaagatggggttagatcgggctccctggagccctggggtggcacagagctagcagggcagctaggcggggcaaaagaagactgcagagttgccctcagcccggtcagcatcagcagctcagctcttttgtggatactggacttccacccaggattttggtggatccaagggttcctggagtaaaggtgcccaggcccctgggagaggcactgcagttcagtggttgggaggctgggttcaaatcctcaaataacttaatcccctacccacacagagcctcagtgtcatctgtaaaacagggcagtaaggatccctgtgtcatagaccgtgaggagacgagttaatgactgtgaagtgcttagaacagcgtctgtcacatgctgtgaatttcctttacctcccgatccccaagagctcacaggatggggctccccactctgggacccaggggtgggtgggggtggaggggacaaaggcaagcaggctccatgcctggaagtgagtcgtcctcaccagcactggggtcgggcggcccgaactccaggctgtagcgcaccacgaaatagttgttccagacgtacagctggttgtcgcgagggttgtagtcaacggaggagatgaactggtaggggttggggaaggtgaggctgacaggctcctcgcggttggcattggtgttgaaggcatagtccacgcggttgccagccgcctcgctgtcatcatccacgtacacggaacgcaggacgtacaggaccccacacaccatgaaggcgttggatgccgagcgcttgtcgtaacccgtctcccacgtgccctcaaagcgcagtgtgtaggggttcagctggctcaccaccagccgcccgttgttgccctcagtggcgtagatgacccacagcccgttctcgtccaccgccaggtcaatgtcggtctttccgccccagcggtagggcgaggtgtcatggtagttggcggtattgatgaccgtctccccgctcttgatgcgcgtccgtaggtcatacttgacgatgttgcgcgtgcgctccttgttgtagaagacggcaccatcgtagaccacaaagcctgtgccatccacgcggttgggcaggcggtaggtggtggtgtggcgggcggccacgtagtcctcccacgaggcatactcagtcagtgtgtccgtgcggtaggggatccagggcatcacgtagatgcggtcacccgcctgcagcgggtccttgcaccatgcgccagactggtgctctgactcgtgtgtcgaggtgggctccagcaccttctgcagggtccctgggcacacgaagactgggcagagtgggcgggaggggaggaggtaggagagaaggggcagaggcgagagggaggagagagagagagagagagagagagagagagaggggggagagaggcaagttggtcacgctgctggtggggagccaggttgtcccctcctgctgctgcagtcacggttgcttggtatggctggtgatgggaagggggtttccgggctgggacccgaccccctccccacgccctgcccagctgcccctctccctggaaatgtgaaccctgaaggccattaagagcggggttagtgaggggaagtggtgcccctcttcccttccctggctgctagagaccccacaggctggggaggagtttggcaagagccctcccagaggtggtcctgtgtgatttaagtgggggcagaatctccccgctacagtcactcctgactttgacggtccagggactcagcacccggccccttctccctcttctctgccacttagggaagagctagggtccaggatcccatccttcaccaaccacacccggacagtgtttttttttttaactcctctttcttcctcctgcaaaaattgcaaggtagagtggtgtttccatacccactgtgggtgtcaggagtgtctccctattccaggataggggtttcaactctctccccaggttcctgatgcagcctgctccccaccccccacccagtacccacgaagtcagtagccgaggaagggattcccagaggcagctcccaggctaggacggggaatgaaagagtctggcccctcctggagggcgcccagccctgcccccagccggcagggtctctcatggggtctggctcagcagcagacagtggcactgtgcacaggggtgggggtggggacatggagagggacagggctcccgggagagttggggagggagaggagagctgtgcagagggaagagagacaagggcgtatggggcttggcgaggtcctggctccgtgggaggctgcgctgcaaaccacctgggaagaaagggttagtgctggcggaggagagaggggtgagcagagaattcactccaaggcccaggcccgactgagggtccctcaggggggcagtcccaggtccagctcggagggggcaggggagggaaccaggcgctaggataaagacccagcccgccccagccaggccccccacctcccctggcccggaccccgatttacctgcgaccatccccggctcgggaagagggaccaaggcagcgctgatgtcagaaaggtggggggccccgccccacccccccaatccctgaaaaggaggaaaacctcaactgcatctcgttggccactgctggccggcccacccttgcccagtcacgtcccagcaccacctactcctaacctccccttgactgatccgggggtcagtgtggccagacaccccacctcctcccagagtgcgcccctccatccaggatggccgggcctccctcacctcctggctggcagaacccacacataggccagggcgagggcacagggcgagggtggagggtttgcagtgaattctctgctcttgcttggcatgtcaccaaagcagctggccccgaggggatcggggggctgggacctggcaccggcttggggggcagccccagtggcaagaggggcttgggctagtcctcattccccacctccagcaggcttgggagggagggggacaggcagcactcccttcacagcatgggaacaatgtggctcaggggccccctggcacaaagcagccaggatgtagtttttgtagagggagaggagcctgggacatagagctgggcaggagccaaaacgaccctggcttgggccctggggactggccatccccctgtccctgatgccctgaggggtcggcctgcccactctgtccagcacactggcctctgcccaagccggtccccacccccaccaggtgtgtggcatctgaggggacgtgtttgtgtgaaggggacggtgggaggcctcagagcctaacctgctcagagggtgtcaggggggaaaaatgtggttagaggtcaacccaggggaagggggagaagatgaggaagggtctgtctggggccttggacagcaaggacccttcaccagcaccaaactcccaatccctcctcttccctcccttgccccgtcaccccacccgccctgccctggccctcgaagagaaaatctccagtggtgccgcatccaaaccagtgggcctgcaagaagagtggctggtgctgggagggagagagactccaggagaaagagaggagactggaggggtgtggtgagggggcggacctggggccagcagcccaggcctctctgagatgggggagaggggaagacggggaggggagcagctcagagggaccctgccccacctccttcggaagggatgctccacagaccactgtaatttcaaggcaaaagggatccctaaaggccatgtcctccagccctgcctgctgctgccggcctcagatgggtaaatttcccaaaactttctggagaggaaatggtcatccctaacatctcaccctagaagcccctcagcagcagcacctccgctccccccaataacagccagtaatggccagccccatccactagggagttctctgctagaaattacggagtctgtggaagtccccagactgtgcccccgccgcccgccgcccatctccctggtcctctaaccacaacagcccagaagaaaccctgactgcagctttgcaagtgtgaaagaaacagagaacacgctcccccacccttcgctcccccaaccacgaggcccgcccccgccccctcgccctcattttttcattttttggcaggctgccccctcccagggctggggacagctgacacccctccccagggctgggcccccagctggtcagagatggggatcaggttgggggtggggaggactggtgctccatgctccaaaacagctctgggccttggaaacatcaaaccagaaggaacttaagccaccaggagcccgagacataggagaatctgctccccaaaaggaaaacaatggtgtcccctccagcccgcctcccatgaaccagaaacatgttataaaaggtacaggggaaggaggaagagagaggggagagacagagagagagagagagagaaagagagagagagagagagacagctcacccggtgccccagtgggggagccggggaagggagtccctccctccccacccgccctggatgcttatacacttctcctgaaggaggcaaaagaagtatgagaaaaggccaggtcccccgaaagggccagggaccaggaaggagggacagagagagacagaaacagcgagagagagaaaatcctgcccaagctcagagaggagcttccgtgggtatctggagggtggagatgcccgtggccgcaccagggctggtcccactgggaggacaacccagggtgggggataccgaccggaccaagtgtgggttggggagagaagaaggggccgggggagggcaggtcacataagtatggtacaggtagaacaaagtgtgagttaggggttagcattggtaacagtgcgtttacctttctgctccacttctactttaagcatcggaagagagagagaaaacaaattgaaaaaaaaaatgtgcaagaaaaaaagagaaaaaaaaagagattaaattgctttcgtttcttttctggcaacacgcccccttttcctttccttcctcgctcctgcttccccaaccccttccgtagcatcagctcgggcccccgcccccaggtcccttcctctgggggtggtcaggtggggtgagagggtgctggggagacagtcagagggacgagggggacacacacaggagggagaagacacagaaagacacaggggtggtaggggggtacaggcaggcagacagagccctcaggtgggaggtgggctccggtcagagggggcaccagggagtggtggggtggataagccactcggctcccttcccaccctgcctgctgccctcctgctagaaccaggggccccaggggaaggatttcagtgtctcccagggcctgggcccaccctcagccaagaaacaggctgaactccttcccctttatgctggcctcacccaggtccagctgacttcccccaagccctcacaacccagaagaagcaaacacagagagaaggtggcagagccagacacagaacgacaggcagacgggcagttgcacccgggccccagagagagccagggttggggagacggaggcagagaggtggcgggggtgggggacacagactgggtgggacagcaagtgggggcacagacacgctcccaggctccccaggggcaagtctgaggctcggcttctctgctcaacccacccagggcccgggggcccaggagctgggagctccgccctgcccgctgccctgcggacgggcggcacctaggggaggaaggggcgcggttagactgtgctcagctgcaaagcaaatccagcattagtcgggcttgtccactgtgtgggagggttcccacacatcacgtgccccctgccacccacccctgacccaccctcaccagcactggggtcacccccagcctctgaagccctgggccaggtggctgcccaggccgctccccctctgcatccctggcccctcaggaacttctgactggagggactggctctcctggcccctctctgaaggttccagcagggagctccgcaggggcagcctctgcctcccttcccagcgcctcacccagggcctggcactcaggagatgctcagtgaacattttggggacaagtgagtgcctggcctccctgtcctctagctacctcctgtccccgctttaactccagcctccttcctctggagcatcaggagttagctctgcccccaacatccaccccgtatgtgtgcacacatgtctgcgcgtgtgtgtgtgtgcgtgtgtctcctgtctccccaagggctcaggctatctctcttccatcagacaggcagccactcatcctctgaactgtcctgccctctgtccctggagcctgcctggtctctgtcggttgtagcccctggaccacgctcagggcctcggctccaggaggtttctcagctcctctcctcccctagcttctttcctgcggcttgacctgagcctctcgtctacttgctttggcttccacctggaccgaggaatttttcctgccctttatctcacctgcctcgggagaagttgggtcattatccgttgttattttaattttgattaccacagcaataatcgtaattgacaagaggcattacaaggagctgcaacaaaagcaacgactaccaagtgtccagcactcacgaggggccagcaactatgctacgcacctcactggccgtcttttgagaaccctgtctacagatgggaaaactgaggcacactgaagtgaggccacatggctggcgaaagcaggcaccatttcctttgcatctacagctcgggtgcacacaagcttgacatgcgttgtcgctactccttgtggcttcccagggaaggcttttgacccctctccaccccatcacagatgaataaacaggctcagctggcttaaagggcattggtaatattactgagcacatcctgaaccaggcatgggtctgggcgctggggcggcgggtgaagacgaagcctctgcccttgggaagtttacactcggcactcaaaaccctgccaccaggagcgactttgtggccggccctgggccaagcgcttctcacatgtcatctcatggactcacacctccttccgtagtggcccagagaaattaaatcatttgctcaaggtttcagagccagaaaactcaagagcccagtcgagccttgaacctacacccatctgactgcccccctgtgctgagctcgctgcctcccaccccccttccccgctgtcccagccgcgggagtcagccgtgtccccagtgctgtggggaggcttcaaggagcagatgggcatccccctcggtggtggctgaaggcctcaagcgctgaaaggaaaggacgaagagtaaaagaagaaaattacggaagcacagaagggatcctgtttccccagcatcgagtcacctgtgaggagaaatcaaaggctggcagggaaggttggggtgggaggggagaggagggagagttacagggcctcttagtccccaaacccggcccgccacactcagacaccctgatggccctgccttctccccactcttcccggaggccctaccaccaggttgactacatggaacccattgtgggaggagaagggaagggataatgggaaggagggagggaggagagagggcaggaaaaaggtgatgtcaagggtggggtgctgaggaggagagaccttgtctttgtctgatccctttggccaggtgcaagatggccaggctcctggctccccaaatcactttcttcaggctgcctggaggccaccctcagtccaacatggcggcatttcctttgcagacaggaagtgccacatggtaatggggagaccagtgaggagctatgaatctgttgaaaatgccccccagcccttcaccctgaatctgccaccaggcctcagaggatggtatcccactctatgggtgtagagtccagcttccatgattgggaagaagtgtgtggggagtgagggtgctgagagaacggtgttgagaggggcagtggggtaagtgagagggaagagaaggtagatgagaagggtcagaaaaggtcagaagagtcagaaaaggaagggatgtgagaaggcgagggaggcagatgggggagaaaagcatagaggccaagggagaagagagagacgtaagtgtgccaggcagagcacgggaccatggcctggcagtgtggaaatgagtatagggtgcatgaagaagcagggtgagtgggctggggtaaggagagctggagaaggtgtccccacaggaggggacagagtctgtgaggcgggggagcaggcactgagtgtggacactggtgtctgggattagagaatgtgtgttggagagagcaggcccggctgtccccactgtgcccaggccccatgcatgtgtgcacatgtgtgatgggtcaaggtgtctcctcctcactcactcatgcgagaagggcccgcatccgcacaaggaacaagatgactcactgtaggggacacagtcgtactgcacctccaggtacttgtaggtcccaggacaggggtcaggaaaggcatccgagccggcgaccaccacgcactgggtgcggttgttacaccttcagaggagaaacagggcattgggaaagaaacacatagacggggtggcgggggtgggggtgcatgctccagggtcatggtgtcatagacacccccaaattgggaaggggcagtggagctggaaaccaagtgatatagtttggatctgtgtccatacccaaatctcatgttgaattgtgatctccagtgttggaggtggggcctggtgggaggtgattggatcatgggggcagtttctaatgaatggtttatcaccatcccctccgtgctgttgagatctggttgtttaaaagtgtgtagcacctcccctgttctcttttcctcctactccagccatgtacggcgtgcctgcttccccttcaccttctgctgtgattgtaagtttcctgaggcctccccagaagcagaagctactatgcttcctgtacagcctgcagaactatgagccaattaaatgtcttttctttataaactacccaatctcaggtatttctttataccagtataagaacgaactaacacaccaagcccagaggacttgtgtgggcactttttgtttcctgcctgctctctctttcccaccagggttcttctattttcagccccagcacagcatcatcctcagggctaagaaggaggagtcacccgctaaacagtgctttcctggccacccctcatctctttcattgtgagtgtagctgacactattatatccttggcatttttctttaaatggactttaaagcccctgcgctgttcactggagagtaatacatgtgaagccatgcacgtgaggtggtgtctctgcaaacttacgatcaatgaaatgttcagtgtccagctgtgtccacttcacaccatctcgtggacacatcccaccctttgggcagtgctgctgtgcagacttatagccagggcagccaggagagagcatccccaggggaaagccattctcggttcccaagaggcaactcctccaagtcactgtcaacttcccagggggctggctagcatgtaagggggaacctatttaacaaaaaggtgtgtctcatctgctgtctgtccccactgtcagggtctctgtcccttgcagcaggctggggctaggccaggcaggacacgggcatgcaggacatagtttgagaggcttcccgacaggtatggggcagaagaggccctgtgtctccccttcaatcctgctcttaaccaagggtactaaacacaggcagacacttgagaagggactaaggatctagcagggagagagaaaaatggggggc

SEQ ID NO: 4620 - DNA, 13330 bp, Homo sapiens
ccacgagtcaacccaaaagttgctggggagaagttgctctttaatgaattgcatctcatgaatgtatcaggctgtgacctttctgcactctctaatgagttcatgaatttaggccaattatggccacaaatgctgctgctgtcacagagagatgccggataaagaacacccaccaccagtctctgaacagggaggggagaatcaactctgaatgtgatgtagtggccaggagagaggaccatgttcaacaacgccacacagatgcaaatgacttgtttcttcaacaaactgcaagggaaaaaataaaaatgggggaagctacagattaaaatacatgtgtttggataggagagtatttaatggcaaaagaaaaagaaaaaatttaaaaatgaaattgtgcaaaacttatttgaatcctgttcaagtgagcaacaaaacattatgatgtacatgagacaactggaaatataactctgactggacactttgagatattaagcaattaccgttcatttttacatatcaaacagtatggtattgtggttacgcttttaaaaagatttgtattttagcgacacatactggaatttttacagggaaaacccactgaggatgctgggcatcaggtcactagcaccgagtgaattttttacaataagcagtaattctccccagccccatgcatcatagccaatcctaaatgaatgccaatctggaaaagaccaaaataaaccacgtgaagatgggaagagctgctcttggtgatgggagaatggggactctctcttttattgtgcaaactccactttccatcatgcaggaaaatccgtcttgaaggcagctcctctctgtgccgggggtgggtgatccagcctaagctagaatggcggcaagctcaaggcagctgtggccctcaggagagcgtctggagtccacagcacagtgggaagcgcaacggcagctagtctgagggtctggacgatggccatgcacagatgaggacagaggagccactgtagtgactgaagcccacggcatccaccctctccagccagccccgcccacacctgaagcccacagcgtccaccctgtccacccagccctgcccacacctgtggccttcctctccttcctgtttggtgagtgctgcctccacacctggctgcatgccagaaaggcctgcacaggtcagaacacaggtttccaaaccctactccaagtctgaacctccaaggacaccccgagctccccaaggttcttgcatagagggcacaggccagagacagcccaggtgggaagcttactctgagtcagctgccctcaccaagatacatccacaggctcctgtacaaggagaggaggcagaagtccctctctgccaggaggtcctcctcaatctcccaagcccacaccactgccctgctccatctcccaccacctccccctgcagatacgggggccaccctacccaccccacaggaacgatgggaaaacctgcctccctctaggaggagggcgtggcacagctgctgcgcgggtaaggaacctcgctatgccttgctcccatcaacacttttattctagatttgaaggtgttttggggaagccatctctgcacaaaagaagtcaacgcaggaataaattccaagatactgaactacctcaaacagaaaataagttactaaaattaatccgccacataaattatagttttttccttttcctcaaacaaggggaaaagaaccaccaactcatctatacgcacaagcaactggccctggtttacaatgatgtaaagacttttagcctcctgctaccaaaaagcaaaggtttatttcatgatttcttctttcttttccagaggcaggctcttgctctgtcgcccaggctggagcgcagtggcaggatcacggctcactgcagcctcaatctcccaggctcaggtgatcctcccacctcagcctcctgagtagctgggactacaggcacgcactagcacgcccagctaatttttgttttttatcttatatagagacagggttttgccgtgttccccaggctggtctcaaactcctgggcgcaaatgatcgacctgcctcggcctccccaagtgttgggattacaggtgggccactgtgcccaagctatttcactatttcatcagcgcacttaaatgcccgttttttttaagtggctacagggcaacaagactatccctgtgccaaataccagattccaaagaaactctacccacgtcacaaacctgcacgtggatcccctgaatctaaaataaaagttgaaattatgaataaataaagccttgcaataagggaggggaaaaaaaaagaaagaaaatccacacgaagggaaaaatgcccagagcacagcccagggaggtggttcctgaggctggctgtgggcacagcccagagagcggttcccgggactgactgggggcagagccagcccgcagcgctcctgaccccacggaatgttgtgggctcatctctgggcaggaagtcagcacaaggacagcaagacactgacagatcctaagaaagcttacgagacagaagttcctgtttggttcaactttgtcacagacaacactgagggagatgaggttacactgtgtacacagaaacaggattaccagtcagtaagacggttactatttaacaggaatgagtcaaacagatcaaggtttcagggcatgtctgaaacgccaggaagaccgccctggctctgtgcagctttgggcgggaggtgcgcactctggcatgccactggacggggaggggaacggggctacaaaaggcagcggacggcagcaggactaagccaccttagacaacaagaggctccggcttgattgctagtttcgatcttagccccaaaagggtgatgttttttatttctttatttatgagacggagtctcactctgttgcccaggctggagtgcagtggcacgatcgtggctcactgcaacctctgcctcccgggttcaagcgattctcctgcctcagcctcccgagtagctaagactacaggcgcgcaccaccacgcccagctaattttttatatttttagtagagacggggtttcaccatgttagccaggatggtctcgatctcctgacctcgtgatttgcccacctcgacctcccaaagtgctgggattacaggcttcttttattttttatttattactactattttttaacagttgatcgctctgttccccaggctggagtgcagtgggatcatcctagttcactgcatcatccatctctcatttcagcctctcgagtagctgggactacaggtgtgtgccatcacaccaggatgatttttggcttttttgtagatatggagtctcaccatgttgcccagtggctggtctcaaattcctggcctcaaacgatcctcctgcctcagcctcccaaagccctaggattacaggtgtgagctcccatgcacagccagggtgatgtttgaggattctgagagaagttcccagatccaagacaaggtcttagggcctccatgactgtgcagagatgaaagcaccaactgacagaatctcagccagagccctgagtgtgaaaacacagggctggaaacgcccagaagggaaagataaggcccggtggaggaaacgagcaactacctcaaggtgccaagagaggccccacaggcaccagctgggtacctcccagcacacagaatacagggccaattcctaagaaacagaaaagccgagctgagtccagagtgcctgccttgctgaagggcctgctctccacccagctgtgctctcctccagctactgggggccggctggccgtccatggagacgaggccagaaccaccactgctctgtgctcacggttccccttttccacacgagagcagctacaacaacacggtcacttctgtctgaatctttcctccaccaacaaacctgcactcgcgtccctccaaaccgggctccagcacctctcacccccacagagccctctatggaggcctttctctgacgggcaccccaagcccaggcagaggcccatgcaccacttggaggcccttggacccagcctcttgacccagacagactccagcaatcacccgaggttcaccttcaaggtcacttataatgcacacagcagccttcagcttccccaaacctcatcccaaggctttatcttctctctacccagcactcgggagcactcttcagaatttcagctgcctttctttacacctccagagtttgtgatttctacccaataagcacctgaagggcatcgagatacccccggccggctaagacaacctaggccacttctctggcccgagtggactttcagcaacatctccgatggagttgtcacaacatggtccgaggctagaaactacccttgggaacaggactcggaggctttgtgatgacaaacgtgcacgtggccagcagggagacagacggacagctaacggagggagcgcaccgaggtacagggatgtgcgcgcccggatactacctgcaacacaggcaggaggagccaggagctgaccacaccggctccacatcctgcacgcgggtggctgggtacgaatgtggccccccacactgtccagaagacgagtagggaggatgaaccagagcaggcgccgaggagaaccagcgacctcccactctacaccaacacacactgcctggggcccccccaggaagacctgctggcgtggcagggtcttgcccagagaaagttcaagatctgtttgagaacggccaaggtatccccacctcagtcgttgatgaagatgacacaatgcaaacactcctcagaagtcgctttccatctgaagcacagagccaggctctgctagaaataaaactcacacaccttgtttgctctctggggataagacttttgctgttccaaaatctgtgatctggatgtgcatatcttcatttaacaaaatgttttccggtttaaggtccctgtaaaagcagattttcacatttgagaagaaatacttaaaacagcaacattattacgtactctaaattttgctgaaaacaaaatgaacgaatgaatgtatatgatccttacaggctgacaaccagggctacaggcctaaagctcacaagcaacaagtgttggctggacacagtagggattcaccacctcacatctccatgtcattctaagtcgttttttaacgaagtaaaatctatcatttttaacgcacaaaatgaaagctatgcacacttctgagctgactttatcagaaagtcatgaaaaacgagaccagaaagaagtacacacagaagctacaactgaaaaagataaaaagcatcagtcaagatggtgaaaagaatcattagctcgccaggaaagacacgcaaccattgcatgtggtattggcaggagagcctctccacgtcagcgctccgtggacgtgtggcctcgccttggcactcaggctgtggcacaggcaggcatctcagtcccacccatccagggagcactccaacctggctgacctcaagggcgggggccatctgggcatcagccgtggcctgtgagccaaacggtcactggccctgatcatcaaactgacgtcctgcaaacccacccagccacccccgcggttacctgtgaatgatgcccttgccgtgcaagtactctaaagcagacacaatctcagccgtgtaaaatcgggtacaggtctcatcgaatgaaccgattttgcgaatatatttaagtagttctccatttttggcataactaaggccgaaatctgaatatcgtgcagttaaggaagtgtaaaaatctcttgtttcgttttggagcaggtttactccgttgcccagactggagtgcaggggcacaatcatagctcactgcagcctcaacctccctggctcaagcgatcctcccaccttaaccaacccaagtggctgggaacgtaggtacgcgctaccacgcctggctcatgtgttttattttgtaaaagtcatttttggaaaactaaccttaaaagtctgataagaatttttaattcagtgcaaactgaaagtacctgtggcccaagacagtcatgtcactggatctgccgggcatcccaggccccagctccaagacgaggcaccagcatgatgagggctttctcattaagaacgccattacacggtctcgaggaaacaggaacagagcctctcagccccgactgcccctctggcccctggccgtgtccacggcctcagtgaaagggaaccgctggtgacagggcctacagaccccgaccaaaaagcgcatataactcacgtgcaggcttcgatgcacaaagaccccgggggccggcggagcagggtcggagagcgcgacagcccctgccctgagaccccggctttatgtgctacgcatccacgcgtggcactgccccttccatgcagtctccttccgtggataaagtgacacattttgttttgttttttttttttaagatgcagtctcgctctgtcgccaggctggagtgcagtggcgctacctcggctcgctgcaacctccgcctcccggagtcaagcaattctcctgcctcagcctcccgagtagctgggactacaagcacgcgccaccatgcccccctagttttggtatttttagtagagacggggtttccccaggttggccaggatagtctccatctcttatcctcgtgatctgcccgccttggcctcccaaagtgccgggattacaggcgtgagccaccgcacctggccgagtgacacactttgtaagacaaaagccatctcatgaacttctacacccatgaagtgtgtctgggaggccccctcctctgggcaccactgccctacgatggctccatctgtagcctccttttccaagaggacttaagaccgacaataaatggatcccagatacagattcccctgcaagcggcaaacgtccatccccattaccggaaacctccagatacttcacacttactggcagcccaggacacggggacccaaatccttgcctgccctgagcagtggctctcgaggccaggaaggggggctcgtgctcagagccaggctggcctgcctgctcacttctgtttgccagggcaccatcatctcccaccaaggatgaacctgaagcttcagggcaacgaagagaaacccagaagcgaagggacttgcaaccaaggctgcccaaagtggcccctgtccaggcccatctctaaatacaacccacaccgaggatgcctggtggggcagaagtccctgggtctcgttcccgtcaggggcgagtgaaccttcacaacctcccggggctttggaatttgacttaatgatgaagggcaacatggaccactggacaaagacctggagttcccactacctgcaccgctctggccaatcccatttggaaatcagtcagcaagattcactctcctctggactctgagcccccgggaggagaggatgggagaggtcaagcgtgtgcaattctgttgcagcctcacaaccaacaagcagccgtgttccgacggctctgcgggaagcccagagggactcccgtggctcatacgggggcagagacgtgcagggccccggggaacgtgaaggtgagagacagaacataccgtgaagaagccactgagagtgggagacagaggcaggaacagggatgacactggaggacagcaggcctgcctggaggccagcattctctacaaccttccacaaaccaacagcaaagcccgctccgggccacgtgcctggcagctgctcggccactgccccgctcctccctaggcaaaatcccagggaagcaccttgcgtcgtttccatttcctcacctcttactcttccttgaacagtccccccaagaaactgcctacccaccatcaacaactggcacagggcagatccacgggtcaggctgtgtgcacctgaccgcttcataacccctgcgtgggcagccagcaccctccatcagaaatcgtttgatcccgtggcctctgggtctccatcattcgagctcgggagcaacatcccatcaccatctcctctcctcggtgggcccctcctcgtgttcacccctgcactggggggaacccaggctccactcacagaggagccaacctctgggcagcctgccagctcgctgtgaaagtcctcacggccctgactcctcctggagctctgctggcagcacctaagtgcccactcagacctgaatggtggcaccagcggatgcatgaaatgccagcccagcacccgccccggtctctcccagctcagcagcagacaccgctgtgcactaggcttgagggccacctcccaggagccgcccctgactccattctcttgaccggtctgttcatcagacctcgaccacggcccctgcccctgctctcctgcccgttctcccgcctggcctaggagaagccacagcaaaccccacgttccccgccacaaagagaaggaagtccagagtcagtgccaggctgccacggctcaggggcccagcccaccacagcctttcatgcccccccacacactcctgcccaggagctgaaagagccccacactgccgccagcccctacccagccctaagactcttggcagcgcatcttgctgccgggaagcctctgacacggatcgtcagtgcacgtccagctcctccaccaaaatcgaagcttctcgtgggcagagacgccacccggcatagcagcgcatccccatcacccatcaacctgcacttggcaagcacctccaaacagagagagcacacacactccgccggcagccgaaggagctgcaggatggtgctgagagtgggagcaggccagaacgaagctctaacacagaagagccgggtgctggggagagacggggaggacaggtgggaggactcaggcccctccccaggcaggatggggaggccacgacacttgggccagcttggagggtggcgggggaggagaagagcagatgcagactgcacctgctgggggtgacgacggtgtggcgtggccagcccagccactggcaggcccacaggtcagctggatggggcagaggtggggcccaccccaacttccaccgggccttgcctcccagattcctgagccaaggtttaataacagaaaagatggcgctctaggggagcaagggacgccgaccaagcaagccgcagcagagaggactgtgctggagccacatcggtggcttctccgggaggtaacgtcctgtgcagactcccagccacaccctggcgctgcctcggctgcctccctgaatgtcagcggcctgagggaccccactcggcagggagcgggggctgcttgtgggaacacacagggtctgattccaagtgagaggggtgactggtgtggcttcagacggcaccaaccacgcaaaggatacacagcttctcgtcgtcctgaaatgtgaagtaaagcttaacaaagaaggggtgatccaggcgcgacatgacatcccgctctctggttacataggggaccttgttctcttttatgatatgtcgcttctccagaattttaacttcaggtgagagagaagtgagttactatcagaaacaacaaaaaacactaaagacatgactcacaaaggtaactggtacaaattaaagtctttcaaacattgtacacaacagcctggtggtctctaaagccaacagtgtcctgtaccctgaaatcagcacagaaacaccggccctgccaccccagccgccctgcacggagccgcttgccctgctcccggacgcacagctccctgcagcccatactcactcgcatattctctggaggttgccagttctcgagccaggacaacctggttgggaaagaaaaggagaaaaagaaacacacaatgtaataaccaggacactgggcctgacgagtccctctgccccacacgcacgcttcctgtccccactgaaggcttgagtctacagtgaaatattttgggtcttgtactgacaagtagagctaaaagccaatgctcgtgttgatgtgttctaacagctaagagaaaacatatccatctctctgttgtttccagaagcttctggatcagctgctaacagccctaacggtgcaacacaagtacaaactcaggaacctcttcgactgccacgcccttcaccaacagaaggaagacagtggcgccaccacaagtggcagggcacaggggcttctgtgacaacaatatgtccttctagtatacattcattgcaaaggctgccctgaagtttcgtttttggaaataactgttatcatacattttgtatgatgttgcttgtgggcaccatgaagagagcctggctgtaaaggacagagggagctaaaccagcaatgcatggccctgcgtgcccacaagagggagccacctgcccgggatgcagcaggcctcctgccctgtcctctcagcacccctgagccctgcactcaaaccccacctccgagacagagcactccagcagggcaggcatcccaaacaggggagagaccctccactcggactagcctggggcacaccctgaggcaccagactggagattcctggtgggcccacggtttagccagagagcatgaggcagctgtgccagggaggccccaccaccaccaagtgggacacaagtgtctcctaagacacccacagggggacggcctgaggagcagggagcagaggaaacctgtcccgtgacattcctgggggctggcaggaagaccttcaggaggccacagggccaggtccacctggccccgggctgtgagccgcaatcggggcaggactcctgatgggacacgtcagaagagatcctggaaagcaccatgtgagacgccttgtggcactcaagaagaatgaagttggattctggggactctacatactcaaggtcttcccagaggaatacgccacgcatggatggctctcagctgccagggagaaaggggaagtgggccgggcagggctcccctctctagctcatgtgtttctgtgaggtcacgtttctccacaagagcacgtgctagcttcataagtagaaaagaggaagaaagaattgtgaacgagcaccgatatttagtggaaccctttctaaggggatactgatgtgatctttccgttgtctaaactcaacacttcacaagcaggtttcctacaagaaggaaggatcctcttccagagaatggcgcgtgacgtgtccctccctggaggttgtgaccgtcctcagggggcctcccggctctccggtgctgcagctggctcttgcccagcctcctatcactgtcctttccccctcccctggaaatcaacttttatgtgatctccatttcaggaaagctgagaaagaactgagggtaacacatgtaatctgagacccagtactgtggattccaaacagccccatggaggagcctccggctcaccgtgctctcccgggcacctccctggtgcaggttcagaaagacacggaccacagcccctggagggacagtgcctgctctccacccatctccagaacccagggaaacaggcaatttcacagatgagtcttcctttttcagtcaagataaatgttaagggccatgtatggtggcacatgcctgtggtcccagctactcaggaggctaaggcaggaggatcgcttaagcccaggtggtgaaggctgcagtgagctatgatcacaccgctgcactccagcctaggtgacagagcaagactctgtttctaaaaggataaatacatacataataaaataaagttaaattaaaaagagacatacaaggaagtaaaactgaggccaagcacagtggctcacgcctgtaatcccaacactttgcaaggctgaggagagaatcactcgagcctaggagttcaagaccagtctgggcaacaaagtgagaccctgtctctacaaaaaattttacaattagctgggcacggtggtgcattcctgtaactgcagctacttgggaggctgaggtaagaggatcacttgagcccaggaagtcgaggctgcagtgagctatgatcatgccactgcactcaagcctgggtgacagagcaagactctgtctcaaaaaacaggtaaagctgagaaaagaggaggcctgttctttcactgggtggttgtaagcagccatgcagaatgcccaaggttttccaaagagtttcttctttctgaaaggatctgagtccccaaaactttggggactagtctcatggttgaaggcatttttcatgagggcataatccttttataaaaaaattatttcataaaacctgcaatttaaaaaatctaaagtgtaagggcagcaaaagttaacattaattaaaacaatatgttgggaatatgggtaagctatatttcatgtttttctttgcattgtgaaatatttcctatgtgtaaaaaagagaaaaaaggaaaataaacctcacctacggtttcttcacaaaggtcaggcaagaaagaattattcaggaactcacccaggccctccagagtgaggtgcccccagggctccctggaatggccctagcacgcacacggcggccaccttggcgaccacagtggcggcacgggactctgtctctttagaggcccagatggagacagtacaccccgagttgctcaggcctcccctgaacctgttacaaccttcactaaatccacaaccacacacggcttcatgggtcccacgtcagcaaaacgtcccatgtcagctgctttcgaccttcatttctttgctttcagaggaaaaaacaccccgaagacaggtaacaagtgtgacttgacagtactgcgacaatactcctgtttgtgaaactcggaacacaagactctggaggctgtgtctccagcaaatgtccagagcgtactgttttatgtattcaaaaaaacaaaacagagaaataagaagaggtcaataaatgtccccaaaaaccctggagagatactaactttcaatctaagaaaaagaacagcttcccagggccctgccagtgagacacaaggacacagaatgtaacttgctgatgccaggttaaaatgaaattaactacatcagaaaaaacctccgcagaccatcaagagatgtgtctaacgttctcatctacaaaaccaggttaaatatttagccacactcatcacgtcatctgcttggggggtacccagcccccaaagactcaagtggccttcacaacaggtgacacccctcaaggggcctgagacctcctgcctggaaggacaccagccttgcttggagtctccggcaag

SEQ ID NO: 4621 - DNA, 388 bp, Homo sapiens
aaaatatacagatatatttatattatcaaaaagtccccaaattggggaaggggcatcaggtagtctggaccccccactcagcccagactggaaggaaggctgaagtccccaaagcgcagctctcagccctgtagaagctcagccaagagctccctccccgtgagctgagtgctcctctacagcacccgctttctgctgttctggagtttgttgggaggagcagggggctcccttccggcagggccccagggcctcacgcctctgaaagggtggtggtcctcccaagttcctgacttatgcccatctctccagccccacaaggacagtgaacccggtggggtgagcaggatgggcagcaccttctccgcaaagtgcagggggcgctctg

SEQ ID NO: 4622 - DNA, 1001 bp, Homo sapiens
ctttcctcaggccctcctgtctgctccacgtggggcgccggggcctcgaaccgcccgtcccctccagccgagtttccccacccgccaggccaccgcggcgtcggggtcccatacctgatgctgttgtcgcccctgctggtaaggcttaattggcccctggtggcaacgccgcgtccggatcttgccgccaccgccccctccgactcctccggctcccgaggccatggcggagcctccgccgcttcccgctccggggcgggtaagggggcgggagaggcagaggcggaggccttagagagcctcccccgccgcccggccccggcccaaaagtccgcccgcgctgtccacacagtgggcacaagcaccccaggaaccgcgaggttgcgagcaggagcggagagagggtgagtgctggcagcggggaagggggtggcggccgcagaggccgaggaggctccggtccggccgcctctgcggacccccgcctctgtgtgtgtcacggtctctatggagatctcccgcagaggacagcacgaacagttccccgcggtgctgaggcctaactcgaccgccgactggtgggagttcttccgtcgccctagccgtagctgccgcagttgaagccgctggcgacgcccgcctacccctcccctgtgcgcacagcgcccgccccgccgccgtcgtcgtcgtcgtccctgcagcctccgccgccgttgcgcctattacccctgctaaggcggctgccgcggtcgcgagccagaatgtcgtcactcatcggcgcccgacgcatttgcatcatcatgctgcgacgagctgataggcaaagaggaagggctggtcgagtccacgctctcggccgcgcggcacgctgggaaacgtagttcaacaacggaacgcggcttctcggaaaggaagagggacggggaaggagatctccggggcgccgcagaggcacaaagccaaggggcactccttgccatttcctgttgctaccatacttt

SEQ ID NO: 4623 - DNA, 4735 bp, Homo sapiens
aaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagcttcccccctgtgggccatttgagagtaaattgctgacattatgccatcacatctggtatgtgggtattcccacaagtcaggacattttatataactacttcataatcagaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacatagcttgccattctgtgtctttcattggaaaacacattgagatttaagagtttggagaatctgatgattatgtgtctcagggatgatctcctcgtggagtatctcactggagttctctggatttcttgaatttgagtgttggcctgtcttgctagaactaacctggggaagttagttctcttggatcctgtgctgaagtatgttttccaacttggttccattctccttgtctttttcagaaagatcatcttcaagctctgagattcttttcttggcctattctgctgttaataattgtgatttcattgtgaagttcactcagctctaacagtgctgggattacaagcgtgagctaccacacccagcgaggaagccaagtttaacgtgtgtgctccactcctccaacctggccaaagggcagtcatcatcactggccactgctgaccacagcctttagaaactccccttgaacgtgctgggctgaccttcctctgatcacaggcaaggttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctttatgtactgtttttcctcatacaagtaaacacagaaagtcaaa

SEQ ID NO: 4624 - DNA, 2415 bp, Homo sapiens
gcatttcctctacatttattgcaacggctaaatgattaacaacattcacaacttcttagatcttaaaaaacagaaacaaaagaaaacttccattttgtaacatcacaaatgtcttctaggctttatcaaggaccaaaaacactacaattctctaagtgatttccagtgatggaaacaagccagagacagtaaagcacccagagtggcgagagagcacttccagatgcctgttgtcctctcgggggtgaccctggaactagaacgacagaaaagacactgtgactttgacacggctgtgccaccacacatcacgcgcgacacgaggatcctgcagagcggcctctgcagagagcaaggacagcctcggttaagagggaggggctgggggcacggagggccagtggcatctcctctatcccggctggccggcagctggcagcacgcaccatgctctgctggctcccgacaccttcactgccccagcgctgaatccacaggagaggtgtcctctgagagtgtagggggctttctaggttcaaggagatgtgccctttgacccctgccaaggactcacagaaccatctcagctcaaacttggaggagcggcaggaggtggggggcggtcagtggccacacgccacagattcctaaagcatttaactttttaataaaatgaagtggagaaagtcaagaatgaacatgctaggacaaagcacatggaatggtcagggcgatgctggagagagtgcgcttgatccacgctgcaggtgtgtgcgcctcgctcgggtcaatgggctgagccccgcttggagctccatccattcacctgacccatggccaacatggaagctgtcggaggggtcaggaaaggagaaggagaaaggagaagatgaaccccccgcacctgtgactccccaaaaccagctccactccaggcccccacaggctggttcgttcgagggttgggttataaacccaaactccatcctccatgctggcacctctactgccataaagatctgccagttgccaaagctacagaagccactggaagcaagcagagcccctgggggtggtggcactgcaaggtgacagggaccaggcagacaaggagctgggaccacagcctaggaagtctgtggcttaaagaaagccaggatttccttttttttttttgagacagagtctcgctctgttgccaggctggagtgcggtggcacaatctcggctcactgcaacctccgcctcccgggttcaagtgattctcctgcctcagcctcctgagtagctgggactacaagcgcccgccaccacgcccagctaattttttgcatttttagtagagacagggtttcaccatgttggccaggatggtctcgatctcttgacctcgtgatccatccgcctcaacctcctaaagtgctgggattacaggcttgagccactgtgcctggcccaaagccaggatttctttacagccaatacaagtggcatttcccgctcagttctgtggctgatgccctagccactgctgtgtcccctaatcctggggtgtcagagggatcctaagttttccagatttttgcccatacttaaaacttcaacgatcctgcttcacaaggaaggatgagtggagaattgagtggagttacacgcagcagagtgctggggaatctggagagcgggggcgatcacatgcctggaaatagagcagctgcagagcccaccccaggaggagcctgcctctccttacaaaggctgtaataagacagcacttgacgatgccatacgtgcgaaaagtgcagagtctcagagggtttacaacccccatccctttgtaactgtagtttgcttacactgtggattctaaagagacatgtaaatctggggccgatttcatctgtttaatgattactccccacccgatagagctattctatactgttgctaaaatttcattaagtctctcaagatgcattgatgagatgagacaccatgaataacacattcatcaactcaagtatggcaactgttcagagagcttcagagctttggtacccgagtgcagacttggtaattaccgggaatttgtctcccccgtataaattctggcgaacaacgagaaaacaccatctgtgatcgtttccacatcacgtttgctaacagagcacttctggagagcaatggccagtccaactggaaaatcagccagaggagctggttcctcagcactcacaggctgaggtgcctttcgggggcagcgccaccttctgaaggggaaccaagacagatttggaggggacttgctgctaaaagcatgtgaacagagaggagaggcaaaagcacattgaaaatggtgcatgtttttttctttgagagaaagaaaagccagcgaaacctccgccccagagactg

SEQ ID NO: 4625 - DNA, 462 bp, Homo sapiens
gtacctaggatacctggaagccgaagccacacctcccgcatggcccctccggccagccgggcccctcagatgagagctgcacccaggccagcaccagtcgctcagccaccagcagcggcaccgccatctacagttggctcttctgctgctgcgccccggcagccaggtctgatggcccagatggcaaccactgcagctggcgtggctgtgggctctgctgtggggcacatactgggtcatgccattactgggggcttcagtggaggaagtaatgctgagcctgcgaggcctgacatcacttaccaggagcctcagggaacccagccggcacagcagcagcagccttgcttctgtgagatcaaacagtttctggagtgtgccgagaaccagggtgacatcaagctctgtgagggtttcaatgaggtgctgaaacagtgccgacttgcaaacggattggcctaa

SEQ ID NO: 4626 - DNA, 3419 bp, Homo sapiens
agtcgcctggaggcccgtttgtacagtggaaaagtagaaaatgagactctaaaaatctcatcagccaaatacaaaacattctccttgctgctacgtggcggcctccacagagccctaaaaccttgaagctcggagacctatcttgaagggggagcaaaggcgggatgcgggaagtttgagtccatggaagacactgataccctctccattcctgggaaccctgagcctgaaggacccggcctgaacagcggaaggactgaatccctgtgcaactcatcggtgatggaacataaagccatggtgccctcggtccccaagacgggagggatggggaaggccctgggtgaaggggacaggcggggaaggaaaaggtgaagagaaaggtgctccccagggagggggtagatgtgcccaggacatgggacattggcagaattttaactccgagcacacacacaggcccacggacggcttcccgtctacctgttccttacgggtgtgctgtgccggcctgggcacctgcctctttccccatgccaggtcacttgccgtctaccctgtatactgccactagttctaagcctcccagaacaccctgatcagggccctgtggcctctgttacaggattccaggcctagacgtctgctcgattggaaaactgcccccagagatgccgtggctcagagctcgtcctgctttggggtggcccctggagtctccgcccctcagcaacccacatggtgacaggcacccacatccgctggcctcaggaaccctggggccaccatcccagcgctgtaaggagctggcagtttcctccccaccctttcggcctaccttgcaggaaccaagacaccaggtgagccgccccgggaaagagacctgtgctcccacggcgctgctcctgcgcccattcccagccactccagatgcttcccgtggaccagctgcactcccggcgggcatgcctggccctccgcagcctggcccatatgatcttcacaggcaggcccctccttatgccccagccccctctccagccagctcattccagcctcccccactgctgctggctgctgctggccagaaggctctccttcctcttgcaatccaattcctactctccctcaaggtccgcctcctccatactgacttctcccctgctagctagtggtgacttttctctaccctgattcggaagctgcctgtccacatcacccctggctgggctgaatcacactctctcctccacctccttcaatcatcccttccccacgtctgtctgtccacccaaggttgtccaactcccatatacacacccccacaccctccaactatactccaggctccttgggcaccagggagggccacctttccataccccaggtcagcccccatgcacatgcgcactcatgcacacacacactctctcacgcctatcgactcgggccacctgatggctctaagaccagaattcccagcaaaaccattcaggacacacaagggggagactgataaacacagggaaccagcagattgaggccccactccccgagactgagaaaccttcccccagagccaaaggattgccaactgctgcaccaggatggtctcaatgagcccattgtcttggactaaattacagggtcacaaaactggcttgggagacagccgcagaagcagctccagatggaggcacatgggggcaagggtggagttacacccagagacccaaggaaggggcactaacaactttcatagtgcaaatggtgacagctgtacaacgaacacaaccccaaaccctggcctcccctcccgccacagggctcccgttgagacacgagagttcttccccagaaatcccactgggggcccgacactttctgttaggaactgagagcagagacctcgatcccgcaggcaggaggagagctctgcacaacacagggcctctctccataagggcttactggaaagtggtcagaccggctaagtcgtgccacttggacatttgggacaaggaaggcccctggaggagcggtcgcagggaggagttgcaaagaggcaggggcagggaggtcacattcactcggggactgcaggaggctcaacggaacacagtggacctagggagaccccagtatgagcatgtgcccaaagatgtccagatgaggaggtgttgtgggggaggggggcgggaacagcaagccctcccagctctgcagacccagacctcccctccctctgggaagcagggatgcaaagggatagagcctgaaaaagggctttcaccactaagctgacaaagtaactacgatgtttccagctcacactctgcacagcgccagtggccactggatcacaaccccctcccgtcccttcgccgccccacaccctcctcaggcccagccctgaagaacagccactggcactctgcttggcgtccagccaaagttctggtcccccaggaggccccgcctcccccactcagatagggctgaccccaggtgggccgtgtgggcagctgggctcaggacacccagatgtcagccctggttctggccatggagcggggaggacctcaggctggtcacctcccagcttggcctgacacctggacagtttgctcatttcaacacagcctttccccctcccggcccaccagagggctctgcccaagtcagcctaggagcctctccgaggggcgggggctccaggtcccggcagaggcaggcccgcccctcagaagccctgccccagagcgctggagaccattgtgtgagcttccccttcgcctgctgtatttactcccgcggacgcaggacgcagagccccagcaccggcagtcaagaggacgcaggaaagcgcacgcactcacaggctcagagacgcggacgccagacccaggcttggacagagcagccccgcaagtcccaacacactttgtaaaccccgaagacaggagagagccaaaatactctccctgcccgcacgcaggccccttctgtcccccacggcccgattctgggaggcggatgaggatatccccaggcctggatgggggccatgggacatcccactctagaccctgccacgacctgggctgtgtccgttcggtgctcccggcccacgggctgcacaacttggcggccccgaaactggcgtgggggaggggagggctgtccacccgagcaggacgcggctgtccactcagtcggaggtgaggaacgacctccctatcccgttgccgggtccaagcggggcccgagagccgccggggagagccaaagggaggggaccgatggatttcccagagtgaaactgtgcgtcctggagagttccgaggcagcctcgcgagccctcgaggaggtcgctgtcgcttggcaaacacaaacaacaataaaaggaaggaaaccca

SEQ ID NO: 4627 - DNA, 1569 bp, Homo sapiens
gcgatatcccctgggtgggcccgggctgtgaagcagggcggtagttggcgggcgatgctatttatttcactcggattccgacttgggtggtctggggagcaagggatttgtgtgtttgcaaccgggtgtggcggcgagggaggggcccggccacccaggtgggccagcgggatgcctgggaggccggtgggtttggctgaccacttcttcccattcctcagtgagagacttgggccctcccggtcatccgagtctgtcccgaaggtttaactgcgcgcggcgaggggaggccttgtaggtttccaaagggcggagctccagtgggaaaacttgaaacttgtcgtctgcggatatttatttccacttcttgtatggcctgaagaatctaggaggagaaaaagccagataccaaacttacggccaggcagacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcagccggaggtggcaaactcagacatctacgggcgcccgaggccctcgcagccctgagccccagctttcacttccctgggctgcccctctccgggagcaggcagacgccccgttctcggagcccagcgctcacttagagcgactgaggttggtcgaaggatctttccccacatcccataatcagggccctaggacactcgcaggtccctttaactctgcttctgtcattacactagaacaagtagtgtttctgtttagagtcccatttcacaaattggttagtggaggcacccgtggcctggcagcttgcacagtggctgtccacctcgggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcattggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggccccagcagctgtcctgcagctgtcagcaggagggcctggctttaataaagagtggacaaactgaa

SEQ ID NO: 4628 - DNA, 1222 bp, Homo sapiens
gccggcccaggggaggcatcgtggtgacgtaggctccggacgtagcaaggacctgggtcctggcacccgcgcggctctgcctcttccagccagtctctttccctctctgggcctttgtgctgcgtggtgtccaaatgttaagaagccctgccccatgcccgggctacatatacatcgaacccaagctgtaaatgctcttgagtagaagcaacttaaactagccttcgggggcaagtaatagagatggctttcggcagagttgggaaatcaactaaatgcattgtagggcctttccaacattgacatctgtggccattagttgcagttcaaagcctcactgagccctcaaaccagctacagcgggtagcctggcagggaactggcagctgtgaggtgctcctcatccggctccctgcaggattctttttggtaggagcctgcaggcgtccgagtggtagctccacccatctccggtctccccagcaagcatcccttccagtgctagcttgagaagaggaaaagcttgccacctgctgtcagaccggcgcttgtgtggagccaggggctgtaggtaccccggctgagtagcctctcagatgtccatggtcctggctgcacgccagcgtgggggcaggcaggcggacgctcaagaaaaacggaggcaccgatatgagtagtaattgagaacgagggttcatgatcctcatctgatttcaatccctgctcctccacccaaaatgtgtggccttgaaggagttaaccaatttaaattttagtttcctcagtggaagataataaatccgcctacctcataaaggtttggtgagaattaactcaggtgatgcatgtgaagtcctcagcgcaatacctggcgcttcctaagtgctgaatcggttagccgtgatcatctcacagtggcatgagcattgctccaagtagatttgagccctccagaaataagccagctctatataggcacagcagttctgccctcgcagagcttctcgttcagataagaggcctgatgggaaaccagactcctgggtcctgtctcagttctggaagggtggggggccagctttgatttatgcctgctgccctggcataattactaatattgcctcctttttcagaagtgccctgctttgggccgggcgtggtggctcaccccggtaatcccagcactttgggaggccgacgcaggtggaccacctgaggtcag

SEQ ID NO: 4629 - DNA, 6029 bp, Homo sapiens
gagatcgacatttctgaagccctgccacctgccatccctcgtagggattcaagtccaaatagccagagcctctggcagaggagatgggggaaactgaggtagccctagggtcgtcctctcaagtcaagctgcctggagactgtagcagctacggttgaggctgctcaggaagcacagaccgccccagacagcagctgaagctgaagactccagggccaggccatcgggtcaggcgttcaggaacgcgaaagctgacggctctgagccaggaggctctttggctgctgtcctctgggacgatgtttggggggcgcggggagcatcaggacaggactctcccgcagcagccccagcccccaccaggcggggacaggccaccagctccatgccagcaaacaaggagtcgcggctccacgcacagctgctggggcctctctttgggctgtccgtgccccctgggatccgttcaggtctccaccgcctgctttctgccagtctggcctcggcctcgctggggtctccgggggctggaatgggggaggcatctgggggtggggtgggcacagggctggacggcatcccagatgagggagcagggctccgggacgagaccggggttgaactcagaggctgcaggaagacctggctcccagggagaggcacagcgtcggtcagcagacaaatggacaccctccccgtcataacccgccaggcactgccggagggagtgaacacgtggcctggcacatctgggcatttccaactgttggacgcagggttcttccagcatgcccgttttagaaaccccactatgaggttcgcctgcggtggtgcgaaccccaggctcactcgtcgctctgactgaaaggtgagctagcagatggccaatgacagttaaggatgacttggggatgggtgactgaggacctgtgtttccagcagccagggagaaaacaggaagaaagaagctgggaatgcccacaggcagagggaaggtgccagggcctggcggccgggagaggcctccccgtgtgattccagtggccgccaggcagttcagagtgttcaagtgcacagagatgaatggaaccatttctgccctccggagcttgggagttgagcatgagctgtgtcatgggtggcaaactgcatgtgcagtcagggagggcttcctggaagaggtaagtgtgaggccaagacacaagggcaggaacattaaggcagcggagtctgggggcttccaggaataggtagaggccagtgtactgtgagtgctgcagagtttgggtggaaggcgggaaggcaatggggaggtgaggaccctgacttgctgctgctccctctgccagcgggacagggacttgagagggggtccgggaagggctgaccaggcgccgggcagggacggggtggccgtggactgcagcgtatctcccactgtacccttggaccccggtgtgcgtgtggcctccgcagctgcccaccttggtggccttgttggtcacaggtcccgggctgcccatgctgagctcctgcagccacggccgggtgcggaggaggatgtgctcctgggggaggaggtcgctgctccccagggaggcgatggcacacagcgccctcagctgcgtgcattcactggtcccacgcaggtggcaggtcagcagctgcagcacggcctcacagttgagcagtccacacctgcacagaggggacacctgggtggcgggtgcggcccgttccctcctccctcgcccacggttggggctgaggcagagcagggcgggtccgggcgcactcacgctttgatgaagtgctgtgcctcctcgcggctcaggaaggcgcgtggtccccgagtcacagtcctcaccaagctcaactcctgctgacagtcactcagggccaccacctcgaccctgccagggggaatggccgggtcaagggtgagtggaggccatgcccccactcctgtctcgcatgggggagaacctggagagcaggagccgcgctgggagggggacagtgtggtgcctccgagacctctcccacatatctggcagctcccgctcacctttctgccaggtcacccggctcccggctggcccctgaatggctgtcgctgccggaatgactgcccgagtccgagaccctgctcaggtcgctgttctgggaggaattctgagagctggggccgctgtccagctcatcccagccccctccggcctgcccaggctgatgcctcacagctggaggaaacaggacagccggtgagatccctggggcttcaggccagccccatgcccacctcccggggccctggaccaggaggcctcgggggctgagtcctgagctgaggatgggtggccaccttggctccagcttcagcaaacaccagccccatgggcatgtgcttccgccgcgggtcccacccctcctgctgtgtgggaggccctgggatttgcctccgtggccgcaaagccccagcggtgacaggaaggagtgacccagaccccaaggggaggagccctcgcctcgatacctcggggacctggaatggccccggggagtaggttccccagggttgggggaccgtggctggctgaaggcatcatggcaggctggtaggtgtcaccccgcggcaggagcctccgggtactgggactctcgggcccggggcgcatggcgctggccaccacctctgcggccttctggatggtggagaggaaggcttcgcctgccgagcctgtacccgaggagagggagatgggacggccgcccagtgcggcccccacccgcgttctctgggagcagggtgcccgcatcggctccctgctcaagcttggagaggtcggggtacatgctgcaggtagggaggcctcctggtgggccccaggccctctggaagctcccagtggactccgctttggcattcccactcccagtgggcctggacaccaaagctcactgcagagttatgcctccgtccctctgtcctctgggggtgaaggtgtcctaaggggcttgggcttggccttggctcagggagggtgtgtccagggctcggggaggggccggcctttcctgtgtgagttccctgtagaagctgccccgacaccaaagtgtcggcaggagccccaggctgtgcgcaggacggcgtgacacagcctaacggtgagcagctacacaccgcccagggcccggcagcagggcacagctgggctgggggctgggtcccagccgcaggcagtggtgccacctgtggctctcctggcgctggtgagcagttgtccactggtactgccccacctcataacagctccacacgggactgcctgagtcacctgcaccacagccaggggcacagccctcggcccctctcagagtgggactcacccctgccacggggcccagccctgacttcttgctcggcctggtttctctcatctgtccataaagcagccctggccacacctgccccacccccacgtcagcagccagagagagacagtggggacagccccaggaagggttgaggccatgtaggggaggggacgggggacagcagctactagatggggcggcatggtccggcccccaccacctcctcatccccacaccctgagatgccagagcccatgcaggccctccccactcacccgtgcggccgtgttccttgctgtagccgaaaccctggagggtgctgtgcggcctggcctgggagcccatgcctgcagagggtcctccgttagcagcaagccggcccccaccctcggccctgcccacggatggcacagacacccaggacactcaaggaggcagaaaccaggaggaggggcaccccgcagagcgacactgctcctgggctcacctgcgcggccgcgcgaaccttctggtacaagctgttcccgtgcagaggatctgggggccctgcaaaagctgcagaacagaaaaggctggtcccgtgattcggagacgatgctcctggctgtccctgggcccagggctggcggccacaagctgagtcaatggctggatgaactgacaccctgaggctgccatcttccctgcaggagcccagggcacccacctgccaccccacgctgcccctgctctgtgacagagcaggagcatcaccatcttggacaagcccctcattctaaagttcaccttaaccaaaaactgcctaaatccatagggcatcagcctaatggctaaggtcagcacgaccatgaaccacaaataacatctccaaccagaaacattccaaactcctccccaaccagagacatgctagccccaagataacccttctccagccgggaagatgccagcttcgagaaaacccacctccaggctgaaaagatgcctgccccaagataaccttccctccttccaaccctgccataaacttctccacacacataaacattccgagcttctgataagccctctcatcctaaaaccaacattcagtctgtaagataaagtgctcctgaccgcaatcggctgggggtgcctctcaggttttaactaaagaaaatctgtctgtaactgccagctgcgttttctttcctctttctgacgctctgcgcgcgtggggcaggccatcctcactgcacacccaccacctggagcagggcgccccgtctctcacgtgtggcatctggcacccactttcctcacagggcctgtcctgacacctcccacagcctgtgtgtcacccagggccagtgtccaggcacggcaggcaacagccatcatccatagctgcctctgcacaggagagactctggtgccgacaagaacccagggtctgaagaagagcctttcccatcctcaggtcctgctgtgccccatccccctacctgctgcagcccccaccccagggcgtgtccccgagaccactgaggccacgacgtacatgcaccaaccacagccacgggagtggcctggagcccggggccctctggcccgctgaatggtgaggataaatggctggtgctgccttggccccaaagctgtgaggagctctgtgaggatggcgagagcacccccgcactgccgtcccctcaggggcatctactgcctaagtcatgtgtcacaactgtctatggcggcccagggcactggcccctgcggaacacctagagctgcatgcccacttgccataaagtgggacaacactggtttcgacaccggttttggggtgagcccagtggatggtacaccctgaggtctccacaagcaagcagtggcacgagacagactcagtctccctccccagaattccccactcaggggctggggtggggtccagacatggtgcgcccagtgaccacctggagccaggcctccctccaccccatggaagatctcaggccaagcccccacaagtcctcattaggcagaggcacatgggactgcccccaagcctgcggggacagctcccccagacccatcttctgcctggacagaccgactggccggggccccgcctctcctgcctcccagctccgccctcccatggcctcactctgtcttgggctccgaggagcagccccagaaggggaacccacagcctgggaaggatgtgtgaacaggcactgagtctgctatgtgtgggcactgggatggagggggaagacccgtggggcacacagagaaacaaactggcacccggggcagcaagcgcagggacagacgcagccaaaggcccagggacgcataggaggcacggaggacccagcggagggagggggcagggcgcgtcaggggaggccgagccggccagctggggtgagggtgggcagcaggtggagaggccagagatgggccaggatcagcaaggcggggctttgatcgggacccggcccaggtgagggctctggctgaagtcttccttctcaaacctggaggatccgccaccctcccccattctccaaagccctggctcttcctgagcgcgtgcgcggcccctgtacctgcagcttcctggatgaaggcagagttgcgtttgaggatgagcaggaaga

SEQ ID NO: 4630 - DNA, 1722 bp, Homo sapiens
tggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctgataatgccatgttttgtcctaaccttttgctgcagttaattactcttcctattatcttccatgaacttaagactgggcaaaaatgtttccttatctgtgagccactctgaacacaaacaggtcatgaagatagtgttgaaaacaataaatgacaaccaaaagaaaagtgaatattacctagtacaaatagtgtaaattgagacagaaaatgttaaagctagaaagcaagggcaatattctagaatacaaatagtgcttgcctactacaatattaatcccaaatcctttaaatatacccattatagaagatgcttacccagcgtcaagagtataaaagtgggtttgtttgttttcttgagacagggctttgctctgttgcccaggctggagtgcagtggcgtgattgtagctcaatgcagccttgaattcctgtgttcaggcgatcctccggcttcagcctctggagtagctgggactacaggtgcatgctgccacgcccagctaatgttgcagtttttcgtaaagactggatctctgtgttacccaggctggtctcctgggctcaagcagtcctcctgccttgacctcccaaagtgctgggattacaggcatgagccaccatgtcctgaccccagtttgttttaaagccaagcgatgcaccaagatgtttgtgtgcacatctgacagtggtaatctttgggtcaggg

SEQ ID NO: 4631 - DNA, 660 bp, Homo sapiens
gtgagctcttggcaggacctaaacctccttggaagataggcagaaagctctcgacaccattccatggcccacgaaccaatgtaagatgagcaaatggcttgaaggaattgctacctccaggtcaagccagggatgcagcactgccgagaccacgtttgtgccaagcactgggctggaccctgtgcagaaccaaatgaacaaggcacgttcccctttcagcactaacggcactgtaagaacagggagaagtggaatctaatctggcctgagggtagagggtgatcagctaagtctgaaacaccatgtagaaacttgccatgtatggccgggcgcggtggctcacgcctgtaatcccagcgctttgggaggccaaggtgggcggatcacgaggtcaggagttccagaccagcagcctggccaacatagtgaaacctggtaacatagtgaaacctcgtctctactaaaaatgcaaaaaattagccaggcgtggtggcaggcgcctgcagtcctagctacttgggaggctgaggcaagagaatcgcttcaaccttggaggggggaggaggtgttgtcagccgagatcgcgccactgcatcccagcctgggcaacaagagtgaaactccgtctcaaaaaaatgaaataaaataaacgaatgatca

SEQ ID NO: 4632 - DNA, 1689 bp, Homo sapiens
ggctgtcccttttgacagccatggcaaagtctagccatgtccatgtgttgttgtggtactccagacagggcagcaccaggttaaggtcaccccagtccacactgttcttctcaccctgtaagaggagggggaggggaaagaaaaaaagaggggtggggaatacatcagctgccattttgagtcccagccagccacttgagtgccaagtcctacaatagtaacctacagatactgatttccccttacctcagcctcgtaatgatgctgactcttgaggggagcagagggaacagcagatttatcacccacagctcagcatcacaaacaacctagctgtctccctgtatagaatctctgatcttatctggttcccttcccaccctgttctacaaagtgcttgagaggtgcagaccttgtagctgacacacagtggaacctgtggaatctttatgtagatgaaggagttgttcatggcagctcgctctttcatcttgtcaatgtcatccacagggtgctaagaaaggcaggcaaggagtgtgagccctgaatccatcagaagaaactcaggaccccaaacatctccctcttcttttatccctagaatggacttagaggaaaccgaagaaatcccaagccacaccaaacaggacctcaagactctcccatttttctatcatcaggggcatgtttggtacctctggcgatttgcgaaatgaccttctgaccccagaactccgagtcaaaccctgtgccacacccttcccagggcccagtggtactgcatcatctgttgcaatcagctgccgaggcttcaccactggtattcctatgaaaaagcaagtgtaccagctgtcatccatcctcgttctgaagtctcagctgtctttggggttgctaccctattcttctggggctccaccataaaagttctcaccagtagtcaccagtttggacttatcctcttcatcaccaacttcatcatcttccacacttcggccaggaaagaaaaagcccatcattctgtggaagaactggtgtgtcagctggatggtgagaggcaccacatttacctaaaaaggaaaaagattcaagaagcaattaagctcagataccatcatcagtttacctactcctaatatcgtgtaacacacaggtggcttttgaatgtcccttgttcccaggtccctaagggactgcttactaacctcaaaatgctccttaacagagatacccccaacagggggccgaactttgctgaagaggcggagagctagctgtcgcccagactggcaggagctctggggccgcagtactacctgtaggatagagagtaaagaagagcccaacccaatgtccttcctgccataaagcaacccacaaatcctctgcagaatgagaggagaagcaatggtactgctaagctgggcaagctttcaccctctcagatcaccacattgttttccatagtggatttatactgaagggccgttataaatgccccgtgctaaaaacatgcaaatggactaggaaaggggaaaaaagacttgccttatagacagcattggggaggaggttgttcatggtaaaccagcccaactccagaagatgttctgctgtgtcatcagacttattcacctataaagacagattttgccccatctactataataaacctttctcagaagtcta

SEQ ID NO: 4633 - DNA, 1473 bp, Homo sapiens
tgcctcagcctcctgagtagctgggattacaggcatgtaccaccatgcctaattttttttttttttttttaggagggatggggttttgccatcttggccaggctggtctcaaactcctggcctcaagtgatccacctgcctcagcctcccagagtgctaggattataggcatgagccactgtgcccggccacgggctggactctttagccagccccaaatcccagccacatgactttggctgggtcactcctttgaggcacgaagaccacgtcacttggttgcatgcttgggtgcccagtgggacaggtatgagaagacccactcaagagtggtgagaaagaaggctggctaggaacccaggtggggcaggttgtctgcacgttatggctattatgagcagtgctgctatggacatttacatgtacgcacgtctttctgtgagtatatgttttcagttttcttgccttttttttttttttttttttttttttaagacagagtctcagtctgttgcccaggctggagtgcagtggcacgatcttggcttactgcaacctccacctcctggattcaagtggttctcctacctcagcctcccaaatagctgagactccaggcatccaccaccacacctccctaattttttgtatttttagtacagacagggttttgccatgttggctacgctggtctcaaactcctgagctcaagtgacccgcctacctcagcctttcaaagtgctgggattacaggtgtgagccactgcacgcagccatgttttcagttttcttgagggagattcctaggagtagaattgctgggctgtgtggtaacttccaggcctccttaaagctttagcctggactgggtagagcatggtttccactgcattctcttagtcacagtgagttgcaggttcaccccagcgtcagtggcgggcgggaagtggggatgacacaaggacctgagtgtccaagggggcttcatggagccctcatgtgaagtccccagcatggaccctgacacatcgtaggtcctcaacaaatgtcactccctgttgtcactctgtttagtactaagaataatgatataaaactgggacagtaaggaaaacacaaactgttgggacctatatctgaatctattagtctgcctaatagaaaagccaccatcaggattttggagattacaagctcactttagattagccatactggagtcagccctggaggctcccagagatcagaacaatcccagcgcttgacaggatggctgggaaacaatacatatgaatgccggaaaatgcagaactaatctaggaaaaagtgtaagaagaaaataaacatcatctgtcattctatctatcagagataactgctgtcaatattttggtttccttccaatattttttctattcactctgtgcataagtatgtatattttaataaaagtataattaagatcacaatgta

SEQ ID NO: 4634 - DNA, 17115 bp, Homo sapiens
ctttttcgccccgcccttcaaatgcgaaagcgactgccttcttggtagacagggtgtcgccatgtttgccaggctggcctcgaactcctgacctcaagtgatttgcctgccttggcttcccaaagtgctgggattacaggcatgagccaccacgtctggacataaacccagtaattttgtacgatttataaaacaatgtagtctgcaggaactaaggctatgttttgcctcaaatgttctttgttttcagaataaaatacttggtcagtggaatctcttcaacaaaatagaagagaagcagtcatggagtgaagaaataaatcatctttgtttctactcatctgtcacttatgcaatacatacaatatgtaaaaaggaaaaatccctgtgtaatagcctaaggcaaccagcagcttccacgtcggttggatattaataaatttttttctttactgtaaaatatacccatcagcttttttttttttttttttttttgagatggagtcttgcactgtcacccaggctggagtgcagtggcgcaatctccacccactgcaagctctgcctcctgggttcacaccattctcctgcctcagcctcccaagtagctgggactacaggcgcccgccaccacacccggctagttttttgtacttttagtagagacgaggtttcaccatattagccaggatggtctcgatctcctgacctcgtgatccacctgcctcggcctcccaaagtgctgggattacaggcatgagccaccgcacccggccactagcttttctaagacactttgtttgtttttaaataccagacctctgctatgacaatgtttgattttgtaaacttcaggtcaaatcatgtcttctgaaaagtaactgcatataaaacacgttgagacatttgcttaagatgttgatcctggtttcaagtaacagcataagggaattcctttgaattttcttttatcaagcaccctttactaacatcacaaagatgcatgcatattccttcatttagtatttattgaatgtctactatgtgcaaggcactcacccatggcctgacagaccacattcaagtacaaagaatcattagagccattccaaatctaagtgtcagaacactttgaagcaggatgtagagtggtcagaatgacttgaggtaaagcagaaacactcaacaaccagtacattaaaaggtgattttaatttttgacattccttgggatgatattcctttaggaagaagtagactgtgttaaattcgcatccatggcactgcttcctgaggcagtaattcttcaaagcctttccttccgtgtcaatactttccacatttgtgcgtttgaatggatccatgtgtttagccattattttactaaacacaaaatcatttgcacaaaaaaaaaaaaaaaaaaaacctattaccatacttgtctggtcatacagaattttagcaccacagaagaggaaagatgtttggcctgagagggcctacactccagtctgtgtaacctaaaagcaacttaagcctgatttcgtcattttaagggtgctgatggtaagcaggagtcaggaagaatggtctaacaaaaaaggctggcccagctgtggttgccaagtctagttctgggagatcctgggcacggaactactgcgtggccactgctttcttcaagacacagaatttgcagggctcttccccgcccttggacagccatctaagtgttgtaaccttggggcaaagtaatttctcgtaagtcttcactttgtcatctataatatagtgacaattatcaaagaacatttggaagactacatgagaaaaaaggaaagcccttagccaggtatctggtgtacaatagatgatcaaataaagacatgttaccttaatttgacctacagggaaaacactctgggacttcgtttacccttagttgaaaacagaacggaacacttcttttctttcttcttaccccaagcttccagatgtattttatgtccagtagcaatttgatattttaaattagcatataaatatttgctttatcagatattctgatgtcctggtatccattgttataacctgtatataacctgtaatcctgaactgctgggattacaggcatgagccaccacatccggccataaacccagtaattttgtatggcagataaaacattttatggaatattctttatgatagccaacttactgtagtagtcacatctgacctttgataatttttttaaattaagttctgatgacaggaaaagatagaccaaaatatttcccaacctggcagatatatacttaatctgttcagctcacaacagagagaaatggtcatattgagatggataaaaattcagatttgagacttccatgtatataggcatacctgtgtctgcaaatgagcacattttggaacgtaggagttagcatacagtatgaaagttgaaagcaaacaatgctggtttctaaaagtggatcccttttcttcactgaacatcatccttagacaccacaatttccaatatacttaaaaaccatcaacccctaaaaagttataatgatttgcctattgatataaaaattttcacaaaactagcgagaaagaaaaaccccttgactccaggaaaaccttttcataatgcatcccccaagttgggggattaaatcgctgaaatgtttatttagcactagagaagtaaattcaaagttgcctgtgggtagacgtacaatagaattggttgacaaagtttggtttataaaatatacttacatattgtttcttaggcaaaaatcggcagcaatctggaataattcagattttttatgagattaattgccaatctttttatctgtgacgataatgccaaaaatgactcagagccaataaccttcatctgtcatatggaagaaacaatcctagggcaatagttttttcaaaagcggaactgacaaagataagcgtttaaaagggtcttgatcaattagttacaggaacatgaaagaaagtgttccacagagaactgtgtctcctaaaatctctttcttctatcatctaccttacccaaaatttctcaatccaaccacatctacctgctggtccatcagataccagatgcctttacatccaaaattctcttaatgctttttttcccccaccaaagttctcattacaaataatatagattggaagtttggaggatggaggggaataaaaaggaaaagtaaaacaaagtcactttccccaatccatatataaaactacaaaagagttttcctgtattgaaattaacatgcttttgtaatgagcaacgccttagtggtagggtattcagtgaatttaaactaagttaacagaatctgagaggcaaagaactaaaaacaggatatacagttaccccttaaaatgtcatttctgttaccaaaaagcctgcttcagtaccaagttccaacatatctgagttatgctacttcacttttagccaattccaactttgatactttaagaaaaaatcattttattgttaaaaaagaaaaaaaaacttagatcttatagttcatgaacttctaggacaagataaattcctctgttttagacacaaaatagatcacgtcagttaaatagactttgttttaattcactcactgaaacatctccaactactagcaaaaattccgaatgtctgaatgcacactactcttcctaatgtggggagacaactgtgtgctttgtatctttcccactcaaattggcttataaaatgaaattattttaactatccaatggaaggtacataatttaaaacatcctatagaaatgacatgttactagtaatttacaattttaaaaaacagccacaaaaaagtcaaagctaaaaacaagatttttactatgaatcagtgcttctattatccttctgaaagaagttatattttaatgtgatgtaaaggcaacattgaaatttcttctttaaattaaccacctaatttatccctaaaattacaaagaatcagtcttttacaggtcaagtgcagtaaactaaaatgttctctcagcacaaagcagcactagaaaaagtaacagttatagatgggagttgactagttttgcagtggctgcgccatcaataacaaacagacatcagacggtatccatcccagagcacagacactactacagactagatgcgaagaatgcgtcacactcttggctgataaatgtcctttgtctttgactctttctagtttgaatgaagtggattttttaaaagtttaaatcaggtcacataagttggctgcttaaataacatcatgatgaggtatgaaaagctctgaatatcccttacattcagcaggatttaccagagatgtataatagcttgtcaggggcaacttccaaatagtttttacactttggggttataatgaattctagaagaggacaagtctaaaaaggtttaaaagggtatgctctgaaacagaggtgagcaaccttttccttcagaattcactttgaacagcacatcaacaaaaaaatcttctctggtagtgtatcccaacattgagtcaagatggccaactagcaccgagaagtcgtattgaactcatttgcagttgtcttggcaattaagcgtattttttcattccagtccaagcacaaatgtggatcactgaacacagtactggaagcgccatttgcaggtacagattgcagtcatcattaaatgagccagaaggcagatactgtttttattttgtgtggggggagggggaagcggcacagtactagcaggagatgaaataaaatgattaggaaacaatgaggttataagatcactgttcttatttgggttaagcaggtcatgttgagaagatggttatttctttcagataaggatgctacattaaaggaatcgtgtgcagcatgaaaagattagaatcgagctgcacctaagaaaaaaatcccaaagttactttcaaaagtatgtgttatctgccagtcacagaggggaaaagcacctagggtgaactccaattttttaatgaggaccttgatcaggaccacaaagcctgaaacatttattttaatgcagaaacacagcccctagttacactgattgcatttgggaaaattggagggttttttcgtccttagttttttttattaaattacaggatatggttttcgattactaagtattcgaaatcctcataccagcaacagaaatgaaccacttccaaattctaagacacaaaagaccaaagagaagcaaaagcgatacaaattaatatgtgcccctctcctttctgctctaagggaatctacaaaccagtatcacatttaggagtcaaagtgttaattcttcagcattcctgacaactagaaagcacattcactgaaggctgaaggtgagggagtggatggtttaactttaatatctgaagaatggcgccaatagaggaaagaaaaccatccaatctcagtaaggattaatgcaaatctggctagaaaaagccaccaggtaatccaagggttcactgtggaagaactcatgaaaagtactctgaagtatacacaacaggtctaaacatctcccttgtcgtaagtagttgtgtaaaattcaagataaagatttagtctcatcttttaatgtcagttttttcccccatgttaaagggaatgaggaggagtcctcttttattcccccacaagaaaaagggagccacattaatatgtgtatattcccataactctaatgtaagtgcggatctccaaagcctagggatttttccgtaaaagagagtgggccgttctggttacccttttattagaagggtattccaccacagagagccggaggttttccagatgtgtgtaagagagcaggtgcgcaaggcaagcaaatgagcgcaaacagtattatggaaaacatttgagaagttagctccatgaggactgtgggctccacaagaggactcgactgggtagcctggtctgacacaggtacgtgaaagcagagtattgcttcaaagctggaaaccttccataggagcctcacactgttggaagatgtactgctgctggttaaggtcaacctggggtgcaatgctgctgtcttcatcttcggtcccgaagtaatgctcaataagatcaaaggccttttggtagatctcctggttttcatgactctgtaagaactcaattttatccagacctaaaatgaagaataaaggaaaatctttattgaaaacttcaataaatattggaaattccataactatatattcctaaactatattttgtcatatatctctgttcttgatgtaaagaaagattatttgtatctcataagtattttataatagcacagaaatgactgctgggattacatctgaaagctagtattataaactgacatcttaaatacatatgcaagtaatatccagtctgcagaagcagcaatttcctaacagtcctcttttcatccagtgcctagcagtagtagtattgtttttactgaactctatctatgacccaattcattcttggccataaacttcttcaaccaaagcatcttaccataagcttcttcaatcaaagcacagtaagggttaatgccagtgccattccttttggcttcctgttctccaagcctcaggatattttccaagccatttagggcaacctgtacaatcttagagtccatgaccgtgaggagatcacagagcggcttgatacaacccagttctactaggtacctaaatacaaagaataatgtagtcaaacaaaacttttaattttgttaaacttatgaaattagtgagcaagtcatcctcaacttcactgcagagacttaaaaaaaaaaacaaaaaacaagcactctttcaaccatacaagctataccttttcacaaaacaaaaacaaaaaaccctctaaataaattatcccaaaccagttctctggcacctttctccattcttttctcttcacaatttatgcattccaaaaacaggaatacttacttattaataccttgaaatgagcgactcatcaaaatagtataggtttgagtaatttcatctttgtttccatagatagccacacctctcaaacatgacactcttggtgctaaaagccagcacaagcctgataagccaaatctttcaaagatgattagaattttagtaaagtaagttgtgggaagaataaacaaatgtcagaggattctagaactggtatttttcctttaattcaagcagaatgtataaccgtatgtaatcaagattaatcatacttgaacttcagagacatgattactgtatcacattcacagtaaatagtcatgtcattttttatcattctggtttctcaagttgagtacagagaggcagggataatgaatccagttgcattatgtgaatgtttggtaaggtcattttgaaacttactgctagtgctaatctatttctttctcacatattgcttttttgtgtgggggaggaagaattcaaaaatatataaaaataaatctctagccaaacaagaaaaaaggagaaaagacaaaattactaatatcatgaaagagaatcatcacttgatctcatggatattaaaaggataataaaggaatactacaaacaactctatgctcacacatttgatcattcagatgataaaatgaacaatttcttgaaagacacaaaccaccaaaactcagtcatggagaaatgactgatgtgaacaggcttacatgtattaaataaattgaatcattaataacttcccagaatagaaaacatcaggatgagggtttcacactggtgaattctggcaaacatttacggacaaaacgatactagtattctaccatctcttccagaaaacaaacagtggggatacttcttaactcaatctttgaggccagcacttccccaataccaaaattaaataaagacatcataagaaaggaaaattacagactaatatgtctcatgaacatgaatacaaaaatcctcaacaaaacattatcaaatcaaatccaagaatgtatacaaagaattatataccaagtggatttattccaaatatgccaggctgatccgtcattttaaaaaaatgaatcaatgtaatcaacttacgatcatttcaacggatgcaaaaaagcatttaacaaaatctaatacctattcatgataaaaactcagcaaacaggccaggcatggtggctcaagcctgtaatcccaactcttcgggaggccaacgcgggtggatcacctgaggtcaggagttcaagactagcctggcccacatggtgaaactccgtttctactaaaaatacaaaaattagccagacatggcagcgggcacctgtattcccagctacttgggaggctgaggcagaattgcttgaacacaggaggcggaggttgcaggagccgagaccgtgccactgcactccagcctgggcgaaagagcgaaactctgtctcaaaaaaaaaaaaaaaaaaaaaaagaatctcatttacatcagcatcaaaaaagtgtaaatctaataaatatgtacaacaggatatatatgaggaaaactacaaaactgatgatctaaaaaaaaaaatggagaaatattccatgctcatggacaagactcaatattgttaagatggcaattcttcccaacttgatctatagattcaatgtgatactcccaaacaaaatcccagcatgttaatagataccaacaaactgattctaaagtttatatgggaaggcaaaaggcccagaatagtcaatacaatactgaagaacaaagttggaggaatgacattatcaacttactataatctaatcaagacagtgtggtattggtgaaagaacaaacaaaaaaccagtggaacaaaatagagggcccagacattcacaatacttgaatgtttgttcccctgatggtatcctagatgccatttaggctttcttttttaattatttttttcattcattcattcattcatgtatgtctgactgagttatttcaaaagacctatctttaagtttagtaattctttcttctgcttgatctgatccactgctgaatatctcaactgtatttttatttcattcattaaattcttcagtgctgggaatccttttttatatgttattgttgcttttttaattgtgtggtggcaggatggtaggagatgctcataacttttgttttgtaaatctgtattctttgatttaacccaccaccactactactgccatcattcacggattcaccaaaaattggatattatcatacttgtttttattaatctttcttacatttatgtatagctgacatctgtttcaatgtttaatattagaaggtttttgggtctatattttgaaggttggggatgtttccttgaccagaaatatcacgtagtaactcaactgatttatattaattagcctatgataaaattggttttgatatatacaatgtttctcttaaagtcaaagtttcctggaacctatcaatgacattaagtgaggacttcctatactgtactaccagtgtgtgtgtgtgtgtgtgtgtgtgtgtggtttctcaaataaactgtgtgtgtgtgtgtgtgtgtggtttctcagataaactgtgtgtttgtgtgtttggtttctcagataaactgcaaattcatgcacagacccacacaaaaagaatagaaagcccagaaacacacccgcacaaaaacagtcaactgatctttaacagaatagcaaaggcaattaaatggagaaaggattccaccttttcaacagtgctaaaacaactgaacatccatacagaaaaataatgaacctagacacaggccttactttgtgtcactcgtgagcttagacaggccaagtcttcccaatacccaagactgaggctttcatcccagtattcaccagtcgattacttaatcatccttgtgaaagaacgacctatagcaagactgacctgccacctccaaaaacactgcattctctcacttttcctcatgctattctcccctccaaaactgccaattctctatacaaatagtaagtttcacttctttgatgaatgtttctctaatttcagttaataatccttatccttcattaagaacatgtgttatatatgtattaacatttgattatattcaacctaaaattctagatgtttcctaaaacattcttttttatcttttgagacagagtctctcactctgtctccgagggtggagtgcagtggcacgatcttgtctcactgcaaccaacctctgcctcctgggttcaagccattttcccacctcagcctcccaagtagctggaactacaggagaacaccaacacgcccagctaatttttgtagagacaaggtttctccatgttagctaggctggtctcgaactcctgacctcaagtgatttgcttgccttgtcctcccaaagtgctggaattacagacatgagccaccacacccggccaagatatttcctaaaatattctaattgtttcttgcatccaaatctggtatctgcaacaagaagcagcagaagccagatagatgtcttttataagtgataaagtcagtttgttttttgtaatttggactgtaatatttttgtgacattctttcaagataactcttcatgtggggaagaagaaactgctaggaggttggtaattaattttattataaatagctatgctgaattttaaaaagggacagcagcaattctgcgcttctctaacagagcaaaatactcctgaatactttctcatgaaagatggcataataaaatatatatgtttatggtttatttcttcttcttctttttttttttttgttgaaatggagtctcactctgtcacccaggctggagtgcagtggcatgatctcagctcactgcaacctctgcctcccgggttcaagcgattctccagtctcagccccacaagtagctgggattacgggtgcacgccaccacacctggctaatttttgtacttttagtagacacggggtttcaccctgttggccaggctggtctcgaactcctgaccttgtgatccacctgccttggcctcccaaagtggtgggattacagacatgagccgctgcacccggcctggcttatttcaattaagaaaatatatttgctataaaatatagagacaattaataactataaatgtgaatttgaacataaagcttattcaaataactatagtacttcattatttttaccatctggtgacagcataattaaaatcatagtactctagaatcagaattttggaggttggaaaaaacctacaagacaaatgtgcttctgtctccctgaaataacctgcccatgatgaacttcaccaaaatagctactgcatatgttaatctgtttgtaattttattctttcaggtacatatttcttattttctctacctgataaatttctgtactttgttactatttttattttttaattccaaacagaacactcaaaactagcatctgatgaatgcctacattcagtccacaaagcaacaatgtaagtagtagctatgtttgtctgatattacgtatgagtaaggagttaatgctttagcactcatttgaaaccatctttccttaattttggattccccataaagttaagactggctgagtctaggctaggctccatttttctcttcatcattactttttttccctatctgaaatactagatgtcctgaattttgcatttaattatatgatgctcctttgaagaactgattcccatccatatttatgttttcttccactcattaagcttataagctgctcgtcgggcatgatggctcacacctgtaattccagcactctgggaggccaaggcaggtggatcgccggagctccggaattcaagatcagcctggccaacaggggaaaactccgtttctactaaaaatacaaaaattagctgggtgtggtggcactcacctgtaatcctagctactaggaaggctgaggcaggagaatcgcttgaacccaggaggcggaggttgcagtgagccgacagtgccactgcactccagcctgggcaacagagagactccatctcaatcagtcaatcactaagctgctaccaagggagccatttaagtcttgagctgctacagctcctccctttaacaagaataccatagtactttagaagatacctgcctctactaaatttggcacttcattctcagacataccactctttcaattctgatccaattctactattaagacatctaaactaaaaagggcaagagtgagttattaaacttgggctcaagttctacaagtaacctatattacccaagatatttctgacaagtagctccagagtaggttgaagcaaggatttctattgcctcaagcctcgactatgcctacttcttatatcccaggattgtttttcagcaaaaagaaatgggagagttataaagaattaaatacacatctaattatgacaccaaggacaatttcctaaggactggaactaaacattcttatttggtaagatcgtctctcacttacttttcccctcaaaggcagctaatcttttactctaggtaatatgtgggaggttataaagtgatagacacaataataatttttctttaacttacaatatgctgcctgattggtacttacttgatctgttcagctgatcctccagaagttgcatttgtgatggcccaagctgcttcttttcttgtccgaaattcagcagtttgtaaaatactaatgagggctgggaaaatgttggcatctatcacagtctaaaattaaagaaaaacttaaatggaaaaaactgtgagatttataaaaatattcatgatactaattataatttctaagctagtttgactattaacaccccttctcctgtcagaaataaattgaaaagagttatgtcattatctctaacctttttttttcttttttgagatggagtctcactctgttgcccaggctggagtgcagtggtgcaatctcagctcactgcagcttccacctcctgggttcaagtgattctcctgcctcagcctcccgggtagctgggactacaggtgcacaccaccaaacccggctaatttttgtacttttagtagagacagggcttcaccatgttggccaggctggccttgaactcctgacctcaggtgatccacccacctcggcctcccaaagtgcagggattacaggtgggagccaccgcacccagcctatccctaatccttattctgtcttggtatcactgaaaacatcttccctggagtttatgatcttataatctcctattttctctgagttcttttctctttcactttcctcttttgttctgcccacagtaacaaattgttaagagctcaattttctgctcctctgctattccattctctcatagcatgtgaacttccatgtgcgaaaactctctagtcctcacttctcactggagcatcagcccagggtagccagcagtttacgttaggtctgctagtcatctcaaacacatcatctgcccgctatatcaagtttccttttaaacccctctagttcacaaaggctattaatttacattctcaatttttaaaatcctgagtccatctttttcctttcctttggcattgccatgctattctccaagccaccacctcccagattaccaaaataagacttatagttggatggagtacttttactcaatccccttcatgtactaacactaaagtagccttcccaaaattactttctccctgtttcttcctggctcaagtacctaacatgggtttatatcatttcctacattaagaaactgagaagttctgcataaaaaagcctggtggtgacaggcaatcaaatacagatgaaatcacctcatatgaatgctatagattgttatagctattaatctcagttcctaattcagcattttggggacaaaatgctttcctggtcaaaaactcttattatacctgtgaaggacgtcaacaaagtttgacaaagttgattactggaaagacacctaatcccggtcctgtcattttactagaggtgctcttgagcaaatcattttaattccatgagccgtttcatctttttattcaaattttttattgacaaataataattgtatatatttatgggatacaatgtaatggatgcttcaatacacacacacaaacacacacacacaaaattgtggtaaatgaaaaccttggattagatgatctctctgtttccattcatctccaaggccctctatgtctgtgttatatcttttcctacccactgttccatccttgaacattgcccaggctgaacactttggcccactgcttgtcgtccacttgagttactctcccaccaatacaaagacaaaagtaaaaaccaagtaactatttaaagaaaaatgggtatccaaaaattcatgaaaatttgaggcaatctacatgggtccactggaaaaataaatatcttacttggaaagcgttaaagccaatcgtgctcagcataaagcccatcaaaacattttgaaaatacaagacattatttgttgcaagaagtcagggaccctgaatggagggaccatgaagcctggcagaaggacataaattgtgaagatttcatggacatttattagttcccccaaattaatacttttatcatttcttacacctgtctttactgcagtctctgaacataaactgtgaagatttcatggacatttatcacctccccaatcaatactcttataatttcctatgcctatctttactttaatctcttaatcccgtcatcttcattaagctgaggatgtatgtcgcctcaggaccctgtgatgattgcatcataaagcatgtgtgtttaaacaatatgaaatctgggcaccttgaaaaaagaagaggataacagcgatgttcagggaacaagggagataaccatcaggtctgactgcctgagagctaggcggaacagagctattatttctcttcttacaaaagtgaataggagaaatattactgaattctttttctcagcaaggaacagtcatgagaaagagaatgcgttcctagggggaggtctctaaaatggccactctgggactgtctgtcttatatggttgtggataagggatgaaataaaccccggtctcccttagcgctcccaggcctattaggacgaggaaattcccgcctagtaaattttagtcagactggttgtctgttctcaaaccctgtctcctgataagatgttatcgatgacaatgcatgcctgaaacctcattagcaattttaatttcgccccgtgctctgccatttgccttgtgatattttattgccttgtgaagtatgtgatctctgtgacccacaacctattcgtacactccctcccctttgaaaatcactaataaaaacctgctggttttgcagcttggggggcatcacggaacgtgccgatatgtgatgtctcccccagacagccagctttaaaatttctcttgtactctttccctttatttctcagaccggccgacacttagggaaaacagaaaagaacctacatgaaacactggaggtggttcccctgataactatttcttgggtcttggtgaaacatcaaatattaacggcaacagaaaaaatgaaggcttaagtgtaaatttcaaaagacttaacatctataagctaggataaagtaaaaagctgactatgaaataagacaacaacattgaaagtggtcttcaaagcaataatgaaaacgatatacgttttattttgttttgagatggagtcttgctctgtcacccaggatggagtacagtggcacaatctcggctcactacaacctctacctccacggttcaagtaattctcctccctcagcctcccgcgtagctgggactacaggcacctgccactgcgactggctaatttttttgtatttttagtagagacaaggtttcagcatgttgaccaggatagtcttgaactcctgaccgcaagtgatccacgggcctcagcctcccagagtgctgggattacaggcaggagccaccgcacccagccaaaaacaaatgtgttttaaagggtgactgagaaaaaaaccttacttttcaataaaaatactgaaagagaagttaggtcctatgaggttacctggatctgtgccctatttccagctgtaatattagatatcgtccaacatgcttcctttttgatagattcctttgggctactcagcaaatgcaataaactctgcagagctgagcaattcagaattacctaaaagaaaaagtttgaaaattttacttattgtattgttctaaatatcaatgtttaacttaaggaacacattttatgaaagacataacatctccccttgaaattttataaataagtaactttatacaggtaaaaaaaagtattcactgttaataagaattagtttctaagagtatcagtacagtttcattgtacacattcacaactgctaaactgtacttaataagatacaataatgttactattgtaattacaaaagcattactcattcaccttcccatcccaatagcgtaagtcttctgaatgggtaaatatatcaagtggccagaaaagtcaggagtctcagatttgtaggtcctctgataacacactacttggtagtcaatgaacgaatacgtacttaatgaggtatattagatgctttataggatacaaagataaaaaagatatgacctcagctatcagtttataaaggtgaaggaggtaacacaaatacacatgaagaaggagacctactctactagaaactaaaataatataagtttgattaaaatagtatatggcagatttaagaattaatcactaaacagagaacagagatctattctagaaacaaatgcagctatttataaagtttataataagttaatcctttcttccaatgacttgtggctatgacagaactggaataaaaagctaaacagattaaagacaattttttcaatatcatttcttaaccctgatatggtttggatctgtg

SEQ ID NO: 4635 - DNA, 1032 bp, Homo sapiens
tgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccc

SEQ ID NO: 4636 - DNA, 1778 bp, Homo sapiens
ctcttagccaggtggcagattctttcgctgtgcccaattagctgctgccgcgccttggagtccggagtaacttggccaggctggccccgagcggaactggagaaagctgagggtgaggaatccggctccggtccttttgtgtgtggagggctgaggagaggagtttgcgtgtgtgattgccatggttgccgtgggtcttcgtggtctgtgactgtggctgcgtggtgctgactctgggtgatcaagtgggcgcttgtgactgtgcgcgctcggagtggatgtgtgtgtcctggacgagccgcgttgtgtgtgcggatgtggacaaccggtgactgtgtggttggggctgcgtgtcccagggtggatgtgtgactttgcgtgtgtgtgcagtactgtgtgtgcgtgagttgcaggtctgtggctgtgcaggtgcaacttgtgtggccccgtggtctgtgtgagagaggagagtgtgactggctgtgaggcagagggtaagtggatatagggaggcatgtgtgtgattggaactttgtgtgtccccttgagagaaaaaaacctttagggagttagagcgggtccttggtaaaactcctttaaacagagaaacagccagaaaaatcaggctgcaggcacagagaaggaaaactagcaaagggggttgtcctaaagacattcctcagctgcactgataagggaccgaggcccaacatagaaatgcctttgtcctttgtgtgaccagcgggcttccaggaaatagtcgcttttttgtgggcatgtatacagtgggctctgttagattttgaagggaaggcgaaggttaaagaaagagagttggcggctctatggaggggaccaactaaatgccagagcccactgccgcttacaagctggagtaattataggcctgggcaggaggggtctgggcagtatagcttgttgcctgggagaatgttggtaaggatgtttcttgggcctttccccagcaggatgtgataaggaagtcaggcggttggggaggatgtttctcgcagcccaaaccccagtggaatgtttccctctgaacagggtctgtgaaatggtgggggcttacaaatcggtgcagcttggactaacaggctccggcggccactttgttttctggacatgctttggactgtgagccgagcctctatgaatcatcacttcagcctctgattggtcctgggccaaactttcacttcagcccctgattggtcttgggccaaaatttcacttcagcctctgattggtcccaggctaaggtcccgggccaagcgaagtcgtgctatctccaagacagctcacagaccagtgagcacattcttcctcttcccagttcacaaaacccccagattcagcctcctagttggcaaccctctttcgggtcccctctctgctggggagagctttcttcttttgcttattaaacttctgttccaaactcattctttgtgtccacgttccttaatattcttggctgtgagagaaagaaggcaaagacaagagcctttatcctaacaactcaattgttggagagaagattcatgcatattctatgtggcatcacacgccatagccctgggattgaaagccatgcagtttaagggatggtgttaatctcagtccaaataggtaataagatctttcacgttgctatattttaggggtaggaatgagattgggggtttgatcaatagtttgtacccataggaccagggatttgcccagtcatctgtgagtaaatgcttgggccagtt

SEQ ID NO: 4637 - DNA, 2414 bp, Homo sapiens
gaacccaggaggcagaggttgcagtgagccaagatcgtgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctggtccaggttcagtgccccagcttggctccttcctccacttcctcccttctctttctctgcctgctgccccaccacccaccccatcactgtctccaagaaaacacaacctgccttttgggggtggagggggtgctcctgttgaagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccaggctacctggctgtgcggtgagcctgggtgagggccagggtggaggcggagggggtgtgtggaacgttctgagatcccctttaggatgaagggaatcgggttccagagagtgaggtaggtgctagcagccacctgctgacctacacctgtcctttggtcacctctgtctgcccacctgtgccaataaattcttgctctgggcatctaattccaaccaccttccccacaatcctgcccacgccttcagccatgggctctccctttctgggcatcccatccaccttgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctcagcccaccgctccctcctgtctctccccaggccctacatggatgtggtcgtctccctggtcactatcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtg

SEQ ID NO: 4638 - DNA, 1743 bp, Homo sapiens
ggggaggcaggaccgtgagctgcaggaggttggtgttggccctgggatgttgggacagagatgttatcctgggagaacagcgtggccaggctatgctgggagcagggtacacgctgccccactgggctgcatgacttcccctcccgcgcccctcagattcctgggtggccttagaacttgggccaaggccacggacgggcagggaggccaggccccccccacagctgcaggcccaggacctttgcccacggtcctattcttcggtgttatcgcttactaaatgcaccccttcttgtccttggctggcaggttgagtgttatgttctccatggcccctggctcgttccacctgcaccaccgccgctcccgtcaggccttttccccatccccactagtggcacaggggatgcccctgccccagtgtgggaagaacagggctgcctgcgggcgacacagcaaggtccagctgactctggaggcctcctggagcctgctcggcccttccccggcccggcccggcccaaagagaaaaacaacaacagctattgaaacatgaaggatcagtttcctcggagctctgggaacccgggggtcccaaaggagagagactctcgggcaggggtgggatacactgtgggccctccacagtcagctctttggaagctgtcaggaggcacccctccaccccccagtttagaaaaatagacatctgtatttttgcatttctgttctccctgcctgactgctgatggcagcagtgacccccatgtgatccctgggccctgagtcacagccgccatccaccccccaccacctttccaagtcatggcttcattcagccctaaatgggaacacacgcctcagaccccaccatgccctggggggtccccacatacgcacactcacacacccacacttgcgtggccccccgatgctttgggggacactagactaggcacagcaacagagcagcaattggggtgtctgcagagcctgcacccccagagcaggcagacccatcctcctggctccccagctctgcccatgggtccctggggcctccctgaccccatggcgcccagccctccatcagcccctccctgagtgcaaaccttggcggtggctctgctaagacgaccccaggacccacaagtggacagagggacggagggaggccagcagcatcgagaccacaaggtctcaacagtgtggaatgagcagcagcagcaacaaatgggaaaccgaggacatcgcaaagaaaagtctgacgccgctgcggccgagtctcaacttggagcacagaaacacagtggcccccgacagctgagggcctgaaatagcagggcaggcctgggggcgctgaaagccctctgcccccttggctctgagcagctgtctgggggcaccagctggagttctcaaaatagccacctgggccaccctgtttgcttgctggagcagagaccctgcccaaggaggagaggctggggaaaggggtgcctaaacgtagagccagagaccagcagaggccacctgcccattccccacgccctcagaacgcagctgcacctttcgacgacctctgtaatactgcaggcaggacccagggcagcggctagaccctgggtgtccgaggagagggaggcacaggtttagaaaaaagattttgcttctcttttgtacaaaaatagactcaagtctcattagcagtagctaaaagtggctgtctttgtataaaactag

SEQ ID NO: 4639 - DNA, 106724 bp, Homo sapiens
attctttccccctcgccgccggcgctctggcagcaggggataaccccggtgcgcgcctctcttcctgtttggtttactcaagcgcctgccccaacgccttctcagtcaagctgggaggaaactgcttcagcttgaaaaggatgcgggcaaaagcccagcccgactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgagccttggccgctttgtctgggatcaggcttatcctcctagcccacggcccgggagggaacaaagagcctcgaccctcaagctctagcctctgcctctcatcggagccccatgcgcccattcatcacctttctaaagacccctttgtctgcctggcaagcacaggtctgcaagggatgcccacgcccctgcccaaagtcctgcttttctaacaactgagctagattggattttcaagccacccagtcttgtgtaaacgacctcataccggtcttttttaccccctcagaatagaccatgtatagattcgttgatgcatgacgaccattccagcccattccttgctagctttttcattctcttccagtccgctttgactgtgctactgttttcctggttttctacagaatagcaagtccttctgtaaggatcaacctgcatcttgctcgcttaaataaatgcttattacctagggagcaggaatattaagaaatggagtgcaggaagtttaagagcatgtgtgtgtgttagcagtcccatctctctctctctcacacacacatacacacacacgcaagggctgttttctttgttttaatcaatgtcagagaaaaatataaactgggcaggcatctctgctggtgtgtagtttctgatagaggacgcctccaaaccggaacagggaggatttccgaaacaggactttgaatagagttgacaatcaggttcacatcctcagaaaaagccttccaagctatgtcagcaacacaaagttgcaccacctcctgggtaaacttcaaagacacagaggccagcgggtggaaggaagtgtgatatttagagaacttagtggggcgggggagagtctgaactcatctagacaaactaaaaaaaatagcagaaatatagtctgtgtgaagctacagtacccagtttctttctaaaactgtaaccatgacgcccatgcgttttagccgtagaagaacaaataaggaagtatccttagtggtactggagtttctaattcaaattataacacattaatctatccaacgtcaaatagaaaaaaaaaaagtagagaaacagagtatacctatttcctgctttctaagctttaacttcagcccttcgagaaaccatctatctccagtatctccttaggtgataggacattgaaaacaggcaaccgtttggtgaataaagacatttctcttgagttctgcccacagattaaaaggacaaggacacacgttctttgttgacacttctgcagtgacttctcctttggcgagagagcacccagggccaacacaactgtcaccacaaccacacagagcaagttgaactcatactgggaacagcttagagaagcacgcacatctcaacaacagcctttgttatttaattcatgacactaaccacgcgcaagctcaaacaaacacacatgctatcctaaccatcactctaccctctatattcacatttcatttatggcttgactttttgtcatatcctgaaatgaagctttgcatttacccgatgagttgcgtctcctggtgctcctcagttcttgctatttcttttgtcttataaaagatcaggagcagacttattgtgcagatcgtccacctcttcctaatggagcgcatcttgggtgcccgagaaagtcctggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttcgggggcgtcactggcccttccctcttgctaggagataaacgctgcgcaaagccaatcaccaggctgagggggcggaggctgcttggagagtaacgtccccggctctgcctgctctgtgccgggagaggaagctcacagtgctacgcgcctgcgagctcgcgcacatacacatatacatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagttctgaaaaaaaagcagctaccatggacctctcttttaaacgcaagtacacccacacacattcggataccaaggaaggaaggaaagaaagaaaggaaagaaaagggaggggaggaaggaagagcaaagtcctctctaaaagtctcaattatatatatagcctctgattgtcacctctcctccgtcccaccatttttcgtacttgtattgggtggcagggacacttttcaagagttctgtgttcgattgttcactctgagtacctctccaccatcctccagtcgttgccctcattgggagagatgcttgctactctgctagtaccacgccttggttccggtctttactgttggctggtaggtcgggaggcacctctagcatgagacagtgtctggaagccaggatttccctcatctatatgcgccggtccccagctccctggtcgccagggtttctctccagttgaattccgtgttccttcaggttgaacagtagcttcagcggtttttcacgctcagaaatgatgaggcccaattccaatcttccctcccgccggaagtaagaaggggaattctgagttgcttgtcgcctgacagcttaaaatagcaacgaaaacagccagcatctttgcttaaaaacccaaggttcccgccagtgtttaccatacttcctctagagtttaagaagttaagaacttccgagatcttgaatttcctctttgcagcacagcgaacggggtcgggtataaaaatgctccaaggagcaagtaattacgaacgtttattgacactacaagtggcccacagggagcctttcgagtttattgatgtctaggcaaatccagcctgcattaatgcatttctgttagattgacttctgttagactcacttttcttctggcaaaaactgccagaataaaacagcttcttatttaagttaaaagggatccggggctgagggcaggggtcgggtgggagagggatgcatggttaggatgctaaattctcaaggataaactttgatttttaaacagtagacaactatattttagattataggtaaaacatcactctctgtcagggatagagtaatatgcatcgtttcattaaactcattatttcttaagcaatggttatggggcaggcaatgtgtgcggagatgggaacacaaagatgaataaaacttagcatctagtcagacacaaatcctactcactcaaagggggcatcttttaaaaataataatttacagtatggcaacatgaatcagaaacatcatttaaaatatatatggtatctgagtaagctcctgggttgaagcagatggggtgtttaagccttttgaagcccggaagatgagtttccgggtgaaggggacacacagactcctgttttcaaagctgacaaggaagtaagccaagcagagggaggatagaacattgcaggtggaaaaaggagtatgcgcaactccagagagtaataaaactctggtgctttggggcaactttgaagtggctcagtactgttagaagggaaagtggtaagggagagtgctggtccaaaagtttcggtgtactcataatattctatggctccagagtgtggaacagtcttctgtaatgagaaagccacaagaaaatcttcaagaggaaagtgagtataatctatattaagctttaaattacattaggggaaactacttacctagcccaaacaggaaaaaacaaacaaacaaacaaaaaaagaaaagaaaaaaaaaaaaaaaaagagcgaaacgaaagcaatcaagaactagttataggaacacataagacaaatttaaatgtccagaagaaaaataagtgaactctccaattgtataatgctgctgtttctgaattttttaagtacagaactttttatattaaggcgagcaattctgaatgactgataactgttcagcgagactccaggaattcttcttcccaaattaaagcaatttagtgtttggagtgtaattgaatgccatttgtttaatattgttagattcgttaaatatatagccattataatttgccaattaaaaagaagccatacaggccaatacttagacaaaagtgaggacagcatggttttttctcaatatgtaaataggtgcaagaactataaatattggataaaaagtcttttggaattaacttctattagaatgcttagtttgatgttcctgagcaccaaaagactataaagaagtcttttggaattaacttcttctattagaatgcttagtttgatgctcctgagcaaataagattgtttctaaattttcatttgatctttggattgtaagttcttcaataaagagaatatatttgtctttattcagcacaattctacaattatacaatagcctataaataaataatgtgagtaatggcagctggttttaaaatgatactttatcctttgacttaatgtaaattcatgttttcattgctggctgtactctcaaatctagctggcaagaaatgaatagatacttgcagtctcatggtggagtttttaatgacccatgacatttttaatagacttttttttttttagaaaacatttaggtttatggcaaaattgaacagaaaatagagagttcccatataactctaccttctccccatactcagtctccctatcaacattcctcatcagagcagtacatttctttttttacattcaatgaaactacatgtacatatcattatcacctacagtacataggtcatattaggattcattcttggtgttgcacattttatgggttttgccaaatatatactgaacatatattcaccattatagtataatacaaattagtgtcactgccctaaacatcctctgtaatctgattattcatgcttctttctcactcccggtcaccccaggctctgacttccctaatgtttttactgtctccacagtgttgccttttcaagtgtcatatagttggaatcatagagtatgtagctttttctgattggattctttaacttaataatatgctccattattttcatggcttgaaaaacaaattttttttcatggcttgaaagtccattttattttagcactaaataaaattcattatatggatatatcaaagtttatccactcacttactgaaggacatctttattgctttcaagtttgggcaattatgaataaggctgctgtaaacatctgtgtacagttttctgtgtagatgtaaagctttcaacccagttgggtaagtagaaataaataagattgttggattatatggtaagaatatgtctagttttgaaagacactgccaaagtgacttccaaggtggctgtaccattttgcattcccatcagcaatgaatgagagtccttgttgtttcatatccttgccaacatttgctgttgtattggtttagattttgaccattatatcagatgtgtagtagttgtatcttactgttgttttaatttgcaattccctgatattatatgatgttgagcaatttacacatgtttatcttctatggtaaggtgtctgttcagaacttttgctcaggtttttaatcaggttcattttcttactcttgagttttaagagttctttctatattgtggataacagttctttatcacatctctttttgaaaatattttctctcagtttgtggcttgtcttttcattctcttgacagtttctttcacagaacagagggttttaattttaatgaagtccaacatattaattattttattgatgattcctttgatgttgtatttaaaatctaaacctaagataaactagatttttaagatatgttaccttttaggcattttatcattttctgtttaggtctataatctattttgagttaagttttgtgaatcatgcaaagtttgtgtctggattattatttttttatcatgtcaatgtctaattgtttcagcaccatttgttgaaaaagctgtcttctctccattgtattgactttgcttctttgtcaaagaaacaaaaggttaaatatatttgggtgggctatcctgtgctttctattgtcttccattgatctatttgtctattctttcaccaataccacactctcttgactgctgaagctttatagtaagtcctgaaatagggtagcatcagtcttccaactttattcttttcctttaatattgtgttagctattctgggtcttttgcctctctgtgtaatctttggaatgagtttcttttttcttttttatttatttatttattatactttaagttttagggtacatgtgcacaacgtgcaggtttgttacatatgcacacatgtgccatgttggtgtgctgcacccattaactcctcatttaacattaggtatatctcctaatgctatccctcccccctcccccccaccccacaacaggccccggtatgtgatgttccccttcctgtgtccatgtgttctcattgctcaattcccacctatgagtgagtgagaacatgcggtgtttgtttttttgtccttgcgatagtttgctgagaatgatggtttccagcttcatccatgcccctacaaaggacatgaactcatcattttttatggctttgaatgagtttcttgatatccaaaaaaatcttattgggattttgattgagcttgcactgaatctatgtatcacgttgggaaggaatgtcatctggatagtttgaatatttctagccatgaatatggactatctctccatttatttagctgttctttaatttatttcattactttttttttacctttcctcatgtggatcttatacatatttaattagttttatacctgaatattttattgtttggggagttaatgtaactgacactgtgtttcatttcaaattccaattgccctttgcaggaactcatggcatttttttttaataatggaaatgttaaatagtatatacttcagagttttttcttcagagaaaaagaaccaataacatttgtatggatagtgaaaatgagatttattttaaggtgtagacctcatgatgcgtgggcttgcaattccaaaacctgcagagtagtctgacaggctggagacctagggaagagctatcttccatgtctgaagacagtctagaggcagaattcgctcttacttagggaacatccatctgtttttaactaagaccatcaactgattgatttaggcccacccacattatggcggtaaatctactttactgatagttttaactgatttaaaagttaattttatttaaagaatactttcacagcaacatccggccttgtgtttgaccacatatctgagtaccatggcctagctaagttgacacagaaaattaaaaagttgaaattttttttgtggttatacaatatagtgaggagtattcatgcttagctttttacctatgaatgaggaaaagcatataaatgagaaaactgctgttaaccactgggcaattatttctctttcatttctttctggacaagacatctagtttaagtatttttttctaaattaatttttacccacatgaattcctatgaaatattaatatttttctgtatgtgtattcacataccttcttcttctgttacattttttcatccataataaccagatataataagcttatgatagaaagatgaccttgacattagggaaaagacacaatcatgaatctagtataatttctgaaagaacagaaaaattccatcattgtccttatcaattcctcctcatgtttgacctgtgtaacttatagcattatcctttgcatttagtactctgatctctctttaaacatgaatgtccttgcaagaggcaattcttaggtaacattagtcaaatagtcttcaatttgtaatatccatttagaatgtcctttgaaagacatcttttaactacttttggtcaaatagatccaatttgtaataagctcttcaattgctcacagtccacattttaattgtttatctacatttatctcctttagttatatagtccaggttagtattgttttattttctactgtatagacccctaaaatgttgtaaacaaacaaatagactatcgcacacatgttttgggaaatcacagatgtcctgttttaatacctagcaatatatttccttttctttgttttctttttgctgtttttctgatcaaatgtgataagaggaactgtctagtaggaacagagtaatcagtaaacaaaatatccctccaacctgctctcctattgaaaagtcatcatttactaggcaattttctatgtcactatctctaggaagtttattatttggagttgtaatttcttcatatttgtgggctttttaaatattctcacttgtatgtggtttagccaacttatttcacctgtcataggatcttttgtctctcatactgtccaatccaatcacccacttaatttcttcatttgagtaactcatcttccttttattctatttttaacccttcatattaaaagcaaaaggagaaataatgttacatattgtgcaaggctaaaaatttatttgtataagtccatgtcttttgagatctacacacctacataactgcttttagagttctaataaaaacagtgagtatcactgaaaaatattgcatcaaaatacatattattacatggagcagttctatgtacattgaattttgtgaaggaaatgacattttaaatattcttttaatatttattgtttgaatgttataaaaataagaatactgaaatcattaatgacagactaagtgatggacatagcctgtagaagacttttgtttctttgtaaattgggttgaaatagaacacccccccacacacacacacagtgccagtacttcaaattgcttttcagaaatatcatgcgatttgttaatgccagacttacctactctaagagtaacaattagatggagttgagtaacaattgtgtcatcttactttatcttaaatttttgtttattccaaaaattttattcagtgatttaatttacttggaccctacatgaatttgagtttgcaatccttaaagtgaataattctattacgacatacaaatttcataactgacctgcttaatagattaaagtttcaataatcttagcatttgtaaagtgaatagttgaggaaataaccaaataaaactcgtatgaactaaagtttgatgccaactctagagatgcctaatcagtcagcaggagaaagttgctctgggagaatgaatcaatagatatttattggagggagcctgtgggaatacaagaaaaataatgaatcttattcacatctgacctgggcctacccaacataatataaataattgatctctcctctgtatttccacaattataattgcctacatttcaccagaaaactttatgtcaatacctatggatagcatagatattgtggttaagcacatgatgcttacaaatatcaaagtttatgcaaattgtgacagcttatgttagttgctgtctgattgtaatcccatcaatagaaaaaaacaaacaaatacatattaaactctaccaaaagatccaaactatcaggatttttaataacttttgtatgacctacatgtaaagaaagttatttgctttgtgactacatgtcttacatgggaacatgaagaaggtagcagagtggatttttccacatgtttttggcagattaataaatttaaagtgagttctcaggaatgaattgattattgtaactttttttaaagtgtaaaattcttgtgaacactaacctagaacctatagagattttgaaagtgtgtagctaatattacagacagctactatatctctactaaggtgagcagagaggtttggacaattgatgattcttgtttatttttattttatttatttatttatttatttttgagacggagtcttgctctgtcgcccaggctggagtgcagtggcgcgatcttggctcactgaaagctccacctcccaggttcacgccattctcctgcctcggcctcccgagtacctaggactacaggcacccgccaccaaggccggctaattttttgtatttttaatagagacggggtttcgccgtattagctaggatggtctctatctcctgacctcgtgatctgcccacctcggcctcccaaagtgctgagattacaggcttgagccaccacgcccagccgatgattcttgtttatggatgctgagatctctttgaggatgtagtcacctataggaagcatcaaaagtagcctcatatcaggaaatctctatgacaaactgtagcaccaacccaaatagacacttcaaactaacagttgattcaactacccacctaatcagttggcatagttattcacaatctgtatgtagtcaaggggttaaagatgagactaaaaccccaaagaagactttggaaatgatgtatgtttacctgctctctttacatagaaaaaactgaattagtgttagcaagtgatttgcatgtggtattcattcattcattaatcaaaacatatttcctgtgcacatgctctttgccaggcattaaactagacactaaggatatagcagaatacaaaacagaaaaacatcctcctcttgagggctatcatttttagatgtagaaaggtataataaaaggaaaaaaatggaggtaattattgtgattagtgctatgaaggaaccaacagggcaatgtaactgagagtaataaaggagcttttctttgaataggatttccatccaagggctttctgaggaggtgacatttgaattgaaacccgcagaataagaacagaatggggaagagccttatagtatgaaagaatagaaagtgcaaagattaggaagtggaaattgtaggcagaaacgtcaggaaataaagaatacaatggaagccattatactgagcacaataaattaagaaagatagaatagtatatagggatggatttattgaaagcaaatttctgaaataactataccaaattctaaaaaagcaaaccgatttaggacatgtaatattatttttaggcagtgatgaatttaaatagagtcctgtcaatacagttatatgactattttcagttgagttcagttgtacagagtttagacatagaaaatgtatgtacttgagttcaagcagtgaagagaaaacaagagttgtaagtgcttaaaaactcatgataataaatatgaaccaccaaatataagagggtaacaaggagagtgaaaacagaaagggaatcatgcataaagataaaatctaaagctccttgggatgaaatctcaattttgaggtactacctgagaagttgagctgaaaagatgagagatatttagtaatactgagaaagtgagatggttacaacttggatttctgggggaaaataagtcattgatgtacaagagtgtttccatgggaacagaaaactaaatcaaggtgaaaccagattttgctagatatgagggagtaaaagacagagagagactaaggttttgaagaactcatcaatacaattatttaactcactaagaacgataatgagtatggattacatgagctgtgcgtgactttattttctggggaataacaggtgatctgtagatgacagcatgaggagtagtagagaaaaatacaaccggtggtataatctccaaaggacatgaagagatgttttgtgtatgcaatggagaacccaaaaagatacctttcctattcctggccatgacttagatgacatgtcaaagaaaagcagccttcactttgtaaggtcatgctgaagtaggagagatgtctcctcaaatgctcagcagtgatatcaagtgatgagactactagtttatttaatcatacattattaaaaccaaaaggcaaacaaatcatactttttagtaactcgagattgcagagtattcttattttttattaatgtgaattttaataaatttaaaatttttatttctgttcaagcggcaaacttttttactcgacgtcatttaagatgcattcaaatttgcaattcaaattttttgttaaaatgtttcatcttgattgttttctaatctagttatgaattttattagttggctttattaataacaaacaaccccccaaatgacagtggctacaactgacattgatttattgttccagacagatatccatggctgtggatcaacttctgtggctctgttccccttgtcttctcacaccagattccagcctcttcaagaagtggtccttatttgggacatctagcaagacagacctgtcagaaacacttgatgccttctgaagtttttctttttcttctcagatgtttctatacgctatattccctcacattccattggctaaagcttgaaatgtggccaggccctaaatcaatgggacaataatgtagtacctctttaaggaggtctctataggccgcatgtcaataaatgattcaggataaagcccttactagaaagagaacagagcaaaaattgagcggcaaaaataagatctaccgctggaaggtggtactgatccctcacacaagttatgaaaatgtggtggataaatcattgagaaactaatattcaggagataaatccacactttttaaagagacatgtatctgtcatgaataaaatccaaatgctgacgatgtcttcagggtccaagaggatagaggatttaagaaaagaataaatgtcaggaatactttttttctgaaaaagtctagaaaataaaaacaaatgaaacaatgagaataatactgttgtaaaaagaaggtagttaattaatatctctaaaattctcataagtgacaattcttttatggtaaaatttccgtgatccgacgtctggccaccaaatttactgactaaggtacatgattctatcatcactccacaaatgttccatatatcaaagggcagacaggtattattaaacccatgaagcaaagagcatgttttattcatctcaggatggagatagttctgccagatgtctaagtgtatttgaaggctgatggccaaagctctctttccataaaaaagtggtgaactagcagctgccaaaacctgtatcttcaagtttcttttctataggattactggtttaatcttaatactttctgattgacccatttattgtttagctttcttaatccatataatcaggttgcatttatgtgttcacagcatgaagctatcctgtctcatataacattgtatctctgatctttaattttaaaatttctccccccaaaagcaaccactattgcctggcacagtgtggttcatgcctataatcccaagcctgtaatcccagcagtttgggaggccgaggcaggcagatcactaggtcagaagatcgaggccatcctgaccaatatggtaaaaccccatctctactaaaatacaaaaacacaaaaaacaaaacaaaacaagaattagccaggtgtggtggaacatgcctgtagtcccagctgcttgggaggctgaggcaggggaatcacttgaacctgggaggcagaggctgcagtgagctgagatcgcgccactgcactccagcctggtgacagagtgagactccatatcaaaaaaaaaaaaaaaaagcaaccaatattcccactcctttcctaaaatttagagggttcaccttccagagaactgatatcttatttacatattcccaaatcttaaatttagagaaaacttccccttagttataacacctcaattaattaataatgtttatatttgagagatagacttcaagaaatcttggatatcacattaataatccaaaatgtctcaatgatcaaggcagaaagacttagagagcaatgagctatgagcataaaggtgttcacaaaggtatgataatgagtttggttatcctttctcattgtccactctagactttagccagaatcatttttttctcttttttttaaattatactttaagttctagggtacatgtgcacaacgtgcaggtttgttacatatgtatacatgtgccatgttggtgtgctgcacccattaactcatcatttagcattaggtatatctcctaatgctatccctcccggctccccccaccccacaacaggccctggtgtgtgatgtcccccaacctgtgtccaagtgttctcaatgttcaactcccacttatgagtgagaacatgcggtgtttggttttctgtccttgtgatagtttgctaagaatgatggtttacagcttcatccacatccctgcaaaggacatgaacgcatccttttttatggttgcatagtattccatggtgtacatgtgccatattttcttaatccagtctatcactgatggacatttgggttggttccaagtctttgctattgtgaatagtgctgcattaaacatacgtgcattaaacatacatgtgcatgtgtctttatagtagcatgatttataatcctttgggtatatgcccagtaatgggatggctgggtcaaatggtatttctagttctagatccctgaggaattgcaacactgtcttccacaatggttgaactagtttacaatcccaccaacagtgtaaaagtgttcctatttctccacatcctcttcagcacctgttgtttcctgactttttaatgattgccattctaactggtgtgagatggtatctcattgtggttttgatttgcatttctatgatagccagtaatgatgagcattttttcgtgtgtcggttggctgcataaatatcttcttttgaaaagcatctgttcatatccttcacccactttttgatggggttgtttgatttttttcttgtaaatttgtttaagttctttgtcaattctggatattagccctttgtcagatgggtagattacaaaaattttctcccattctgtaggttgactgtttctgatggtagattattttgctgtgcagaagctctttagtttaattagattccatttgtctattttggcttttgttgccattgcttttggtgttttagacatgaagtccttgtccatgcctatgtcctgaatggtattgcctatgttttcttctagggtttttatggttttaggtctgacatttaagactttaatccatcttgaattaatttctgtataaggtgttaggaagggatccagtttcagctttctacatatggctagccatttttttcccagcaccatttattaaatagggaatcctttccccaattcttctttttgccaggtttgtcaaagatcagatggttgtaaatgtgtggtattatttctgaggcctctgttctgttccattggtctatatctctgtgttggtaccagtaccatactgttttggttactgtagccttgtagtatagtttgaagtcaggtagcgtgatgcctccagctttgttcttttggcttaggattgtcttggcaatgcaggatctttttcatctcatatgaactttaaagtaatcttttccaattctgtggagaaagtcattggtagcttgatagggatggcattgaatctataaattaccttgggcagtatggccattttcaccatattgattcttcctatccatgagcatgggatgttcttccatttgcttctgtcctcttttattttattgagcagtggtttgtagttctccttgaagaggtccttcacctcccttgtaagttggattcctaggtattttattctctttgaagcaattgtgaatgggagttcactcatgatttggctctctgtttgtctgttattggtgtataggaatgcttgtgatttttgcacattgattttgtgtcctgagactttgctgaagttgcttatcagcttaaggagattttgggctgagacgatggggttttctaaatatacaatcatgtcatctgcaaacagggacaatttggcttcctcttttcctaatggaataccccttatttctttctcctgcctgattgccctggccagaacttccaacattatgttgaataggagtggtgagagagggcgtccctgtcttgtgccagttttcaaagggaatgcttccagttttgcccattcagtatgatatcggctgtgggtttgtcataaatagctcttattattttgagatacatcatcagggatattggtctaaaattatctttttttgttgtgtctctgccattgccagaatcatttttacttttgggtaataatttgcaatcagtgaagtgtaccgttcttaagtgttcaatgtaataattttggtaaaatctgtaagcaataaataacactttgatcaaagcatagactattttcatcatcccagaatatccctttttccctctccctagtaaaccccatctatcataaacgatcattctctattatttatctcaccataaatatttacctgttcttgagctccataaaaattgatgtatgcagtatctgttgtttgagatctatgttttgagtgttctcaatgttgtggtttttagcagttcatttgccaaaaaaatattgtttggtattctattgaataaatatacctcagcttgatcatttattttcttgttgatggatagttggggttattttcagtttgaggcttttatagataaacttagaactttgcaagtcttttgtggaaaaaagatattcatttctcttggaaaatatttttattttcaggggtgataatgtttggtcatttaatacgtgtgtgtgtgtgtgtgtgtgtgtttgtgtgtgtttcactcccccatcattgtattaaagttctagctattccacattatcaccgacatttgatattttcagtctttttcccaattttgtaccttctattgaatgtgaagtattatctcattatgttcttggccatttgtgtatattcatctttgaaatttctgtaaagaaatgcacctatttttattgtgtctgttttctttttattattgagttataggagctctttatacaatccggacaaaatataaggttgtaaaagcaatgtgattttaatgacattacttctaatggcaaaaactgcagtaagttgcaccaatttaatacttcatcacatatacctattctaagtatttttccctaatctaaagcttcccttttcatttccttagagcggcataagaatgagcagatgttttaaatttggtaaagttcaatttatcagcttttcttctatggcttgcgttttttgtgtcctgtctaaaaacccctttgctctccacagagttgtgtgtgtgtgtgtgtgtgtgtgtgtgtgtatatacatatacacatatacgcacacatattctacttcagaattttaggttcaatatcaaggcctgttatccttttcaaattaatgtttgtatgttatatattattggttaagatatattttgtccatataaacattgagttgtttcagcactatttatgcaaaatacattctgttctcccttaattgttttgacattttcattaaaacccacttggccatgagtaaaactatttccagaatttgtattttattttattgatatatctgttaattgttatacaagcataatactattttgattaatgtagcttaatagtaagtcttaaaatcagtagaatgtatcctccatttattttattctccaaaaattttgttttcctaggttctttgcatttccatacacattttagaatcagttcatcaatttctttaaaaaacaaacaaaagcctgttattattttgattgggattgcaatgaatatataaatccatttgtggagaaaagacaccttgacaacatcaagttttctaatccataatcatggcgtatttttccatttatttaggttttaatttatctcagctatgttttaaactttttaatggagatgtcttccacattttatgttaaatttatttctaaacattttttaaatactactttgaatggtaattttaagctgttatttttcaattctttcttgctattaaatagaaatataactttttaaaaggcattaaccttgcattcaataataaatctaaaattatttattagtttctttgtccacagtttctttatccactcgttgattgatgggcatttgggttggttccacatttttacaattgtgaattgtgttgctataaacatctgtgtgcaagtatctcttttacataatgatttcttttcctctggatagatacccagtagtgggattgctggatcaaatggaagttctacttttagttctttagggaatctccacactgttttccatagtggttttactagtttacattcccactagcagtgtagaagtgtcccctgttcactgcatctatgccaacatctattattttttgtttttttgaacatggccattcttacaggagtaaggtggtatagcactgtggttttgatttgcatttccctaatcattagtgatattgagcattttttcatgttttttggccatttgtatatcttcttttgagaattgtctatgcatgtcctttgcccatgttttgatgagattgtttgtttcttcttcttgctaatttgtttgagttcattgtagattctgaatattaattagtcttttgtcagatggatatattgtgaagattttctcccactctgaggttgtctaagtactctgctgactgttccttttgccatgcaaaattcttttgcttaattaagtcccaggtcaaatggatagactgtgaagattttttcccactctgggggttgtccatttactctgctgactattccttttgccatgcaaaagctcttctgtttaaaagtcctagctacttatctttgtttttattgcatttgcttttgggtgcttggtcatgaaacccttgcctaagccaatgtctagaagggtttttctgatgttatcttctagaatttttacagttccaggtcttagatttaagtgtttgatccactttgagttgatttttgtataaggtgaaagatgaggatccagtttcactctcctacacgttgctcgccaatgatcccagcaccatttgttgaatagggtgttcttttctcactttatgctttgctttatggtttgctttgtcaaagatcaactggctgtaagtatttgggtttatttctgggttctctattctgttctatttgtctatgcctatttttataccagtatcatgctgttttggtgactatggccttatggtatagtttgaaatcaggtaatgtgatgccttcagatttgttctttttgcttagtcttactttgactatgcaggctcttttttggtttcatatgaattttaggatttttttttctatttctatgaagaatgatggtggtattttgatgggaattgcattaaatttgtagattgcttttggcagtatggtcatttgcacaatagggtttctacctatccaggagcataggatgtgtttctatgtttatgttgtctatgatttctttcagcagtgttttgtagttttccttgtagggatctttcaccttcttggataagtatattcctaagtatttttttttttgcagctattgtaaaagagattgaatttttgatttgattctctgcttggtcattgtcagtgtacagaagatctacaaatttgtgtacattaattttgtatcctgaaactttgctgaattaatttatgagttctaggagctttttggatgagtctttaggattttctaggtataaaatcatatcattagccaatagtgagaatttgatttcctctttacccatttggatgctctttatttctttctcttgtctgattgctctggctgggacttctagtactatgttgaaaagaagtggtgagagtgggcatccctgtcttattccagttctcagagggaatgttttcacatttttcccattcagcattgtgttggctgtgggtttgtcatagatggcttttattagattgaggtatgtcccttctatggtaattttgctgaggattttaatcataaagggatgcttgattttttcaaatgcttttctgcatctattgagatgatcaggtgatttttaattctgtatatgtggtgtatcgcatttattgacttccatatgttaaaccatccctggtatgaaacccacttgatctcagtggattatctttttgatatgtttttggagtcggttagctagtattttgttaagaacttttgcatctatattcatcagggatactggtctgtagttttttttgttttgttttgttttgttttttggttatgtcatttcttggttttggtcttagggtgatactagcttcatagaatgatttagggaggattatttctttctctatcttgtggaatagtatcaataggattggtaccaagtcatctttgaatgcccagtagaattcagctgtgaatccatctggtccccaaatttttttttttggtaatttttttattaccttttcaatctcactgcttgttattggtatgttcagggtatctaattcttcctgatataagttaggagggttgtatctttccaggaatttattcatctcttgtaggttttctagtttatgtgtgcaaatatgttcacagtagccttgaattatcttttgtatttctatggtgttagttttaatatctcctgtttcatttctaattgatcttatttggattttctctcttttttcttggttaatcttgctaatagtccatcatttttatttatcttttcaaagaaccagctttttgtttcatttatcttttgtattttttctttgtttcaatttcatttagttctgctctgatgttagttatttcctttcttctgctgggtttgggtttggtttgttcttgtttctctacttccttggggcatgaccttagattgtctatttgtgctctttcagactttctgatataggcatttaggactatgaacttttctcttagcactgcttttgatgtatcccagagtttttaataggttgtgtcactattatcattcagtttgaagaattttttaattttcatcttgattttattgttgacccaatgatcattcaggagcaggttatttaatgtccatgtattttcatggttttgaaggtttcttttggagttgatttccggttttatttcactgtggtctgagagagtacttgatataacttcaattttcttaacttattcaacttgttttgtggcttatcatatggtctatcttggagaaaatttcatgcaccgatgaaaagaatctattttctgtggttgttaggtagaatgttctataaatatctgttaagtctatttgttccagagtatacttgaagttcattgtttctttgttgactttctgtcttgatgacatgtctagtgctgtaggtggagtattgaagccccccactattattgtgttgctgtctatctcatttcttaggtctagtagtaagtgtatcatacatttgagagctccagtgttaggcatgtatatttaggattgttaaatcttccttttgtacaagaccttttatcattatataatgtccctcttgtcttttttaactgctgttgttttaaagtttattttgtttgatataagaataggtagtcctgcttgcttttggtgtccatttgcatggaatatctttttccaccactttaccttaagtttatgtgagttcttatgtgttaggtgagtctcttgaaggaagcagatagttgatttatgaattattttcattctgcaattctgtattttttaagcagagcatttaggccatttacattcaacattattattaagatgtgaggtactattccattaattgtgctatttattgcctgtataccttgtggggtttttttttgtatttttattttataagtcctgtgagatttatggcttgaaagagattctgttttgatatgttttcaggatttgtttcaagatttagagctgcttttagcagttcttataatgctgtcttggtagtggcatattctctcagcatttgtttgtctaaaagagactgtatctttccttcatttataaagattagttttgctggatacagaattcttggctgataattgtttgaggagactgcagatggagctccaatcccttttaggtcgtagggtttctgctgataaatctactgttaatctaatatgttttcctttatagattacctggtgcttttgcctcacatctcttaagattctttccttcatcttgactttagataacctgatgacaatgttcctagctgatgatctttttgtgataaatttcccaggtgttctttgagcttcttgtattgggatgtctaggtctcttgcaaggctggggaagctttcctcagctattcccccaaatatgttttccaaacacttggatttctcttcttcctcagcaacaccagttattcttgtttggtcacttaacataatcccaaacttcctggaggctttgttcatttttttcttattcttttttctttgtctttggattgggttacttcaaaaaccttgccttcaagctctgaagttctttctcctgcttgttcaattctaatgctgagactttctagaacattttgcatttctctaagtgtgtcctttatttcctgaagttgtgattgttttctgtttatgctatctatttcactgaagatttctcccctcatttcttctatcatttttttttcaatttccttacattgaacttcatctttctctggtacctccttgattagcttaataactaacctgaattctttttcaggtaaatcagggatttcttcttggtttggatccattgctggtgagctagtgtgatttttgggggtgttaaataaccctattttgtcatattaccagaattgtgtttctgtttccttcttatttgggtaggctatttcagaaggaaggctactgttcagtttcttttgtcccacaaggtgttcccttgatgtagtatgctccccctgtcctagggatgtggcttccagagagctaagctgtagtgattgttatctctcttctggatctagccacccagcaggtctacccgtttccagtctggtcctgggggatatctgcacagtgtcttgtgatgtgaatgatctgcaggtatcttagccatgaatatcagcatttgctctggtggaagtaacaggcaggtgaaatggactctgtgaaggtctttagttttggttgtttagtgcactattttttgtgctagttggcctcttgccaggaggtaggctttcaagagagcatcagctgtagtagtgtccaatcttaatgtcttttagacaacatgaaataatgcaaaaatagtaccaagattagtccaatacaacagtataaaatttataggcaccatgaacaatgtactttatacaaaacaaaaagcctcctgaattctagagtggcaagttctttgagctggtgttatgacttgaacatgtgcatcccgcaaactcatatgctaaaatcctaattccccaatatgatgatattaggaagtggggcctttggaagatcataagggtggagcccacatgagtggtattagcacccttataaaagagacccgtagagctcactagttctttctatcatgttagaacacagcaagaagatagctgtatatgaaccagaaagtagaccttcaccagacatggaatctactggtgccttgatattgaaatcctcagcctccagaactggagaaataaatgtttgttgtttaagctacccaacctatgatctatgttcttttgctatagcaatacaaacagatcaagatagctggaaattattttcatcttcttagagaactatgaatgcatggctggggttggggaaagactagaaataggtcacaatatcctatattgtgaggggaaatggcattatcctggagaaatataagtgtccaacaaatattttagtgtgccagaaatctccctttatgcttaattatgatcaccatgctctgtcataaatgaagtactccagatatccaggagagattgccagggacaatggcttttcgctcgatcagaactccagcttcaattctgtattactaatactgtactaaaaatcttcaggtttttctagatttaaacaagtctgagtcatcctgttgaccaattaaggcctaggcattggaatgaattaaaattaatcattatattaatatgttagctgataaagatactctgattttctgtaaggattatgccttatatttggtacaggaaacagactgtgagatgaagacttgaatgaagaaagttgatttaccagtgcctttgatattaatatctgtgttggggtgaaggaaggaagtttgggcagagaaaatgtaaactgtgattcagtcttaacaaaagccttagcatatccacaaggaactctgaatctgagaaagcctttcagtgttatccagcctcgaagcacagggatcaggtcttgatatcattttattgatcagtcatagattgggtttcttcagggtacaaatattaccctgagcaggcagctctctttgacttaaggcaattcatggagagggattcagcagggaaccattatctgttgacagttctgaaggagatctctggattgtgcaccacagcatccactatggttcaccccttgtgctatcttagtccacttccaccctatgataaatttcacacatattttatgtgacgcttattagtctataattcaagataaacttacaaaaagaagggaagtgggataaattatcatccctgcttctgcaagtggtcttaagactgaggctttaccatgtagattttctatcattattacctttcaggaccactactgattagggttgtagtacagcagctgattaagctcaacttccattagttggacaagataaattcctatattgttataaatgtaggcagatatagagggactggtacaccaatggtgggtgttacaagggtctggaccactgcatattcctgattttagatgtatcatttctatgttacaatgtgtttctactaggcctgccttgcttatgacatgaagggtctgacagaactcagctcatgatttgcagggcaaatggccacttaatttcttatggttaagtatttcttctataccagggccaaataacatgctagaaacagagtttttttttttaatgttgcataattctccactatgccataaataacaaagaatcattacccattacccaaacctctgtataagaatatgccaggttggtacagcttttactttttctagcttttctctattgcagaatacttttctggtctggacctactcaaagatggcaggtatgcatgtcactttgttaatagcttgtggcaatattcttaagtgtgggagatgctacttctctttttcttttccaccaccccctcctctctctttccttatctcaataggccccatatatgaaaactggctcaagttcagaaactgtcaagaaccatggaattttattggagatgctgccctcagtctactgaccatccatgcttaatttcttttgattgtgcatatggagaaactttcatcagctccccacctgaggatgctgctatctattaactacctccatagctctctgagagtcatggcctacaggtggccattgtgatttttccactagttatggcaactggttccatcctgtttctgatgattaaatactgcttttggcctccaccttttcaagattccattaccttttgtgtcatcgaggaacccagttctgtaacagtatttattactcataagtcctcccagtagagggcaggtgacattgagtttctccaggatgatatttctctcactagtacatcacatattgctttggcaaatgcggctcttcttcagaatatggttaaatggcgaattttctggccttacatagtatattcagtaggttggccacttttgtaaaattttaaactcttctttgccacgtctggcagtcttggcatttatactttacctactataaactaccactttctcaaaacttctaataactcaatcagtatgttaacactgttttctgaggttttcatcaaagtgtcaaatccttttgggatagttttcctttatcaataaactggccagccattatccattctcatgttctaccttctttgatacaagagcctctggatacagaccaaatcacactctcctaactccttccagtatacagtcatccctggtatccacaggggattggttccaggacctcccctggatacccaaatctgtagatgctcaagtcccttatgtaaaatggcatagcattggcatataatctatggacataatcctgtatactttatatcatttctatattacttacaatacctaacacaatgtaaaagctgtgtagttgttatactttttaaaaaaatttctacattattattttttattgtatttttgtcatattttcaatctgcagttagttgaatctgtgggtggggaacctgtgaatacaaaggactaattgtatattgactaggtcttgctgaacccattagaagtttgttgagagatgtcctcaggtctttttgggatatagtcgcttatctttcttaacatgcctagcactttcccagcatgtaagctaaaaatggagttgagtttagatgctgaggagtgttcaagacactgggtgaggtggaaattactgcatcattttcagacaatgggggcattctagtctttattaggaagcaatgtgcatcttcttcaagcccagagtattcaggggatttgggtttagtgatttttaatccatcaacaaaaatatttccaactcaaggctcagggtcccaagcttttccaaccaggaatctatcattggcattaacatagcctttgttggctatgaattcgacctcctctggaaggctctctgctgctattataattataatactataattgattcttggacctgattctcaggttttttcctgccctctatctttaggaaataagagtccctttttaacctgccaaggaggccctctgaattttacagttgactttcatgggtgattaatcacccacaacattttattggtcttctctgatgtatcaatgtcactcagctaaaacatctaattcaatttccttctaacactccccttagccagtcaaaagccgagacactgaaattttgagtgcattaacttataccagcataccatcccaatttatcaaaggttagagttttaacaattgcactgctataattacagtactccatctcctcccaataatgatgccgcccttaccagctggctgatagaggaacaggcttcaatatctcatattaagatatgtttacttagacttgatgatgccaatgtcttaagtcaggattccctgaaaagaaatgaagatggattttgcatgtgggaactgtgttgggcagtatcctcgaaatcaacattttaaacatgtaaagtcactagaatttggcaaaggaagaagttaagcttcaatgcagttacaaggatggcctcaaatagtttcaggagaagcgcttgagccaaaaagacccttcagagtcatcttgccttgagacaaaggagccatgactttacacttttatactgacaatgaataggtttaaatgttgggaagggtcctgacacgagcacacgtttccagctaaaagaaagttctaaagagagacttagctgctcacattttcagaaggtggtggaatgagtttctcagtcctgcaggaggagtctgggtggcacgtcatattatccattacagaaagtgattgcaaattacattgtgttactcacttcttcttgatttcatgttcataagtactttaggcgctttttccctcccggcttctactataacttctgggagtagtaaggatattgattcaggtttccttatgtttattttcctttttttttttttattataccttaaggtctaggttacatgtgcacaacatgcaggtttgttatatatgtatacatgtgccatgttggtgtgctgcacccattaactcatcatttacattaggtatatctcctaatgctatccctccccagtcccctcaacccatgacaggccccggtgtgtgatgttccccacccagtgtccatgtgttctcattgttcaactcccatctatgagtgagaacatgcggtgtttggttttctgtccttgtgataatttgctgagaatgatggtttccagcttcatccatgtccctgcaaaggacatgaactcatccttttttatggttgcatagtattccatggtgtatatgtgccatattttcttaatccagtctatcattgacggacatttgggatggttccaagtctttgctattgtgaatagtgccgcagtaaacatacgtgtgcatgtgtctctacagcagcatgatttataatcctttcggtatatacccagtaatgggatggctgggtcaaatggtatttctagttttagatccttgaggaatcgccacactgtcttccacaatggttgaactagtttacagtcccaccaacagtgtaaaagtgttcctatttctccacatcctttccagcacctgttgtttcctgactttataatgatcaccattctaactggtgtgagatggtatctcattgtggttttgatttgcatttccctgatggccagtgatgatgagcattttttcatgtgtgtgttggctgcataaatgtcttcttttgagaagtgtctgttcatatccttcacccattttgatggggttgtttgactattgttgtaaatttgtttaagttctttatagattctggatattagccctttgtcagatgggtagattgcaaaaattttctcccattctgtagcttgcctgttcactctgacagtagtttcttttgccgtgcagactctctttagtttcaattagatcccatttctcaattttggctttggttgccattgcttttgctgttttagacatgaagtccttgcccatgcctatgtcctgaatggtattacctaggttttcttctagggtttttatggttttaggtctgacacttaagactttaatccatcttgaattaatttttgtataaggtgtaaggaagggatccagtttcagctttctacatatggatagccagttttcccagtaccatttattaaatagggaatcctttccccattgcttgtttttgtcaagtttgtcaaagatcagatggttgtagatgtgtggtattatttctgaggcctctgttctgttccattggtctatatctctgttttggtaccagtaccatgctgttttggttactgtagccttgtagtatagtttgaagtcaggtagcgtgatgcctccagctttgttcttttggattaggattgacttggcagtgtgggctcttttttggttccatatgaactttaaagtagttttttccaattctgtggagaaagtcattggtagcttgatggggatggtattgaatctacaaattaccttgagcagtgtggccattttcatgatattgattcttcctatccatgagcatggaatgttcttccatttttttgtgtcctcttttatttcgttgagcagtggtttgtaattctcattgaagaggtccttcacaacccttgtaagttgtattcccaggtattttattctctttgaagcaattgtgaatgggagttcatgcatgatttggctctctgtgtgtctgttattggtgtataggaatgcttgtgatttttgcacattgattttgtattctgagactttgctgaagctgcttatcagcttaaggagattttgggctgagacaatggggttttctaaatatacaatcatgtcatctgcaaacagggacagtttgacttcctcttttcctaattgaataccctttatttctttctcctgcctgattgccttggccagaactcctaacactatgttcaacaggagtggttagagagggcatctctgtcttgtgccagttttcaaagggaatgcttctagtttttgcccattcagtatgatattggctgtgggtttgtcataaatagctcttattattttcagatacgtcccatcaatacctaatttattgagagtttttagcatgaagggctgttgaaatttgtcgaaggccttttctgcatctattgagataatcatgtggtttttgtcttttgttctgtttatatgatggattagtttattgatttgcatatgttgaaccagccttacatcccagggatgaagcccccttcatcatagtggataagctttttgatatgctgctggatttggtttgccaatattttattgaggatatttgcatcaatattcatcagggatattggtctaaaattctctttttttgttgtgtctctgccaggctttggtatcaggatgatgctggcctcataaaatgagttagggaggattccctctttttctattaattggaatagttacagaagaaatggtaccagctcctctttgtacctgtggtagaattcggctgtgaatccatctggtcctggactttttttggttggtaggctattaattattgcctcaattttagagcctgttattggtctattcagggattcaatttcttcctggcttagtcttgggagggtgcatgtgtccaggaatttatccatttcttctagattttctagtttatttgcatagatgtgtttatagtattctctgatggtagtttgtatatctatgggaacagtggtgatatcccctttatcattttttattgtgtctatttgattcctctctctcttcatctttattagtcttcctagcggtctatcaattctgttgatcttttcaaaaaacctgctcccagtttcattgatttgttgaagggttttttgtgtttctatctccttcagttctgctctgatcttagttatttcttgccttctgctagcttttgactgtgtttgctcttgcttctctagttcttttaattgtgatgttagggtgtcaactttagatttttcctgctttctcttgtgggcatttagtcctataaatttccctctacacactgctttaaatgcgtcccagagattctggtatgttgtgtctttttttgttctcattggtttcaaagaacatctgaatctctgacttcatttctttatgtacccagtagtcattcaggagcaggttgttcagtttccatgtagttgagcagttttgagtgagtttcttaatcctgagttctagtttgattgcactgtggtctgagagagtttcttataatttctgttcttttacatttgctgaagagtactttcctttcaactatatggtcaattttggaataagtgtgatgtggtgctgagaagaatgtatattctgttgatttggggtggagcgttctgtagatgtctattaggtcagcttggtgcagagctgagttcaattcctggatatccttgttaactttctgtctcgttgatctgtcttatgttgacagttgggtgttaaagtctcccattattattgtgtgggagtctaagtctctttgtaggtctctaaggacttgctttatgaatctgggtgctcctgtattggatgcatatatatttaggatacttagctcttcttgttgaattgatccctttaccattatgtaatggtcttgtctcttttgatctttgttggtttaaagtccgttttatcagagactaagatcgcaacccctgcttttttttgttttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcatttagcccatttacatttaaggttaatattgtgatgtatgaatttgatcctgtcattatgatgttagctggttattttgcttgttagttgatgcagtttcttcctagcctcgatggtctttacaatttggcatgtttttgcagtggctggtactggttgttcctttccatgtttagtgcttccttcaggagctctactgaggcaggcctgatggtgacaaaatctctcagcatgtgcttgtctgtaaaggattttatttctccttcacttatgaagcttagtttggctggatatgaaattctaggttgaaaattattttctttaagaatgttgaatattggcccccactctcttctggtttgtagagtatctgctgagagatcagctgttagtctgatggatttccctttgtggtaacctgacctttatctctggctgcccttaacattttttccttcatttcaacttcggtgaatctgacaattatgtgtcttagagttgctcttctcgaggagtatctttgtggcgttctctgtatttcctgaatttgaatgttggtctgccttgctagattggggaagttctcctggataatatcctgaagagtgttttccaacttggttacattctccccgtaactttcaggtacaccaatcagacgtaaatttggtcttttcacatagtctcatatttcttggaggctttgttcatttctttttactctttcttctctgaacttcacttctcccttcatttcattggtttgatcttcaatcactgataccctttcttccagaattggctactgaaggttgtgcatgcatcacatagttcttgtgccatagttttcagctccttcaggtcatttaaggtcttctctatgctgcttattctagttagccatttgtccaattttttttcaaggtttttagcttctttgccatgggttcaaacatcctcctttagctcggagaaatttgttattactgatcatctgaagacttcttctttcaactcatcagagtcattctctgtccagctttgctctgttgctggcaaggagctgtgttcctttggaggagaagaggcgctctgatttttagaattttcagcttttctgctctggtttctcccaatctttgtggttttatctacctttggtctttgatgatggtgacgtacagatggggttttggtgtggatgtcctttctgtttgttagttttccttctaactgtcaggtccctcagctataggtcttttggagtttgctggaggttcactccagaccctgtttgcctgggtattcccagtggaggctgtagaactacaaatattgcagaacggcaaatgttgctcccttatctttcctttggaagcttagtctcagagggacacctggctgtatgaggtgtcagttggccccactgggaggtgcctcccagttaggctactcggggatcagggacccacttgaggaggcggtctgtcctttctcagatctcaaactccatgctgggagaaccactactttcttcaaagctgccagacggggacgtttaagtctgcagaagtttctgctgccttttgttcagctatgccctgcccccagaggtggagtctacagaggcaggcaggcctctttgagcagtggtgggctccacccagttcgagcttcttggctgctttgtttacctattcaagcctcagcaatgttgggtgcccctcccccagcctcgctgcagccttgcagttcgatctcagactgctgtgctagcagtgaggaaggctccgtggccatgggaccctctgagccaggctcaggatataatctcctggtgtgctgtttgctaagactgttggaaaagtgctgtattagggtgggagtgacccaattttccaggtgtcatctgtcatggcttcctttggctaggaaagggaattccctgaccccttgcacttcctgggtgaggtgttgcctcgccctgctttgcttatggtctgtgggctgcacccactgtcctgcacccactgtccgacaagccccattgagatgaacctggtacctcagttggaaatgcagaaatcaccagtcttctgcctcactcatgctgggagctgtaaactgtagctgttcctatttggccatcttggaacttcccctccttatgtttattttctactgttaatgttgacacatatgatggctattttaagtgatacatgttatagttttgctatttaatatatatttgggaattagaatacttatttttttcatgaaacccaggattttatagcaaaaagacagctcattcctgacacattttccaaaagctaacttcagcaaaaggaagatgtccattccttcctaataaaggcaagaatgtccccaatatctctgtagactagtaaaatagagctgtttaagaaattctaggaggcctaaaggaaaataaaaagaagtaaagaaaacaataaatgccaccttcagttttaagtaaattttgttcatcttgctgtttgaagcagccattgttaattttggaaatcttttacaatatttacttttggatcacttttaatgccactgagatttactatctaaatgaaacaatcaaaataagaaacagtcatgtaagtggcaaacacctctgctctactatctcattgcagtgggataataaagcttaggtccattgatccaggaacgactgtgtaagagcatcacatggctcatagcacagaatcccaactaagatatgcagagaattatactctaacataatatttaaaagccctgtagtaagttaatatataacattatggtttgaagaaagagtatttttgtgagagatttcacattcaaacatattgaatactcaatgtggcatgtatttggatgggcaatgaaaaatttatacaactgttcatgaataatcacacggttgcacttaatgttcagtaacacttacctgaatgttttcatattgctgagatacattcatatacaaagcctgaaagcacacatttgaatgtatgattgatgaaaatagatctacttaatattgttctagcctcatctactctctctaatgtttatatagttcttggtattgttttcaaataaaataacaaaatgcaatatgagagcttgaaaaatattttactagttatcccaaaagaattaagaaataatacaaatgaattagaagtcattttagtatttttcatagtttaaagaaatataatgagagacattttccaaagaggtgttttagaagcttgtgaaaatggatgtggcttaattacctttcagtacctggagtgtgctggttatgtgccatgtttgacacaaaagagcaggattctacttctttgttcccccagttttactcagtgtggttgcatagctgaaccaaaatattcatcatcaccgaataaagcatttagctttgagggtggtgggttagaatcaaggaagcataggaattttacacgttctaagtatcctgagggaagagatagaaataaaacaaggtggctgggaagaattccttacaaatcactcaagaacatgctaattcatttctttcagctttattcaggtacaattgacaagtagaagttgtatgtatttaaggagtataacttgatgttttgatacatgtgttatattataaaataatcaccacaatcaagctaattaacatatgtgtcacctcacacatttaaatttatttttatttttgatgaaaacacttaagatctatcatcttagcaaagtttaagtatgtaagtcattattgttaatggatgtacaggagatcttcagaacatattattttgcataactaaaactttgtaagctttaacatctctccatttttttctcgctcagctctgacaaccaccattctaactctctgcttctgagtttgactattttagattccacatataagtcagatcacacagtatttgtccttttgtgtctggcttactttatttagtgtaatgtcctccagttcaatcatcttgtcataaatatcaggactatcttattttttaaagctgaataatattccactgtgtttacatacctaccaacctacccacctatctacatatcttgggttttcttgtccattcatctatcagtggacatttagattgtttctatatcacggcaatggtgaataatgctgcaatataaacatgagagtgcaaatatttgtttgacatagttatatcattatcttcagatatacaccagaaacgggattgctggatattatatgatagctgtatctttaactttttgatgaatttctagactgttttctataatgagtgtatcaatttacattcccaccagcagggtacaagtgttacctttccaccagattcttgtcagtatgtgttgccttttgtctttttgataattgccattttaactggggtgaggtgatatctaattgtgatttttacttggatttttccaatcattagtgatattgaacaccttttcctacagctttgggttctttgtatgacttcttttgaaaaatgtctattcaggttctttgtcctatcttgacttcaaaacactacaaaactatagtagccaaaacagcatggtactagcataaaaacagatatataaaccaaaggaacaaaatagagggcccagaaatttatgcatgtatggtcaactgatctttgacagggtgccaagaacatatgatggggaaaggatggtatcttcaataaattgtactgggaaaactagtatctacacatagaagaatgattttgaaccctttcaccatatacaaaaatcaactgaaaatctattcaagtcttagacataaggcctgaaaccataaaactacttgaagaaactacaggaaaaagctccttgatattggtttgggcaataagtttttttggatatgatactaaacacacaacaacaaaagcaaaaatagacaaatttagaaaaaatagtagaacttcattaaactgcaaagcttctgcacagcaaataatcaatcgtgtgaaaagagaatccacagaatgagaggaaatatttgtgaaccatatatctgataagaggttagtatgcaaaatatgtaagaaatttatgcaattcaatagcaaataagcaaggaaaaaaggaacccacttaagaaaaggaacacgctcattttttgactcttactttaagactgataaaagatctgcagaaaaaaagccacatataaaaatatatatatataaaaatacataaataaatctgatttctgtatgttggtaggtaaaaaaagaactccctttaataaagtttaattatttaattattactgtgtataatatttctttctctttgagaatattcacaccagagggtatggttgaaaaaatttatttcttgtgttactaaaactgctaactaattatcacattaattgtatgggtttcacgtattattctttgaagtatctgaagtcattagtgctcatgagtcttaacagctctctttatgtaaggcctttggggtaacagtagacactctagaaatttaataatagattacaaaaaatatactactgtttgccattatctcaatttcctgagtgttccccattctaatgcattttctttaatctcctctttcccctcctcatgaaactacctctacattatgttctataaaattggcatttctttgttagtttattggttgtatcaattgcaaattgtctctcttcctgttggcattttaataaggcctaaggaaagagcataaatgctattgtgatggttaattttaagtgtcaacctgtagggtatttttggatgagattaatgtttaaattggttaattttaggtaaagcagattattatccacaatgttggtgagcctcatccaaattgttgaatacctgaatggaacaaaatttccaacctctgtgagcatgaagaaattttctagcagactgcctttcaacttcacctgcaccatcagctttccagagtctccatcctgtcagcatttggactggaacaatgccattggctgtcctacgcctcaaacctcctggcccgtgctgcaagattctaactcactagcctttgtaatcatgtgagccaattccttaagagataagaatctctttcgagatattaaacaagacattcaattggttcttttactctggagaacctaatacagctgtcatgaaaaacttggatattcaaattagataaaagtatatttcagaaatgtaccaggatcacattgttagcttgtctctatggctttatcctaagtccttaagtattctctgcttagacagcagggtttgcttagtggagagattgtatctctaactgtattgccaggacaggtttttgactacataccacctatctttctcaagaaagtgataataaaagcaatttttttcatatttgaaatcctagagtacaacaatagcaaatggaaaatgaagaaagagggaattaaaaatgagtaaaagtattaacattacttgttttaggaaaaagtaacaataagtagataaacaatggctagataaggaaaaatttttaaagtcactgttaaaacttgaattttcttctaaaattctcctgctgaacacctttctagatgggtaaaagagtgagaatattaaataaaattctaaacttttaaaaatataactggttttaattatctgacaggtaacatacaaaatttatatgtaaggacatttttaactatagcagttgttcccaacatatacttcaaaagtagtgttcggccgtcctaaaacactagaaaacttctacaggcctttgacctcttgtagattatgtggaaaacagtaatctatctattctgtattttttttcagaagtatccaaattttttcctcagggaaaaaaaatacaggtaataagtttcttgataaaatgtttctcttaaaaactgcatagattacttctactttcaggtaaggtcttacttctctccataaataattgaaaacttagataaaacatgtttttagatactagacaacagtaaatactgtgagctaaagaaataaaataggtaactacctacaatcattctgactttctggcctacaggatatttataaatcttggggcagggagagccaacccactagctcccaagagctgtagctaacattttatttattattttttgatttgaggagatggtgtttgtagcataaatctgagattgctagaatattttgggacggatcaccaatgaagaaagagttactcagagaaacagctccagaaatctacataacgaatcaacgaagtctttagttgaatgccaatctgcatgttaaggtgaaactccctgaggataggcaaagaaaatttctgaggaaagaataatttccaggtacatataagtcaaaacaatttccacaggacaaacagtgtcatgactccttccaagtgctagcaaacaaagtgaagtaacatcattgaatacatgggcagtagtagagacgcaagataggcccatgctctagtaattgggctaaactagtcccataaaatagattattctgtaccagggatcagcaaattaaggaccaatctgaaccactactttccagtaactaaaattttattgcaaaatggcttttcacttatttacatattatctatagagacttcagtgttacaacaatagagtgatagaaatcaaacggtctgcaaagctttagataaatactgtgtggctcttgacagaaaaaaaatcccttgctgattcctcctctagacttgccctaatcaaaggactttcatgcaactcaacagcctatcagaacaaaattcaacactgataaaagtctgacaacaaaattcagtaatcaaatatttaacattttcaatgtctgtcatccaatccagaattaccacacatacaaagaaggaggataaaatacctctatacccaggtaaaacaaatcaaaaaataacatagatgatgacaaaagtagaaaacattttttaaaataggtataattatcatgtgcagcatgtgcaaatattttttaaaatgaacataatgaggagagtcatagggatataaaaaaagaaccaaagggaaattctaaagataaaattatgataccaaaaattaaaattattctgattggtagattaggccctgaaatagaaagtcagtgaaattgaaaacatggcaacaaaaattaaaatataaaataaatataaataaatgcacaaaggtaaaaaacaagatattaatggcctcaatattaatatcagagacaatatcaattgcaacaaaatacatggggtggaatactaaaaagaaagagaaagagaaaaacaatgtgaagcaattcttttttttttttttgagacagtctcactccatcgcctaggctggagtgcagtggcgtaatcttggctcactgcaacctctgcctcccgggttcaagcaattctcctgcctcagtctcccaagtagctgggattacaggctactactaccatgctcagctaatattttttttttgtatttttagtagagacagggtttcgccatgttggctagggtggttttgaactcctaacctcaggtgatccacccgcctcgggattacaggcgtgagccaccgtgcccggcccatattttaaaaatatctatattttataccaagtcatcagacatttgagaacatatcctattgaagtaaaacacagtaaggatgtatttaaagaatgagtattgaagaaatactcacagaattgaaaaatcagagaatgttaaataattataatatattcatattaaaaaataatattcagtcttaaagcaaatagttaaagcaactaaaccagttgtaataggcagatttccaaaaaacggttatgtaagaaaacaagatacaaacattgtaatatcatttcatgttttcaatataaattatttaaaaatttcatatatgtatatgtatgtttaccaaactatgtgagtactgagaaaaatatgaaagaatgcatgcttgattgtcatatcccatgggtgtgtaatgggagtagtgaagaagataaatggggtagtataaaaaatataaaaccataatacactaaaatgtaatatgaatgttatactttacatttgtttaaaattacatatgtgatttgtacaactaaagtggtataaaaattagaagcaaagttaaatgagaaggaattgattaaatgtacatacatatacccacagaacggtatcaatacatgggtacacatacacacacatatatatataatgtttatgttcactaaataattatgtgtcacttaacgatggatatacattctgagaaatgtgttgtcaggcaattttgtccttgtgcaaatatcatagagtgtatttacacaaacctagttcacactttggctatctggtatagactattgcttccaggctacaaacctgtacaacatgctactgttccaaatattgtaggcaattgtaactggatgttaagtatttgtggatcttaatgtatctaaacatagaaaaggcacatacaaaaatacagtattataatcttatgagaccatggtcatccatgtggtccatcattgactgaagaatcgttagcatgtcatgactgtacatatacagcattcatatatttaaatacatgcatatatattatatatatatggggcatacacataagtaatatatattttcatacaccttgcaattttactgcttggatttattttcttagaaaacaaaataaataagatagtatagatttaaaaatctatggataaaataattcaaagcaatagtacttttgtagtgaataacataatatagtataaatgtacaaatacagtgatgcattacagatattttgcgtattttacagcatgcaagttatctctttaaaagagctttagaaatgaattcagtaagtgaaagaacaaaatatttttatatcaaattattttgccaaatttatacgttactaccgctagtaacgtatgagatcattcatctcaccattgcaaacattgtcattataattcaaaaaattgtatttactatttggttgacttaatttacatttttaagaatagtataaaatggctaaagtgatggcattttaattatttgattcatcttttttggctccacttaacaattgaggttctattaattattttatggatttatgtgggcttttctatcaagctacgttctgaaatagttgctcataatttagtactgctttctttttctcttaattttagttaaagcttctgacatacagtagttgtaaattatatattaaatctattggttttttccattatgatttttttccttattgtaataaagcttaaaatgaatatccttcctcttgaacaagtttcctatctagcttgtattaaattaatctcagtggaacttaaggatccatagcaaatggaggattcctgaaatccaactgaatatcaagtattttctgaagacatcataagtaatagtttgtgtacttttaattgtgtgaaatattttaagcttaataagccatatatgtatttaaaactaataaatttatagatagcatatgcaacattgaattgatctaacagataccaaaagaagtacacctataatgcaggcagttgaaatttattttgacacaggaacttctttatttttattttttatttttttgagattgagtctcaccctgtcgcccaggttggagtgcagtggcaccatctctgctcactgcaacctctgcctctccggttcaggtgattctcgtggctcagcctcccaagtagctgggattacaggcgtgcaccaccatgcccggctaatttttgtatttttagtagttttgaactcctgacctgaggtgatctgcccacctcggcctcccaaagtgttgggattacgggcataagccacggctcccagccaaggaacttattatactaagtgtggagaaccctgctatagaagtctgtcaaatatttactgcccccacccttttcttagtatttctgtaattcaaataacttttcatatttcatatttagtttttcatatttattattgtaatctattgggaagttatttttacatagaaagttggttaggaatacgatttatcttgtcaggttttatagtttttctaaaagtttacctacgtgttttcttttttcttttttctttttttttacttttttttcttattttgagatggagtctcacacttgttgcccaggctgcagtgcagtggcgcgatcgtggctcactgtaacctccacctcccggtttcaagcgattcttctgcctcagtctcccgagtagttgggattataggtgccagccaccacacctgaattttttgtatttttaatagatactgggtttcatcatgttgaccaggctggtctggaactcctgacctcaggtgttctgcccgcctcggcctcccaaagtgctgagattacaggcgtgttttcataagtttcttttctctataaatatcatattgtattactaaagtggagtcatttttgtttcattattacttaatagctttaactgtggtaatgaatttcagtgctttcctttcatactttatgatttttgcaccttcagcttgaaatcaggtactattaaactccagtaatttttatttttataacacattgcaatttttgttattttcttttccaataattctacatttttgttcattgtagcaacattagaaatatacttttattatttatttatttaattaattattattattattttttgagacagagcctctctctgtcacccaggctggagtgcaatggcacagtctcagctcactgcaacctccacctcctaggttcaagtgattctcctgccttagcctcctgagtagctaggaatacaggtgcatgccaccatactcggctaatttttgtatttttagtagagacggggtttcactatgttggccatgctggtcttgaactcctgaactcgtgatcagcctgctttggcctcccgaaatgctgggattacaggcgtgagcctccacactggcctcacatgcttttagttatagtgttttgtttttgctttttagtaattgaagtaattgttgttttcaaattccttcttctggtttatcaatttccttatatttttcttaatgtttttactgagaaatgctaacaaattttatcatgcaatcatgtatatttttattatattcagtaatatactaatgctttattatgttaattagctataaaaatatatttaaaagtcctgctttgtcatgttggctacagaataacactaatcactaatatgtcatttcaaatatataaatatcaaagtatatatgtgtgtgttttatacaccatatattacattatattaaatacatatatgccttatttatatatatatataatgtatgctgaattttctttctctttcttcccttcttctttctttctctctcactttatttcttgcttgcttttctgtttttgtttaatctgttttttggtgacccagacagcatccattttctcttcctaagaacattctattttttggggggagggatctatcacttccccttattgttgataaattgatagaatgataaatcaagttaccttgaccactcttatatagccaatgactcactctaggtcaataatactatcccaggactttgcatcttgactgaacatttgttcactcttcttgagtaaaaaaactccaaaactcggtgaaaacaagccaaaaatatattaattattgctcacatatctatgagttggtttggtttctgaccttccaggcaggactgtcacgaattattcttgtcattatacatctgagatgacaaaaagactagctgagatgataagttctgtgtttcactgatcatcgttggatgagtgagcttaacaagagacgttactctcatagcaacaccaaagatgataaagagcatttggctaactgacacttttctccatgtactatttgccaaaacaagtcacataactaagccaaaagagatggaggaattcatttccctcatggagatgagaagacttgcaaagttaaataacaagagtagatacagaagaaggagaagtattagagtcagtaatgaaatctaccaggcattgagagccacaaaggcaaaatgtatgtgtaaaatattcactttattagcacctaagaaagagagagttgagcaagctatatctgtttcctaagagcccagtaattgctggtatacatgttgtttcttatgctagttcctagtctctgtgtaaatttgaactaaacaatatataaaagattcccctcttcttaattttgtggaaattggtattgcttacttccaaataaagaatcctaagtggttaagaataaaacaaaatttgaagaaggtagaatatataaagaggctgacaaattctttgtgatcttggcttaaagaacaatacatctcactgtggcctttgctactttattacttttcttcctaagagccttaggaatttctaaatccagttttccagcttaatctttacagtggacagaaaacttctctttatactaactcccatttgagaatcctgtacttttcctcaaatatagagaacttcacttctctccttgccatggccagcttatttttcacttattggcttccacaaagttggccgtgacctgtgctctccacaacaaaaatcacataaactgatggcaatgcagaattcaagtaaacatatttagctagtgatgatgcttgatccagtagtagctgcactgttagttctctcaacttctattacttttgcttgctatttctcttagtttcctttgttttcccttcatagtacattctattgtattacacaatataaatatgtcattttattattatcatcatattacacaatacaaagattctacagcaatgctgtccaattgaaatatactgtgaatgataagtataagacatatatgtagttttaaattttaatacccatagtgaaataaaaagataaaatgaaatttagtagtatatttaattccaaatattcaaaatataaccatctaaaaatacaatcaatattaaattgttaatatgagttttttcttttttttggtataaagtgttcaatatccaatgtgcattttatacttactgcaagcatgtctccatttggactcactatatttgaagcggtcaatagccacacatggctagagactacaatattcaacaatgtaagtccataaagtttcttagggctgagttatgtatgtctaatttatttgcaaatttcataagggcagaggtcttttctatactgtttaccacaatacacatagaaccaatcagaaggtttagtctaaaataataggcatttaagaattttgtatcaaaaactcatttagtataatgttatctattttttctagagtgaaatacatagttccatcttttaaatttctaccttataagcactattatctaccataaaattatctgttcatttgtcttgaaattctttattaaacacttagatacaagtttttctttatttaaattctctcaataattttccatttttcccaatgctacgtgagtcaatcgtcaaggaaaaatatcctgttcattaagagtttaaatgttttagtataaaatgatgacctgttttatgatcaaacaatagttatttaccaaaggttacacattcccagctgtgtattattatgaaactttaggttatgtcaatcatcaatagagtttcttcatttgatacccttaacataattttttccagatatagatacattatgttcatatgttatctttagatttctggatttttgtgatatctgttctcatttatatggtcatgaacgattttaatagaaggtgaaatagaataagatactcttagtaatctgcctcataagtgagaaattcactatatttttttgacatttattagaatcattatttttaaattccatggctatagtgctatacttatcctactgagaactgctctcaatttaattaataaggacttgtctgttgaatacatcattccttttagtattcctcccatcttctcagggtatactggaaggaaaatttgtgtgcttttgctgaatattattatagttatacctttggatagtttaatacactgacatgattagttgtactgagtttatattttaatataacactcaaattttttactggattatgcgagtcaggtactcttacctgaacattttagccacttatatataaacctctaccatagttttacaatgctaggctgtctttaaaaagtccatggcatttatcaggaataagacattttaaaaatcaatttctagcagtttgagctatgagaatgcaaattataacattgtactacagttctgggatgtactaaaaaattaagaagaggcataacaataattacgccaggtggtgtgttttatttgtaatgacaaagcttatttctacacaaaatgcctctagtataaaagaatgtcaagaattactatctaacgcattgctgatttctttaattactctcattaatgtgcctttaatagctacccagaattaaatatttaaaatatattgtgcattttttattaaaggagatatttaaataaagcaaaataaatttcatatctataatcttcagttataggaatgaagatagaagcagtgtatatttatcttagggaagttgttagtaattactaaatttctttaacaaagcaaaattggattcaccaaaatataaacaatataaataatcatatgtttaagtggttcaacattttaaagtgttaattaccttctaagatatattctgcctcaaagcctccatacatgctgagaaacatactgaggaattataaacatcttgtgtaaaacatgttgtcatatattctccaacaactgtgtttcagtaaaatctgcccaaggcttaacaaaaaagtgtttaaagtattatctgtctacatcaagagcagcattttgtcagttaaataaattatgataactttgtgaaatacagtaattaaggtgcttctatgtaatagaataatgtgtaactggtagaatattactttacaagaatgtttaaggttattaaaatgttcagatatgttaaacaaagtgcacttgttgaataatatacagcttatgatgaaaattttgtgagtgaatgatgaaaattttgttgggtatatatgtaaatatttaatgtgtgtagaaaatgagagagagacaaagatggtaagagcaggtaagtactttaaaagaattataacccaaagaattataataatcatcatctgggtagtagaattaggtgttcttaattttcttcttacactttcaaaagcattttacagtgtcattatgaatatatatgactattttaataaaaataattgcacaaagtatgtattaatgattataaatagaatatattatttagtatatactatacttataattacttccttcaacagaactactttgttttactatgatcagacactaatattaaccaaattatatcttctagattcatctgctccatttataccctcttttaaatttacctccaagaaagcaattctgttctttcttgcacctctaatttctttccactgtatcctttctttttaattccataaatgagtatgaagtttgtcatggatgttctgtgtggccctaggacaaaatctatcagaaactgtattgcatgaagatggctggcagctgagtcctttagaaatgccttttgctgaagggagttgggccatcaaagatgtaatgatacatccctgggagaggtcagggtccaatgacggtttaatgtgaggtttgagatgcccagcccccttgcatgattcagaacttctctgtagggccgtctccatttcataagccctgtgtgattggctgaagtttctgttcctactgtaaccaattcctcccttctccttttccaattcagcttcttgtgtttcctcatagatactgcgactgaaaacgacccaatgcctttcctgcataaaaatgtctgtctcttagtctactttgcaggcaaaatgacaaagggattattcaaaggtacatccagctagtgttgcaaggaaatgtttattgggattacacacaaaaatgtgaaggttctgtataagaaggggagcccattttcagttcaaaccttaaataaactaaatgaatttttttttttttttttttttttgctctcacgcttaacacggcaaaataattaaagaagataggaaatatcagtacagaaaaccgtagtctaagcagacagacataggctttttttgtggaaaacaagtgaaactgtcagtcagcagttacagaaaatattgcagaacatctcagagggaagcaatgtccctctggacatcaattgtggtagatttacttaaagtaaattgtataatttttcatgacttcaaaggctaagtatttagtggtaatggctcttaaaactgtcatcagaaggaagaggatcagcagagttgggacaatctagtcaaattcaattaaatattgaatactaaattcttcctatattttctagctttgttctagatgttacttgggaggctgaggcaggagaatcgcttgaatctgggaggctgaggttgcagtgagccaagatcctgccactgaactccagcctgggtcacagagtgagactccatctcaaaaaaaaaaaaccagaaagcaaaacaacaacaacaacaacaacaacaacaacaacaaaaaacttaagctttagaaaatgttgtaatagagattttatggagggtaatatggttaacatttctctacttccttagtgatggagaatcaagagtttcttacctacctattctctatctacctctcagttttgaatccttcacttgtttactctgcatcatatctagcactctgccagtctgttttatatccctacccctcttgaaccttgatagctaaacttaagcatcatgtagtctacaactaatccagacttattctctctgtgaaataggttctagcatctatcaccatttcagtaaagggcaaatgaaagaattgtaaacacaccctcacattctaagtcttccatccactgagcaacaggaatttcttaatttatactccatatggtggccaaggactgatttattattatgtgagtaattcacaccaggtattcatgaccaggtaaatctacactcctcataattctgtggtttccctgttgtttgaaatagtctgtaaagttgtttattcttccctgtgtccttcgttttgtgcttttttttattcaattacttattacttatctatcctatttttctttcccctcccaccccaaactctgacaactactgacctgttcatcattcctgcagtttctccttttctagaatgtcaaataaatacaatcttaaaatatgtaacctttgagactggcttctgttacagcacaatgcatttgcaattcatctatgttgttgtgtgtgtcagtagttgattacattttattgttcagtaatactcccttgtttgtataggctaagtttgtctattccatcacctatgcatttgaattaatgccagtttgagttatcctggcataaacattcttatatagattttggggtgaaagtaacttttcatttctctaaaataaacatgtagaaatgggattgttgagtcagatggtaattacatgtttaactttttaagaaacagactgccttagattctttagtgttgctgtaatagcatatcatagactgggtaattttaaagagggtaaatttatttcttatagtactggagactggaaagtccaagatcaaatggcacacatctggataaggccttcttactgcaccatttcatggatgggagcagaaaggcaagaaaacatagaagtggggtcacttttttgtctggtagctttacttttaaatttttgaagaacctccatctgtttgtattagttcattttgtgttgctgtaaaggaatacctgaggctaggaaatgtataaagaaaagaattttatttggctcatagttctgcatgtgctgtacaatcatggcaccagtatctgcttggcttctggtgaggcctcaggaagcttttactcatagcagaagggaagggatccagcatgtcacatggtgaagaagggagcaagcaagagagagaaagtgccaagctcttttaaacaaccagctctcgcacgagctaacagagtaaggacttacttattcctgtgaagacaacaccaagtcattcgtgaaggatccatgtctatgacccaaacatctcgcattaggcctacctgcaacattggaggtcacatttcaacagaatatcagtgttttcacaatgcctatattactgctgagttttaggagttctttctgtatatctttctggatacaagtttttcattgatgttatgcttgataaagcaaacaaggtctgagggcaaagactagagtaaatacctaatgccttgatgcacagacattgatgaatgttcacaagcatcaagaatatgaaaggcattatgacttcatgaaacaaactaaataaggtgccagtgactaactttaaatagagggatatgtgtgacctctcagacagataattcaaaattactgctttgaggaactcaaccgactttaggaaaatacagagaaggaattcaaaattttatcagagaaacttgacaaagaggttgaaaaaaatcaaatggaagtcctggagctgaagatgcatttgaggttctcaacagcaaaattgatcaagcagaagaaaaaacatcagtgagctcaaagacagctatttagaaatatcaaaaagtcagagaaaaaaaaaagaatgaaattctatggccaggtgcagtggctcatgcctgtaatcccagcactttgggagactgagagcggaggatcacttgagctcaggagttcaagaacaactggggcaacgtggcaaaaacccatctctacaaaaaatacaaaaggtagccagacatggagatgcacacctgtagtcacagctactcaggaggcttaggcaggagaatcacttgggcttggaagatcaaggccacagtgagttatgatcgagccactgcactccagcatgggtaactaagcaaatatcctgtctcacaacaacaacaacaacaaaggaatggaatcctgtcattcacaatgtggatggaactggaggacattaagtgaaataaactatgaacagaaagttaaacaccacatgtgatatggtttggctctgtgtcaccacccaaatttcatctcgaactgtaatccccacatgttgagggagggacctggtgggaagtgattggatcataggggtggtttcactcatgctgttcttgtgatagtgagttctcatgagttctgatgatttaaaagtgtttggcagttcctctcctctctcttgcctgctgccatgtaagatgtgccttgcttcccttttgcctcctgccatgattgtaagtttcctgaggtctccccagccatgtggaactggcagtcaattaaacctcttttctttataaattaaaaaaaaaaaagtcagggaagaaaacaggaaaagaacaaaaaatgaaaaacataaaatctagaaaacagcctcaaaagtacaaatctaagagtcattgaccttcaaaagggagttgagaaggaataaagggtagaaagattattgaaagaaataataacagaaaactttccaagcctagaataaatacatagatatccaagtgaaggagtgtcggagatcaccaaagatttaactcaaataagactacttcaaggcaagtaacacgttataattacaacagcttattttaaactgatgaccccttaactttgatcacagtataagaatggaaataaagaaactctaaagcaagaaactctaaaatacagaaactctccatattaacttcattttctgcatctctcccccaggcataaatattttgacttctagatgtctcaatttacatcttttatattgtttacctcaatatatttttatttttattattgttaataattttgtcttttactttttatgttaaatatatgacaggtttacaaaccacaatttcatcattggagtattctgaatttgtctgacatttacttttatcattgagttttatgcctttaaattttgttgttaaatattactgtcctttccatttaaattgcagtactttatttagtacttcttctaaggtggatctggtggtcacacattccctcaacttttgtttgcctggcaaaatctttatttctgctccatgtttgaggatagttttgctggatacatcattctgtgttggcaggtttttgtttctgtttttgtttttgtatttcagcactttaaatatgtcacccactccttcctgactgcgtgatttctgctgagaagtctgcttcaacacattgaggagcttctttatctgctattttcttattttttcttgctgcttttagggtcctctgttcatccttcaccttttagagtttgaatattacttgtgaggcattgaactcaagtgcagtcctgttacagcagaaggaaaaacgaccaaattcagctgtgtccacagagagagcatttaaaccagccctagccagaaaagaattgctcattccagtggttggaacttgagttcccattagtcttgccactgcaggctacagcattctgtgtctccaagtaaacttgaaaagcagtctaagccaggggtgtccaattttttggattccctgagccacattggaagaagaagaattgccttgtgccacacataaaaacactaaaactaacgatagctgatggactgaaaaaaaaaagtcacaacaaaatcttacttgtaaacttttaagaaagtttacaaatttgtgttgggccacattcaattgggttggacaagcttggtctaggtcataaggactacaactattaggtgagtcctagtgttaaactcagcccagagacaatggacttggggggcacatgacatactgaggtccaactagggcagccaaggaagtgctgccatcactcattcctcaaggccagaccccttccttctgcttgaggaaagaagaaggaaaagtgggaagaactatgtcttgcatctaggctatcagtttaaccacagctcaaccacagaaggataggacactggtcagagttatgaggcccccgttccaggtcctagctcctagatgacattactagactcaccctgagccagaagagaatccactaccttgaaggaaaagtcctagtcttggcagcattcagcatctgctaacagaagagcccttgggcctcaaataacaagcagcaatactcatgtactacatcaaggaccttgatgaacctcttataattactggcttcaggtgagactcagcaaattgccagcagtggtgaatatgtggtgaaaccccttctgcttgagaaaagcagagagaaaagtagaggagactttgtcttgcaccttagataccagcatgagtacagggcggtagagcaccaagtgggctcctggggtcaatgatccaataaattcacttttgaacagcatttctgaacattcccggggccagaacccactgcccctgagggataagtcccaggtcaaaaaacattcacaacaagctaactaagagaccttaggccttaagggaacattggtggtagtctggcaataatcctcgtggactgggatagaagtggctaggaggtgaggctcctctgcttttggaaaggggagggaagagtgggaaggacttcatcttgggtttgagtgccagcctagctgcaatacaatagaataccaggtaaaattctaaggtttttgactgaagtccctaactcctgaatggcatttctggactcatccagggcctgggggatctcactgacttgaagggaaggacaaagatctggctggctttgccacctgctgattgtagagccccagggccttgagggaacacaggcagtagccagggagtggatgaaacaggccttgggcaagacccagaactgtgctggcttcagatgtgagccaaggcagacacagtagtagtggccatgggagtgtttaggccattccaaccccagctttagaagattcagaaagagagagagagcgagagaaagaaagagaaactctgtatgtttggaagaaagaagaaagtaagggaagagaacaagagtctctgcctggtaatccagagaattctcccggattttatccaagacctgctaggcagtacctctatgagtctgcaagaactacagcattactgtacttggggtgccctgtacagcagatacagcttagatcacaacactgaaggcctttcaaatatctgaaaggccttcccaaaaaggatgactacaaataaacccagacagtgaagactacaataaatacctaactcttcaatggccagacaccaacgaacatctactagcatcaaaatcatccagaaaatcatgacttcaccaaatgaactaaataagaaaccaagaatcaatcctggagaaacagagatatgtgacttttcagaaagagaactcaaaatagctgttgaggaaactcaaataaattctagataaaggctgtcacggtggctcatgcctgtaatcccagcactttgggaggccaaggcaggcagatcacctgcggtcaggaaattgagaccaccctggccaacatggttaaaccccatctctactaaaaatacaaaaattagtcgggcatggtggcaggcacctataatcccagctacttgggaggctggggtgggagaatcgcttgaacttgggagacggaggttgcaatgagccgagatcatgctcctgcactccagcctgggtgacagaatgagtctccatctcaaaagaaaaaaaaaagaaattctagataaacatagagaaggaatccagaattctatcacataaacttaacagataaatcgaaataattaaatagaatcaaacagacattctggaactgaaaaatataactggcatactgaagaatgcatccaagtcctttaacaggagaactgatcaagcagaaaaaagaattagtgaacttaaaaacaggatatttgaaaataaaaattggaagagacaaaataaaaaaataaaaagcaataaagcacatctacaaaatctagaaaatacccacaaaggggcaaatgtaagagttactggccttaaagatgaggtagagaaagagatagaaatagaatgtttattcaaagggataataagagaacttgccaacgtagagatgactcaatcaaaagtaataactacaacaattttaaagacatagttaatacaataagatataaatagaaacaacaaaaagttaaaaagcagaaggatgaaattaaggcatagagtttcattattatcctttttgcttgtttgtttgtttacagaaatactgttacgttgttatcagtttaaaataatggttataagatagcatttgcaagccctatagtaacctaaagcaaaaaaaaaaaaaaaaaaaagaataaattgcacaaaaaacaaaaagcaaggaactaaatcacatcacaagagaaaatcaccttcagtagaggaaaacaggaaggaaagaaagcaggaagagaaaaccacaaaacaactagaaaacaaataacaaattggcaggaataaatccttaattatcagcaataacattgaatgtaaatggagtaaactccttaataaaaatacattgactggctgaatggataaaaaaaaaacaaaacccatggatttattgcctacaagaaatacacttcacctataaagacatatatggactgaaaataaagggatggaaaaagatatttcatgcctatagaaactgaaaaagagtaggagtcactatacttatatcagacaaaatagataccaagacaaaaattgtaagaagtgataaagaaggacattatataacaataaaggaggcaattcagtaagggaatataacaattttaagtatatatgcacccaattctggagcacccagatgtatataaaaaaatatattagagctaaagaaagagataggtcccaatacaataatagctggtgacttcaacacctcaccttcagcattggacagatcgtatggacagaaaatcaacaaacaaatatcagacttaatctgtactgtagaccaaatgaatctaatatatatttagagaacatttcatccttgagctgcagaatacacattctttttctcagcacatagattattctcaaggataaaccatatgttaggccacaaaacaagccttgaaacattcaaaaaattgaaatactatcaagtatcttgtctggccaaaatgaaataaaactagaaattaataacaagagtaattttgaaaatggtactaatacatggaaattaaacaatatactcctgaatgatcaatgggtaaataaagaaataaaggaggaaatcaaaaaaattcttgaaacaaatgataatggaagcacaacataccaaaattgatgagatacaaaaaaaggagtactaagagggaagttacagctataggtgcctatataataatgaggaaaaacagcaaatgaattatctacatatgcgtcttaaagaactagaaaagctagagaaaaccaaactcaaaataagtagaagaaaaaaaataagaaatctcagagcaaaaataaatgaaatttaaatttaaagatacaaaagatcaataacctcaaagtttgttgtttgaaaatttaaacaaaattgagaaaacattagccagactaagaaaaaaatgaatccaaataaataaaatcagaaatgtaaaagaagacaactgacactgcagaaatttaaaggtttattaatgactactatgagcaactatatgccaacaagtgggaaaatctagtggaaatggacaaatttctagatacatacaacctaccaagattgaaccatgaataaatccaaaacttgatcagaccaataagtaatgagatcaaaattgtaataagtgtcacctaataaaagtttaagatttgatggttttaccactgaattctaccaaacatctaaagaagaaataataccagtactattcaaactattctgaaaaatagaggagggaatacttccaaacagttgcagcactgtttaaaatagctaagagttggaagcaacctaagtgtccatcaacagataatgtataaaaaaatgtggtacatatatacaatggagtactcttcagccataaaaaaaaaaagaatacagatccagtaatttgcagcaatgtggatggaactggagattattatgttaagtgaaataagccaggagcagaaagataatcatcacatatttcatttacctgtgggatctaaaaatctaaacatttgaactcatggacatagagactagaaggatggttatcagaggttaggaagggtagtgaggagcttcgggggaagatggtgatggttaatggttattaaaaaaattaaaaaaaacagagagaataagacctactatttgataacacaatagggtgaatatagacaataataacttaattgtacattttaagataacttaaagagtataactggattgttggtaattcaaacgataaatgcttgaggggatggataccccattttccatgatttgcttatttcacattgcatgcctgtagcaaaacatcgcatgcaccttataacgatatatgatggacctacaaaaaaatttttaagaaaaaaacaaaaaaggagagatgacctaaataaaatcagaaacaaaaaagaagacaatataactgatgacaaagaaaaagaaaggataaaaaatgctactaagaagaaccataagccagcaaattggaaaatctagaagaaatggataaattcctgcacacacacaacttgacaagattgaatcatgaagaaatagaaaacctaaacagatcaataacaagtaacaagactgaagcagtaataaaaatctcccataaaagaaaagcccaaaacctgacagcttcactgctaagtctaccaaacaattgaagaactaatatccattctactctaactattccaaaaagtttaatggggggaatacttccaaactcattttataaggtcagcattacttccaggccaaaatcactaatgaatataaaagcaaaaatcctcaacaaaatactagtaaaccaaattcaacaatacattaagaagatcattcaccatgatcaagtaggatgcatctcaggtaatcaagaatgattcaaaatatacaaatcaatatatgtgatacatgaaagtaacagaataacaaaacccacttgaacatttcaatagatgcagaaaaatatttgataaaattaaacatctcttcatgataaaaactttcaacaaattggttacagaaagaaggtaccacaacatgctaagtgtgacatacgacaaacccttaagctaagattgtactgaatgaaggaaagctgaaagcttttctctaagatcagcaataagacaaagatgcccagtttcatgcttctattcaacatagtattggaagtcctagccacagcaatctggcaagagaaagaaataaaagctatcaaactggaaaggaagatgttaaattgtccctgtttgcaggcaacataatcttatatagagaaaaatctgaagtattgattttatacattgaaacatccttgaacctcagggatgaatccaactggatcatgttgaatggtctttttagtgtgcttttgaattctgtttgctagtattttgttgagaatttttacatttatgttcatcaggcatattggtctgtagttttcttttctcatagtgcctctgcatggttttggtgtaaggataatgttggtctttcaaaataagtttggacatattttctcctataattatttggaagaattcgagaaacattggtattacttccttttcaaatatttagtagaagtcatagtaaacttaccagttcttgggcttttctttgatgagtatctttttatttctgattcaatctccttaccttttattggtctgtttagatatctctttcttcataactcaatcttggtaggctgtatgagtctaggaatttattcatttttttaggttatcaaatttgatggcatacaattcttcatagtagtctcatacaattctttttattgatgtggtatcaattgtaatggcttcttcttaatctctgaatttatttatttgagtccataaaaaacttttagaactgatgaatgaattcagtaaaggtacaggacgcaaaaccaacatacaaaaaccagtagcatttttatactaacattaaactatcggcaacaaaatcaagaaaataattgcatttacaaaaactttacaataactacgaaaaataagtactttagaataattttaaccaaggagataaaaaaatctgtatactgaaaactgtaacatatttactaaaggaattggagaatacacaaaaaaagtgaaaagataccctctgtttaaggattggaagacaatattgttaaaatatccatattacccaaagtgacatacagtttcaatgcaatcaaaattctaatattatttttcacagaaacagaaaaaaaatctaaaatttgtatggagctacaaaagccttgaatagccaaaacaatcttatgcaaaaagaacaaagctggaggagacatactacctgactttaaaatatattacaaagctatagtaacccaatcatcatggttgcataaaaatagatatgcagaccaatagaatacaataaaagtcccataaataaatccgtatatttatagccacctgattttttgataaaggtgccgggaacacacattagggaaaggacagaatcttcaataaatgatgttggtaaaactggatatccatatgcagaagaatgaaattaggcccacatctcttacaatgtattaaatcaactcaaaatcgattaaagacttaagcctaagataacaaaactttgaaactactagaagaaatcatagggggaatgttccatgacattggcttgagcaacaactttttggataggacaaaatcacagacaacaaaagcaaaaatagacaaattggattacatcaaattaaaaagcttctctatagcaaaggaggaaatcaacaaaatgaagagagaatctatagaataggagaaaacatttgcaaactattcatctgataaacggtgaatatctagattatataagaaacttaaacaactcaatagcaagaaaacaaataacctgattttaaaatgggcaaaatacctaaatagatttttttaaaacactgtaaaaaatatctatcaggtatatgaaaatgtggtcaaatcactatcaaggaaatgtgaatcaaatccacagagagatatcacctcacttctattagaatggcttttatcaaaaagaccagagtaagcaaagatgtggggaaaaggagcctgacacactgttaatggaaatgtaatgctgttatgtacagccattatggaaaatagtatgtagttttctcaaaacattaaaaatagaactcccatgttatccagaaatttcactactgggtatatatccaaaggaaataaaatcagtatgtggaagaaatgtctataattccatggtcattgcagcattattctcaatagtcaagatagggaaccaaccatgtgaccctctaaggatgaatggataaagaaaatatggtgtatgtacaatatttacccttaaaaagaagaaagtcttataatttctgacaacatgaatgacccaagaggacattatgttaagtggaagaagacccccctaccccccaaaaaagctgtataatctcactcatatataaatctgaaaaagttgatcttagaagtagagagcagaattgtgttcaattctacatggatggggttgaattggaaaaggggatttggtgagatgttggtcataaaatacataataacagttagacaggaggaatatggtcaagtaatttattgcacagcatgacgtctattgtgaatgacaatatattgtatttttcaaacatgctgagtggatactgtgttctcaccacaaggcaatggaatacatatacatttcatttatattatattatattatattatattatattatattatattatattatagtgaagtcaatgtatttgttaattagccagataaccattccacaatgtttatatactttcaaccccatattgcacatgataaatacatagagttttatatgttttttaaaaatttctttattttttaaaataaatttgaaaaaaaaagaaacacacagaaactctttgactagaaatagtgactctcctatgtctaaatctacaaaccaattgcatctgtagtcaatcttccttctgagctccagaattccctgtcctgctttccctggaggaagctagaattattaattagtcatcattttcttgtatgccaatttctatctactggttctttactgaagtcctttaaaaatcctcttttctctctgcttcacagacaggaaagttctgcttgatcattcttccctgttttgccagatctataacttatttttttttccagaaataagctcccataaggcattatcaagactctttgtctcatttttttcactacttacacatatctcaacccactgacatctggctttcatcgtcctcattcctttcaactgctctcataaagggtactgatatctcacctattgttaatccaatgtatttttacttcctattttacatatgtctcagaaggatgtgacacacttgagactattacacctttaaaaattctttccactgatttgatgacataattttggttctttctttctttctccttgagatatattcacttttattttcccttgctgtatctttctcactgccattctttaaatgctctcccatgatgatgactaaactcccttctcttctcacacaagctctctctgttatataaccatacttatatgaattccattgccttgtacatgccaatgactccctaatccaagttaatctgtattcccttcctgagtgccaaacacaactctcttctagacatttcttctgaaatattttttaaatacctcatgcacatgttaaacactaaactaatcatgctggctcagttttcccctttaaacacatctttttcagtgttcagtttagtaaaagtatccccatatctactcacttatcagactggacaaatctttcttcattttcccctacatgcaatcaatattgaattcctgcctaatgtacttctcagctcttgatcctaccctttctttccatctccactgacacacttttaattccaagctgaaatttaacaaatttctctcatctacaatctccagaaagatatgtatatcactctaatcatttggtactcttaatagcttttgagtaatctaaaaaaatgcaaatctgttcatgttgcgagctatattagacctttttagcttcctgttacctttatgtcaaagtctatatgttgaagtctaagttccttcacataacttacaattctcttcataattctaggtttctctacctactcagtcttgccttgtcataatcgctatcattttataaggcatagatactctggactgctcttgtctccaagaatgtgttgtgtcacttttccccatgtgtctttgaggatgcttttgccaggtctgaaatcttcctccccttttacctggctgatgcccactcactttcaggtcccaacacatatgccttgagacattttcttgacctaagaataagttagtttccagtgacaagtgtgtctaagcatctaaaatcaataattccctttaatttaattacactattaacagttagggtttagaaaaaaaaaggctcacacaacatagttttttaaatatagattttagaagagttgaaaagccaaactagatgagagggctacccaaatttaagcaacaattggaatctataggaacaaagggaaaaggtggtgccataagtgccccaaatccagggtggccagatgtgagttgaaaccatggaaaagactgtccagtgagatgtgggaccatgggctgagtggccacctggaggaaccgggaaatgctgaagagatgtagccactgttagaaatagtggcaggaagtacagtaaaagaaaggaataccttagatttgcttgtctctctggctctacctctgacctcccactagtgtgtttttgtggcagaacccaaactgaagcctagtaacatgggaaggagatgctgtccagaaacatcagccccactagaatacagagagtcaggggaagataggtaggggacacatgaccagcactcacagtatgttttgaacaattgtttattttaagaggaaaaagactgtgcttttcctgtttactattttcagaatatggcctttgcctagttcatagtaggttttcataagtatttatttgatggattaatgatgtcagtgtccccaaatatgtattcctattatatcttatacatatataaataaaaacaaatatatacacacacatatacacacacactttgtttccagaatttcaaatattcttagttaagcttttgtcttgattacattgtgattacacaaattccttaagacacagttctttagtttcctgtgctgtacctgaaacatacttgcctaataaattaaaaaatcaggtatctgaaatagataaaactagataagcactattcttcatatatgccatcctaattcaggttctttctgcttgagcatcttacaactctactgtttacttcccctcataatgtatccttccctatcttactccttcttttttccatttctttggatgaattttgcttccttagtaaactccattcttgacaatttccttcataagtgtcaatttggcttgtggctcaggagacagatagttatactgcattttctaacatacattaaaagctctgaattatattctgatatcaaataaccgtagaattatacaatgacagctctggattgtactttgataaatcatctagtttaattccgttctctgtaaaaggttaataatggcagtgtagatagcggctacctcacacattttttttttcacctttccttttacttaagcttgcatggatggtatatccaccatcatgcaaattactctattccaatatttaaaagaagatttacagagaagttcttccttatctccttctcctcttcctccttttactcctgcttcttctctttgtgggcatttttttcttggtatctttccttgctcaaacattctgaaacatgaggaagaacttgttggtacatataatggcattaactttatgttagaagatggttattactatactgagatggtcttcactggtggagcaggtacaaagtttatagtctgcaaacatagaactttatcttttgtacacagacttaggtcctgagtcccatttctgctgttattagaaaattgatgccaaacaattttctctgtctctcttatcccagtagttagataattagtcaattcagtattttatctcatccttcactattttttctctttctctccttggtttagaagatgagtgaagtgggcagggacttatatggcaacaattgaattactctcattttgttttctagtcaccatgtcagtgcagttacctttacccaacagagaattatttccgcatgtacttttctattctcaaccacatctcctggggatgtagaatacttggggatattctttcatgctacttcagattcaaagaaaaatggtggtggtggtcgtggtggtggtattgagagtgaattttgttgttgctgtatttgttttagctttgtttcctcaactttcacacagtatacaagacacagattttcttttccaggaaattcttaaaaatcctctgggatttcctcctgacacatacttccccaataattttaatagatagaggagatgcaaggtttattttgtatacacatctgctttggtcctcaatattttatcacatatcaaactattttctctttcgggattggaaaaatgaccttacatcattataattctatgtcagtctatggtttctactaaggaattttattgctgagccattcagatttgggggggatgtggcactggctaaggttgtgttctcatgggctccacatgggtccagtctctggttcagagagatccaagccacacttaatgtcgtctatgtgactatgagttcttccccaagccttgcgatggagtccagtttctttcctcaaagtaagtactttctctccaaatttacctaaagtcaccaaacttacagtctgaagtggttattttagaattagtgtttcttctctaataagaagttccattagctattcagacttttcagatagaacattgctaagatacaatataactcatctctctgtatcaaaactatacagactttggtgacattttgcagaatgattcttttgaaacctaaatgtttcctttatatgccgcctttatatgtcataatgaattacactagaacaaattcaggaatgaaaaaatgttgtagtctgtatatctatataactaaagtagctctgaactccttgttttccttagaaagaagacactttattgagttatttccaagcaagcattgccatttgaaaattaaactaaatttcaaaatttcagaaacttctttttaaaaattttgctctccttgttttactatttaaaaactatcttgtattgttacatccctttatttttcagtattgaatacatttgtatattaagtccataagtaatatggacttcatatatgctatactatacttcctttatctctgtctctgtctttctgccttgagtaggtatgaatgcatgtatctgtgccagacttataaagatgcaaccactttgattaaatctacagtagtgttggtatcaaaagaatgcagtcctgtaattcaaagtcatttcaaaaaacatactttcttgaattacgtttctcaaacatcttaaattagaaatactgttcatattatatctattgttctcactccaaagctgttcttgttcctcatccttcactctcttttcctttccaaaaggaagaaattcctcagcaaccccaaccccagccttcatgggctcaaattgaggcagtttagctctttaatttgtgatcttagtataacattatattgttgtgcatatttcaacctataatatattgatactcagagtagcgtattttaatgaaaaagttcaaccagtgtaatacattttctcttctaacaaattgcgaataaggctattgtaggaatagtctcccaagtaaaactttccttttgaaataatagagcatatttttataagcagattactgaataatgacagtcaaaaagcatctagttcagattttttttaaattggaaaattattctggattgtttatactatttttcatatatgagaagcagacatgattattggtggtatatcatctcagtaatgccttacagtgaagttttaaattttagtcaaaattttatatagcctttttatcttgcagagaactaagagagagagagtatatgtttaaattttggcatagaaaataaaaaataatttttcttagataatttaagttactctcttcaattagattgacatcatcagcttgtctatgatgcaacaagacactgtgaagattctctctggtttttacctataaatttcttgtgaacattgcctaaaagaagtgtgtgtgtgtgtatgcatgtgtgtgtgtgtgtgtgtttgtgtgtggtgtgtgtgtgtgttccccttgcactggtattgataacaaccgtttttgttttttttttaattttctagttcactatgaaactgctctttttaatccttcaatatggcttcaaatatattttcaagactgggaactttgccagtttattttaatttttatctctgatagagcatcacagactgtattgaaagaatacttttatatattattaactatccttataatttagtttaatattaatttgtattcaaaaatattgctggatacctcttgcagctctaggtgctcctgagaaatagttttagttaccttttagatttttacttttttaaaaaaaatgtatccctatataaaaacagctttgctgcatcccacagattttgactcctcttaccctcctcctctatcaactttacagctctaaatggattgcctgtttgtgtgattcagatatcttatcccgcagctgtctgagacactcacattcttaggccaagtctgtcacccttatccacttacagtcaaaattgggtaaggaggtagaagaatgtattgtgaaaggtattctttccttccttcctgtgtagtagcagtcctgcttcctgaccatgaagaacaatctcctgccaagatggtggctccttttcttgcctgctgatctgttcacacaggaccctgaagtattcaacacagcttaagctttacgagaatcttgctgtgtcctttgtataaaatgttttccctctgggaaatgacacgtctaagcatagtggccagagattcagcagtaggaagcacaatgagccgctggtagtgacggtagtcagggcatggtaggatttttgtccccaggattttcaccttcttatgttatgcctgtgaatatgttaccttcaaggcaaaatgaattaaagtttcagacagaaatgagtttcctaatataataatcatgaaataagaagattatcctgggtgattctggtgggtttaatgtaatcataaagcctttacaagcaaaagaaggaggtggaatatttgatccagtacactcccagttgtggccacagggatgcttgtgtcactccacacccagttcatgggggctaagaaaacagagagagagagagagactcaatttgtacaggagaacttaagggaagaaaacaaagtatctgcttggtaatccagaaaattcttctggatcttacccaagatgatcaaagtgataccagtgcaaatctgcaagaacaaagctgtagtaggctttgggtaccccctaattcagatacagcttacgtaaaaacacacaagttttttcaaatacctaaaaattgttcccaagaaagatgggtacaaacaatcccaaactgagaagaatacaataaataactactcttcaatgcccagacagagacaaacatctataagcatcaaggccatacaggaaaacatgaccacaccaaatgaactaaataaggcactagggaccagtccttgagaaacagagatacgtgatctttcagacagataattcaaaataactgtgttgaggaaacccaaagaatttctagataaacacacagaaggatttcagaattctatcagatacatttaacaaagagatagaaataattaaatagaagcaagcagacattctgaagctgaataatgcaactggcatgaagaatgcatcagagtcctttaatagcagaactggtcaaacagaaaaaagaattaatgagcttgaagacaggctatttaaaaatacacaactggatgagacaaaattaaaaagaataaaaaataattaagcacatttacagaatctagaaaatagcctcaaagggacaaatgttaagagttattggccttaaagaggaggtagagaaagagatagtaatagaaagtttattcaaagagataataacagagaatttcccaaacctagagaaagacatcaatatccaaatacaagaaggttatagaacaccaagcagatttaaaacaaagaagactacttcaaggcatttaatattcaaactcccaaagatcagggttaaaaaaaaaggattctaaaaccatcaagagaaaagaaacaaaaaacatacaatggagctccaaaagggctagcagtagacttttcattggaaatattacaggccaggagagagtggcatgacatattttaagtaatgaagaaaaaaccttttcccctagaatagtatatctggcaaaaatatccttcaaacaggaagaaaaaataaaaactcctatgaaaacaaaagctggggtttttcatcaacactagatgtttcctacaagaaatactaaacggtgtagttcaatcagaaagaaaaacatgttaatgagcaataagaaatcagctgaaggtacaaaactcactggtaattgtaagtacacagaaaaagcagaatattataacattgtaactgtgatgtgtaaactactcttatcttaactagaaagactcagtaatgaaccaataaaaaataatagcaacaaaaacctttcaagacatagacagtataataaaatattaacagaaacaataaaaacttaaaaagcaggggtatgaagttaaggtatatagtttttattagtttttttttttttttgcttttggtttgtttacttaacagtgttaagttgttataagtttaaaatcatataatttgccagtctcatgataaactcatgtcaagaaacacaatgaatatacaaaaaataaaaaagcaagaaattaaaacatattatcagagaatatcacctttactaaaaggaagactaaaaggaaacaaaaaaataagaaagaaaatatcataaaacaaccataaaacaaataacaaaatggttattattgattataacattaaatgcaaatggactaaactctctaatgaagagagtttcagcctggctgaatggaagaaaaaacaagacccacaaatctcttgccaacgagaaaacacttcacctataaaaaacacaaagtaaaaataaagggatgggaaaggatattctatgcaattgaaaactaagaaagaccaggagtagctatacttatatcagaaaaaagagacttcaaggcaaaaatgataagaacagacaaagaagtccattttataatgataaaattgtaaattcatgaagggaatataacaatagtaaattcagtgagaggatatatatttacaaacacacatatatgtatataacaattctctttctctttatatatatgtgtgcatgtatatatgtgtgtgtatatatatgcacatatataaatatctatatatacacacatatatataattgttatatcttctttctcaatttacaactttatcatatatatgatggttaatattgagtgtcaacttgattggattgaagcatgcaaagtattgttgcttggtgtgtctgtgggggtgttgacaaaggagattaacatttgagtcagtggactggaaaaggaagacccatccttaattagggtgggcacaatctaatcatttgccagcatggtcagaataaaagtaggcaaaagaacgcagacagattagacaatcttagcctccaagcctacatctttctcccatgctggatgcttcctgcccttgaacatcagactccaagttcttcagctttgagactcatattggcttccttgcccctcagcttgcagatagcctactgtgggacttcaccttgtgattgtgtgagttaatactccttaataatctcccctttatatatacatctatcctattaattctatccctgtaaaaaaccctggctaatacaacacccaacacaggagcacccagatatgtaaagcaaataattctagagataaatagaaagataggcctcaatacaataagagctggaaacttcaccatcacattttcagcaccggacagatcttccagacataaaatcaacaaagacacatcaggcttaatatgcactactgaccaaattgacccataaatatttacagaatatttcctccaaaagctacagaatacacattcttttcctcagcacacggatctttctcgaagatagaccatatgttgggtcacagaacaattcttaaagtgctcaaaataattgaaataatattaagcatcttctctgacttcagtggaataaaactactcataaatcaaacaggtaatttggaaactttataaacaaatggaaattaaacaatatgtacctgaatgatgagtgcatcaatgaagaaattaagaaaattgaaaaatattttgaagcaaatgataatgaaaacacaacataccaaaacctatgggatacagcaaaaacagtactaagagggaactttatagctatatatacttacatcataaaagaagaaaaacttcaaataaactacctaaaatgcatcttgaagaattagaaaagcgggatcaaaccaaacccaaagttagtagaagaaaatacataataaagatcagagcacaaataaataaatttaaaatgaagaaaacaatacaaaagatcaacaaaacaaaaagtttgttttttgaaaagataaacaaaattgaaaacttttagccaggctaactaagaaaaaaaaggagaatatccaaataaatataatcagaaatgaaaaagaagacattaccattatgattgttgctgcaggaattcaaaggatcattagaggctactataagcaaatgtatgccaataaattggaaaatagagaagaaattaataaattcctagatacatacaacctgccaatattgaatcaggaagacatccaaaacctgcacagaccaataacaagtaacaagattgaagcaatcataaaattctcccaaaaagaaaagcctcagacttgatggtttcctcactgagttctaccaaacatttaagaaaatactaacacaaatcctactcaaaccatcctaaaaagcagaggaagagtgaatatctctagattcattgtatgaagccagtattaccctgataccaaaaccagacaaagagacctcaaataaagatgactataagcaatatcactgatgaatataaatatgctcatcaaaacactagtgtatcaaattaaacaataagttaaagaaatcattcatcatggtgaagtgggatttatccctgggatgcaagggaggttcaacatatgtaaatcaatcaatgtgattcatcatatcaacagaataagagacaaaaaccatatgataatttcaattgatgctgagaaagcatttgataaaattcaacatcgcttcctcataaaaacctcaaaaaccggggtatattaagaacgtacctggacataataaaagccatatacaacagacccatagctactatcacactgagtagggaaaaacagaacacctttcctctaagactgggaacacaacaaggatgtgtactttcaccactgtttttcaacatattactagctagagaaatcagacaaatgaaagaaataaaggtcatccaaactggaaagaaagaatgcaaattatccttctttgcagattagtatacagcaaaagtacaaaatttaaaaaatatacagtcataccagatattgtataggaactggggttggcaaatatgtagaaaatgttatttaatgtatttttaaaatgccacaaaaagccctttagatgtcattgtgtatgtgtctttttttgtgtgtatgtatgtgtgttgtgtgtgcatgtgtgtatgaaaaagagagagattaattttcctttataattaaagagctttattggaactttagtaaaactgttaaaatgggctctaatattttaagtaagaataatttgattttaaaataaactatatttatcagttactctcttttatcctaaagttaaaactcacacctgcatataagagttacatagttaaagacaaaataattactgaagaaaatagaagataaagaggtagcattgctgataacttggtatttgataatacctttacttgctatataggagttctctggacatatttttcttttcactacgtcatatcattctcaagtattacaagcttataatgggcaagactaataggagcttctgcaaaacatgccttctttaaacttaggtctaaaaatgtgattttgtcagttagactttcagaacaggcagattgtctcatgttttacagaagactgaacagagaatagacaattatggtaacagactgcccttatttttactttttattttgcagtaattgtagacaaacaagaagttgcaaaaaatatcacaaaaaggtattacacatcttcacccagcttcccccagtgtcacacctgcataattgtagaacataatcaacattaggcgattaacactgtcacactactactaattaagcatatatggttaaactcagcttgcctgctacaactttgcgcaacctctgagtgacctggagtcacagtgctaacaattgatcaaacctgaaagaaatgtactatcaagacattaatatattcctatatcaaagacaacttgcactatcttctcagcgtattttctggtgaaaaataaatgaatcagtattttgcacctagtttatgttttcataattcttgctatttagccttgtcatacctggttttacttacatgatcagaagagtaattaaaaaaaattcttggtatgaaactgtagcttccctgaaactaaagtgtttcatatgtatctgctatttcaaaatccgaagaagctgccttgtgtgaccaagaaaggaacatgagagctgcaatctgtattttaaagaaattttctaatatatctagatagtcgaaattgttacatgaaattgttcatggcagtggctcagtctaaccccatcactttgggaggcgaaggcgggtggatcatctgaggtcaggagttcaagaccagcctggccagtatggtgaaacccggtctatactaaaaatacaaaaaattagctaggcatggtgtcgagcatctgtaatcccagctacttgggaggctgaggcggaagaattgcttgaaccccgaggcggaggttgcagtgagccaagatcgtgccattgcactccagcctgggctacaagagtgaaactccgacccaaaaaaaaaaaaaaaagttcgtaatattttcttataatttcaatgtttgcagaatgtatagtaatgtctcctcattcatgtattattattattttttctttttttgtttttttatttttatttttattatactttaagttttagggtatatgtgcacaacgtgcaggttagttacatatgtatacatgtgccatgttggtgtgctgcacccattaacttgtcatttagcattaggtatatgtcctaatgctatcccttccccctccccctcccccacaacaggcactggtgtgtgatgttccccttcctgtgtccatgtgttctcattgttcaattcccacctatgagtgagaacatgcggtgtttggttttttgtccttgtgatagtttgctcagaatgatggtttccagcttcatccatgtccctacaaaggacatgaactcatcattttttatggctgcacagtattccatggtgtatatgtgccacattttcttaatccagtttatccttgttggacatttgggttggttccaagtctttgctattgtgtttagtgccgcaataaacgcacatgtacacgtgtgattatagcagcatgatttataatcttctgggtatatacccagtaatgggatggctgggtcaaatggtatttctagttctagatccctgaggaatcgccacactgacttccacaatggttgaactagtttacagtcccaccaacagtgtaaagtgttcctatttctccacatcctctccagcacctgttgtttcctgactttttaatgatcgccattctaactgatgtgagatggtatctcactgtggttttgatttgcatttctctgatggccagtgatgatgagcattttttcatgtgtgtgttggctgcataaatgtcttcttttgaaaagtgtctgttcatattcttcacccattttgatggagttgtttttttttcttgtaaatttgtttgagttcattgtagattctgaatattagccctttgtcagatgagtagattgcaaaaatattctcccattctgtgggttgcctgttcactctgatggtagtttcttttgctgtgcagaagctctttagtttaattatttataaatttatctttctttgatcaatcttgcaagaagtttatcaacttcataactattgttaactaatcagaattgatcttatggaatgttgtttttgtccatatttttacatttttttctactcagctctttattattttctttctttaacttattttcatttgaattttgcttttctttttttattaaattcttagagtgggtgattaaatcaacagtttaaaaatttttattttaatccaatataagcacttagagctattaatttcctttctagctttataagcatcccataaacttgtgtatgttgtagttacatgttcattaatgtccaagaaactacttttctttgtgatttgttttttgggtcatgggttatttagaattgtgcatctacttttcaaatattttggagttctctagggatagctctgttatttatttcaaatgtaattattttgtggtcagacagctggattttttttttctttttttttgaggtggagtcttgctctgtcgcccaggctggagtgcagtggtgcgatctcagctcactgcaagctctgcctactgggttcacgccattttcctgcctcagcctccagagtagctgggactataggcgcccacaaccacgcctggctaattttttgtatttttagtagagacggggtttcaccgtgtgagccaggatggtctcgatttcctgacctcgtgatccacccgcctcggcctcccaaagtgctgggatcacaggcgtgagccaccacgccgggccctggaatttttaaaaacatattgagatttcctttatggccaacaatacgcatgatattggtaaataatttgtgaatatttggaaagaattgccagctattttaaggttattttataaatgtcaatttggtcatgttggttgttggtagtgttcaaatcttctatatttctactgactaactgtcttctggctctatcagttattcaaaattcctactgtatttgtgaatttatctttctttgtggttgtcagcactatgcattaggtaatttgaaatttctgttatttgatgaatatgagtttaaggttattacatcgcttttgccattatgaaatgactatttataactggtaatattctttgttctgaaaaatacttagatattgaaatagccatttcaactgttttttgattatttaaaaaatttttacaatttttaaaataatgtgtgttaagagtttattttattttaaggcaggatgtagtgtagtctttttaaattttgaattcagttgtattatgttgaatatttagaacattgacttttaatgtgattattgatattattgaatttttttctttttcttctttcttccttttattttttttttctttttggactcagggtcttgctctgtcacccagggaaagcaatggcacaatcaggctcactacagccttgactttctgggatcaaatgaccctcccacctcagcctcccaaatattctgccttttgagtagctaggaccagaggtgtgcatcaccatgcccagctaatgtttaaaattgttggagaagaggtctcaccctattgcccaggccattcttgaacttcaggtctcaagtggtcctctgcctcccaaatgctgggatcacaggcatgagccaccacgcccagcaattagatttcaattaaatcattttttctattagtccttttttgtcccttcttccattcttcctttttttttctttttagccaacattctagctaaactattatttttattgtattattttacctctcggcttattaactataattttggtttcatgttttaatagctgcttagagttaatagcatatgtttttaattcatcatattgtaacttctaattatatcatactactttacatatactgtaagaaacttatactagtatattttcatttctcactttttaacttttgtgttattgttatacatttttattttatatatgttatacattcattatattgttatcattttttttgcaaccaggtaagtatatttcagaagaatttataccttaaaaaactcctatgtttacctgtatagtttcttttccaatgtttcttattcttttgtgtagttccacatatccctctggtaccattttcactttgattgaaggacttccttaaacatttcttgtaatgtgtgtctgttggtgaatttgtttaggttttatacgtttgagagaagtcttcaccctctcttttaagaggttattgcatgtaatgttccactattttcttgtttgcattgtcccatactaaaataaatattctgacaagtttatctttgcttccatgcacataacatgggtttttctttgggaagattgtaatactttctgctacttcctttgtatgagcaatttaattaaattgtctcggtgtaattttctttatgtttcttttacttggagattgttgagtttcttagatatgcgagtttataatttttatcaaaatttgaacattttcataattctcaatattactcaaactttattttatgttcccatttcttcccttggggactttgcacacaagctaagcttagtagtcatctgaatatttgagcagatcctctgcatatctcttaagttctctctctgctctccagttctctgtgatgcaaattcttgccaccttaatttttctgaattctcagctacacctgctaactcagggagtccaacatgctatgacagaatcctccctttctgtgcaatagcctaaaaatactctttttgtacctgttccaaggcagactattaggatgggacacacacacaaatacacacacacacacaccatctcacagctatcgctaacttgcactacccagtatccagtatcttgcaaacattttgtctgtggtatgattgttccaaagtagacagtaaatttggtctctgttattgatactggaggggagcagggaagtactagttagagaagggtggggtacctggtgagggctacaccttggacctgtgccaggaacctaagtgaggaaaaacatttctgttttcacacccaaaaaattgtcttttggcccactacaccccccgccattctgtatccataaaaacctgagacctagtgggcacagacacaagtagttggacattgggaggagtaaaagaacacactgacacacaccagcagacactggtaggccattgatggtggaaagatgtggatgccaaggggaatttggcctggggcggtcagaggagagtctggccactggtggcctgactccaggggaagaccacgttcccaatgcattcctcttctggctccccattcacctcgctgagagctacctccatcactcaataaaaacttacactcatcctccaaacccatgtgtgatccaatttttcctgtacactagggcaagtactcaggatatggaaagctctctgttcttgcgaagaggcagagggtctaatttagctgattaacacaagcttcctgcagttggcaaacctgaaagagcacactgtaacatgtgcccactggggcttcaatagctataaacactcatccctagatggtgtcgtgggatcgaagcccaaaaatgctccccacgacttctgcagctgcctgtctgcatgctcctcctaggggtttgagtagtgggtgggcactgaagaagagagccacaccactgttgcatgtcctgtgagggggataagggaacttctcccacttcgttatgcccatcttggctgaaaaataaaatctatatctaacttgctgttttctctttgtcacctatgtactttgttcttttctaaattttcttgttttgctgcgtctttttggagtaatggtgatttgatgttctattttattgtttattttggcttataacctttatcttttatttctatgttttttgttattatttagcaatatgttacggttactggaaaggggtcctgatccagaccccaagagagtgttcttggatcttgcacaagaaagatttcagggtgagcccttagagtaaaggaaactaaatttattaagaaagtaaaggaatcaacaatggctacatcagacagagaagccctgagggttgctggttgcccatttttatcgttatttcttgattatgtgctaaacaaagagtggattcttcatgcctcccttctttagaccatatagggtaacttcctgatgttgctatggtatttgtaaactgtcatagcactagtgggagtatagcaatgaggacgaccagaggtcattcttgtagccgtctagttttggtcagcttctttactgcaacctgttttagcagcaaggtctttatgacctgtatcttgtgctgaccccctatctcattctattgaaggggtgggttgcccctccacacctgtgggtgtttctcgttaggtggaacgagagacttggaaaagaaagagacacagagacaaagtatagagaaagaaaaaggggcccaggggactggcgttcagcataaggaggatccacgccggcaccgtcctctgagttcccttagtatttattgatcattatcgggtgtggcaggataataggataatagtggagagaaggtcagaaggtaaagacgtgaacaaatgtctctgcatcataaacaaggtaaagaaaaaagtgctgtgcttttgatgtgcatatacataaacatctcaatgccttaaggagcagtattgctgccagcatgtcccacctccagccctaaggtggttttcccctatctcagtagatggaatatacaattggctttacaccgagacattccattgcccagagacgagcaggagacagaagccttcctcttatctcagctgcaaagaggcgctccttcctctgttactaatcctcctcagcacagaccctttacgggtgtcgggctgggggacggtcaggtctttccctttccacgaggccatatttcagactatcacatggggagaaaccttggacaatacctggctttcctaggcagaggtccctgcggccttccgcagtattttatatctctgggtacttgagattagggagtggtttgagattagggcgtggtgatgacttttaacaaacatgctgccttcaagcatttgtttaacaaagcacaccctgcacagcccttaatgtatttaaccctgagttgacagggcacatgtttcagggagcacacggttgggggtagggttacagatcaacagcatctcaaggcagaagaatttttcttagtacagaacaaaatggagtctcctatgtctacttctttctacacagacacagtaacaatctgatttctctttcttttccccacatctgtgacttagaatacctaatctgagaatgcagcccagtaggtttcagctttattttaacccagctcctattcaagatggagttgctctggttcaaacatctctgacatttccacttactttctttcttattctttgccactgatttcatataatttacttctatatgtggtgacaccctacaatatatgttcataactttgtactgacaattttcattcaacatatgtaactatgagaatcacttaaatacttaaccacatagttactttcatgcgcatccgtgtgaagagaccaccaaacaggctttgtgtgagcaataaagctgtttatttcacctgggtgcaggtgggctgagtccgaaaagagagtcagccaagggagatagcggtggggccattttataggatttggaaaggtaatggaaaattacagtcaaagggggttgttctctggtgggcaggggcgggggtcacaaggtgctcagtgggggagcttctgagccaggagaaggaaattcacagggttaatcactcagttaaggtggggcaggaacaaatcacaatggtggaatgtcatcagttaaggcggggcagggccttttcacttcttttgtgattcttcagttacttcaggccatctgggcatatatgtgcaagtcacaggggatgcaatgacctggcttgggctcagaggcctgacattcctgccttcttatattaataagaaaaataaaacaaaatagtgttgaagcgttgggtcggcgacaatttttggggggcggtatggagagagaatgggcgatgtttctcagggctccttcaagcgggattaggggtggtgtgggaacctagagtgggagagattaagctgaaggaagattttgtggtaaggggtgatattgtggggttgttagaagaaacatttgtcgtatagaatgattggtgatggcctggatacggttttgtatgaattgaaaaactaaatggaataagagaaggagaaaaacaggtataaaaggactaagaattgggaggacctaggacatctaattagagagtgcctacagagcttcgtcatagtcctgccagcaaagattatttatttacttcaagagttaagagtggcagtttggggatagcacaaggagatatcagctgtgatggcttggagaaacagtgtaaaccagcagtgtaaacaagagcagggcatgtatgagtagttgagaacggtgaataggagtatgactagagagaagatagtagggatgacaagttatttgggggcacagtctaagttggtctggtgtctggaatgagactggggcctaataaaaaggagcatctatacaggagcttaaatgggctgtaccttgtagcattctgaggacaggtctgacttctgagaagggaaagtggtaaaagtattgtccagtcctttttaagttggtggctgagcttggtgaggtgtgtttttaatagaccattagtctgtcactgaatactaagagcctgaaaaaatgcttggctgatttgactaataaaggttggtctgttatcagactgtatagaggtgggaaggctaaactgaggaattatgtctgacagaagggaagaaatgactgcggtagccttctcagaccctgtaggaaaggcctctacctatctagtgaaagtgtctacttagactaagaggtattttagttatctgactcagggcatgttgagtaaagctaatttgccagtcctgggcagggacaaatcctcgagcttgatgtgtagggaagggagggggcctgaataatccttgaggagtagtagaatagcagatagaatagcagatggaacactgagaagttatttccttgaggatagatttctatgatggaaaggaaatgaaaggttctaagaggcaggctagtggcttgtactatagcatagcctgcctttgctggtgtatggtgattaggcctggtggaactgccatcagtaaatcaagcgtgatcagggtgagaagcagggaagaaggaaatgtggggaaatgggatgaacatcaggtggatcagacagatgcagtcatgaagatcaggtgtggtatctggaataatgtgggaggctggattgaagtcctggccatgaacaatggtaattgtgggacttaacaaagagtgagtacagctgaaggagccggggagcagaaagtatatgcgtcaggtatgaggaagaaaatagattttggaagttatgagaaatgtagagagtgagttgagcatagtttgtgattttgagggcctctaaaagtattaaagcagtggcagccgctgcatgcagacatgagggctaggctaaaacagtaaggtcaagttgtttggacagaaaggctgcagggtgcggtgctggctcttgtgtaagaattctgaccgcactaaccatgcctaggaaggaaaggagttgttgttttgtaagggattgaggtttgggagattaatcggacacgatcagcagggagagcatgtgtgtttttatgagaattatgccgagataggtaacagatgaggatgaaatttgggcttgactgaagtaatgggggctgtctgtgaagccttgcggcagtacagccttggtaatttgctgagcctaatgggtgtcagggtcagtctaagtgaaagcaaggagaggctgggatgaagggtgcaaaggaatagtaaagaaagcatgtttgagatctagaacagaataatgggtagtagagggaggtattgaggataggagagtatatgggtttggcaccacggggtggataggcaaaacaatttggttgataaggcgcagattctgaactaacttgtaagtcttgtctggttttaggacaggtaaaatgggggaatggtaagaagcgtttataggctttaaaaggccatgctatagcaggcgagtgataacaggctttaatccttttaaagtgtgctgtgggatgggatcttgacattgagcggggtaagggtgattaggttttaatgagatggtaaggggtgcatgatcggttgccaaggagggagtagaggtatcttatacttctgtgttaaggtggggggatacaagaggaggacgcaaagtaggctttggattgggaagaagggtggcaatgagatatagctgtagtccaggaatagtcagggaagcagataatttagttaaagtgtctcagcctaataagggaactgggcaagtggggataactaaaaaggagtgcttaaaagagtattgtctaagttggcaccagagttggggagttttaagaggtttagaagcctggccgtcaatacccacaacagttatggaggcaagggaaacaggcccttaaaaagaaggtaatgtggaatgggtagcctctgtattaagaaggggacgggcttaccttccaccgtgagagttacccaaatctcagcgtctgtgatgggttagggggcttccgaggtgatcgggcagtgtcagtcttcagccgctaagccgagaagatctgggaaggagtcagtcagagagccttgggccagagttccaggggctctgggagtggctgccaggtgagatgaacagtccgattttcggtggggtcccacacagatgggacgtggcttaggaggaataccgtgctgtgggcattccttggcccagtggcagatttccagcatgtgtagcaagctcctgggggaggaggttctggaggaatgcctggctgctgcagttcaggtgtttggaagttcttgtgtgctggagatgtggctgaggtttgtctcacagtgtaggcaaggaattgcaacttttttctgttattgcacaccttgaaggtgaggttaattaagtcctgttgtggggtttgagggccagattccaatttttggagttttatttaatgtcgggagcagattgggcaataaaatgtatattgagaataagatggccttttgaccttttagggtctagggctgtaaagcgtctcagggttgctgccaaacgagtcatgaactgggctggatttttatatttgatgaaaaagagcctagacgctatctgatttgggataaagaaaaaggagcattaaccttgactatgcctttagctccagccacctttttaagaataaattgctgggcaggtggggaagggctagtcactgaacgaaactgtaagccagaccaggtgtgaggaggggaggcgataaaaagattacagggtggaggagcggaggctgaggaagaattgggacctagcttggcctggcgaggaggggagaggtcagatgggtctgtagaaaaggaagattagaaagactcagcgatgcttggggttgggactgaggggacaggtgggagggaaagaaggaagatttgggatgagttgcactgggcacagagactaggaagggactgatgtgtaaaagaatgcctggacatcaggcacctcagaccatttgcccattttacgacaagaattatttagatcttgcaggatggaaaaactgaaagtgccattttccagctatttggaactactgtccagtttgtattggggtcaagcggcattgcagaagaaaaaaagacgcttagatttcaggtcaggtgagagctgaagaggtctgaagttcttaagaatacaggctaagggagaagaaggaggaatggaaggtggaagcttgcccatagtgaaggaggcaagcccagagaaaagagtagagacacggagaaggagtgagggtttgttgcctcccagaaaagcagagaaagggttggggcacagaaataagggattggggcacagagataagaggtcggggtgtgggaataacggattgggggttcttgccccctagaaaagcgggacttgctgctaacggtgaaggagaaggagttgaggggtacttgcccctcccccagaaaagcgggacttgccgcaaagggtgaaggagaaggggttgaggggtacttgcccctccccaagaaaagcagagaaggggtaaagacacggagagaaggtgttggggtacttgcccctcccccagaaaagcagagaaggggtagagacacagagagaaagggttggggtacttgcccctcccccagaaaagcagagaagggatagagacaccaagagaaggggttggggtacttgcccctcccccagaaaagcgggacttgccgctaagggtgaaggagaaggggttgaggggtacttgcccctcccccagaaaagcagagaaggggtagagacatggagagaaggggttggggtacttgcccctcccccagaaaagtgggacttgccactaagggtgaaggaccaaggcaggcgtccctgcgtggtctgacacctttgaaacgtggatgaataatcagaaaggcgtccctgcaatgattaaacaccaagggaaggctgccttcccagtccatgactggcgccagagttttgggtccacggataaaacatgtctcctttatctctaccagaaaatgaaaggaattgaaattaagagaagggagagattgaagtgtggcgccaagattgaaaggagaaagaagttgagggatagtgagggaagttggagaagagagtaaaaagaggccgcttaccagatttgaaattggtgagatgtttcttgggctggtcagtctgaggacctgaggtcataggtggatctttctcatggagcaaagagcaggaggaggggactgatctcccaagggaggtcccctgatccaagtcacggcaccaaatttcatgcgcgtccatgtgaagagaccaccaaacaggctttgtgtgagcaataaagctgtttatttcacctgggtgcaggtgggctgagtctgaaaagagagtcagccaagggagataggggtggggccattttataggatttgggaaggtaatggaaaattacagtcaaagggggttgttctctggtgggcaggggcgggggtcacaaggtgctcagtgggggagcttctgagccaggagaaggaaattcacagggttaatcactcagttaaggtggggcaggaacaaatcacaatggtggaatgtcatcaattaaggcagggcagggccttttcacttcttttgtgattcttcagttacttcaggccatctgggcgtatacatgcaagtcacaggggatgcgatggcttggcttgggctcagagccctgacagttaccattctttgggctttttattcctttgtgctgatccaagttttcatcttttattattttccttcagcccccatttttttttttttacatttttatagttcaggtttgctcacagtatattaattttctcaggctttgcattgtgcgataaagtcttcatttacttcatctggaaaacaactatcactctatctagaatctatcattaataggtttatttttaaccttacagatgctttttcattgctggcaaggataattaatgataagtagtctagcgaaattcttatctttctttctttgtaatgtatcattttctctcaaggttataacaaattatctttatcacagggttttaacaacttatgtgtgatgtcttgtctcttgaggtgatattctctgtgtttattggtcttgaattcattgagattttgaatctgtgacactgtaattttcctttggattttgaaagctttattctttatttcttcaaatagttttctgttttgttgattttcttggcactcctgttacatgcctgttagtccacttaacatttttccagagatcactgaggttgtttttgctgcaattttttttttttttttgagatggagtcttgctctgctgcccaggctggagtgcagtggtgccatctcagctcactgcaagctctgcctcccaggttcacgccattctcctgcctcaacctccccagtagctgggactacaggcacccaccaccacgccaggctatttttgtgttttttagtagagacggggtttcaccgtgttagccaggatgttctcaatctcctgacctcgtgatctgccctcctcagtctcccaaagtgctgggattacaggcgtgagccatcatgtccggcctttgctgtaatttttatctcttcattctatatgtgtaaattcactgttcttttttctctagtgtatatagtatgttctaaatctcatccaatgaatattgaatttcatatatgtttttatcttgggaagttctacttggcttttttgatgtggtctattttatctccttgtgttaatgttatattcaacattgttgagtgaataaagtatatttataatagctttttaaggtttgtttctataatatggactctgtttctatttactgattttctcttgctttagggtcatactttccttcttttattactattgattttttattgaatattgagcattttgttttttctatttttggtgtgtgtaacagattttattatcctccctatcccaaagaatgtccctattttttctggcaatcagctaacctacagtttacccagcttgatccttttgtgacttattttcaactttggtagaggagttttagagtggtttttagtttttaagtctactttaatattactaaagtctcacctgaatgacaatctaggtctcttcttaatgactgaggagtttgataaagattcttcactctgctttgtttgaatgtgaaggtcacccagctctgtatacatttccaaaactttggctcatttattctcagttgttcttttcctgacattgtaaaatttctgtaatgccttcaaacatagttttctgtatcacctaattatgtccatatgaagattcctgaagttttgtgtatgaaaaaccacctcattctcagctattcaatttctagctatttcatcctcttcaaattctgatatctatttaattcaataaaactcactcgctttacttgggatcattctccttgtatgatggtcttgaagtgcctccaagcagaaagctggggttaaatgagcttttgtccatgatttcccttgtcccaggaactacagcattgtgacatctcatgtacaatgtctgtaacatggatttttatcttctgttcattttgttttctttttcctatgggagggtaaattagtcacagtgaatctatcacttccataagtcattccaaatggtatctgagatatcatgaagtttaagaactgacaaaagatagatgagaaaaatctctttacttttatgtatcagttttaggtatgtttcagaaactacacactcattagctttactttaattcataagcaaacaatttagtatatggtattaaactgatattaatgtagatagaatggtaatcactaggattatttcactaggaataaataaggagaagcaactcatttagccattgcactagtgttactgaaatgggagagttccctaaaccccttgtgggacttttaacaggggtgtggcttgcttgctgggctgtaacatgttcaaaccccttacaggagagggacatgcagatgggcagatgcaggagctggggtgagcgtttgagctctggccccacaatagcatctaggagtgtgttactattaatgcttttttagctgacagctaagtgttaaaccagatcagtggatggctaatttttaaaccagttcactggacagctaagtgttaaaccagctcagtggagagccaaggtgacagcctttaacaccctgccctcttggtacccgggtccttgtccagcatccaggaagaatcaggtcacttggacttgaaggttggtgaataaggggattttattgagtgatggaggtgactttcagcaggatggatggggagctggaaagggaatggagtgggaagatgatctttacctgaagtacggtcatccaacagccaatcttctctatttctgtccccagccaaactccttgttcagatgctccttcttttctctccttctcagccatgccactctgctgctctgccactcttctgctctttgttcctctgtttttggagcttgggatttacatgggcccaagataggggcgtggagggccatagtgttcttggaaaagacaacatttgggtgcgaaaacagaaatgcctgttctcatttagggctgtgggtttccagacttgagagtgggcctttgccaggtaaccaccctcttctacccagtatttccctgcctcttgtctgtatcattattagatcagatttgtgtgtgtgtgtgtgtgtgtgtgtgtgtgtttgtatgttctgtatttgtatcaaggtttgagaaataatttcatgttttggttgagggtatgatgaaacagtatgagagagatggtgatttatgctaagttatccaactgaaaatgaaaacaacctaagggagaagttgttcatttttaaatgtttagttttaaaccatcagaactcagccattttgtacaggcaagttaaatggtctcctggatttagggtaattttgagaggttcaggttttgtcagtgtagagacaatctccttttttatcaacagatttttttctcattagaatcttatgtcttttgggcaagttgaaaacgcaatgagaaatttaactgtatccttttgtacataaaatatatctttatatgtaaaatattcataattcttctgcaaatatctttggttaagtgcttcagtggtaatagaatacaggatagaggacatcttaaattgaagaattattcacagtggccattttctaagcaggtactcggttaaacaactcttgtacattttagaactattcacaaacacacacacacacaactgatctaataataatacagacaagaggcaggaaaatacagggtagaagagggtggttccctggcaaaggcccaccctcaagcctggaaaatcccagccctaactgggaagaggcattcctgttttgcgcccaactgttgtcttttccaagaccaccttggccctccacaactctatcttgtacccatataaaccccaagctccataaagagaggaacagaagagcagaagagtggcagagaagtagagtggcatggctgagatggagagaaaagaaggagcaactgaatgagaggagtttggggacataaaggagattgtcagcaacttaaaattaattatgtataatttaagactcattattcaccttttttacttctagtttcatttcttctgttatagtcttcactctgaattatttaaagtttgaatacactgcttttttccaattatatttaatcaagactgtgggtgactgtctaaatctgctggctgtggtagatgaacaatactttgactgatatactattgattgcagttctacttgtgattgattttcccatttaaaactatctttgactaattgaacctcaacttttttctcaaaaataaacaagttatagtatttaaatacctgaagcgcactgaagaattggatgtctttctaattctttgttggcatatgctaagactatcttcttccatattttagcatgcaatattaaaaaaattggaaagcaacacagtgtgtcagtctcaaactctctatgtcacatagtacaaatgttaaattttaatgtatttttttcaagaaaataaattgaacacccaataggtaccagaattcatgctatacctgtgttcactttcctcttggactgtgaaagtcacataagcagacatgtaatgtgttgtgcttaataaggaccattatcattccgcatcctcatctacttctgtcttctcctagacatcagctagcatacaaggctaaatattgtatttcccaaattattttgtatgttctggttgtcacttagtttctgccagtgagatttattcttttagagctggaagtgtaagctgacaagcaaagtcagatatgaccattgacagtcgctagtttccatttccagagtctagtcaccagctccatgactgtgtggtggttgtgatggttgtagtaataatgatgaaagcagcagcaattttctcatgctagtttgcaagagcattgacattaaatctaaatgtcatttatttctccagcatgtccagtgattttgtaagacttaattattcttactaaattatctcttgttgaaacacctgaagtaatttctgtttcttgagctgaatgctaattgacatagattgtatatatgatacaaataatgcttgcgctggtatgtgtgtatatgtatatgggcctgtgtatgtgtacagagtcagaaaaacctagaattaccttcttgatttactacacacttcccgtttgaacttgttgaacctcaatttccttaacttacaatctttagaaaatgcttattatgccatattattataaggataaaattgtggaatatatataaaatatctccaacaagtaacagcagtaaataaattgtgaccagcagaaggggagtagttattataatgacatgagaattaaaattatgccttattttgatatcttggtttctataaaaattaattatttttgtttgttctacatattttactcaatcttctaacatttaggagatgcagtaaataacaataaaaatacaaaacagatgtgtgattttcgtgagttccaagatatcattatgacaggtaataaataaactaaacatgcaagcagaaaaatgtactttagtaagtaaacagagttttgtaaatgtgtccacaaatggcttgtgttgctagaaagtaaaatcacattcatcttggatataacaattgaaatgaatatgcactgaatttcatagaaatcagagtagttttagaaaaataatttcattttagttagaaactaatcaaggcataggtgctattctgactaaattaaatttgtttaaatattcagtttatatgtaaatgtgttgtttgataaatgtcaagatttttcttaattttaacaaatcttttcattagaaacaatatttttctcgatttatataatctacattttcctttactttctctgatgagtttgaaagaacacctgcatgactaaattcctttgaattgattttaatacaaatataatttatagaaagctttacttgttcttttaatcattttgtctttctttgacaaaccaaataaatgaaaataagatgacaacttaaaaattaattcaacatcatttaaagtaaatatgaatatacttacctataatgcaaagatatttttgtatggtgatttttgaacaaagcaatttgaaaacattgagttcttaagtgatgaataaaatttacaagtataccaggaagaaaatataataaagtgggtacaattttaataaaaacaagtttaatttaaacttatttccctaatacttttaatattggaatttttgacaatgtattcaaattatggcaggatttagagaatgtaggctcttctgtcatctactttatcaaatactagtttctcaaaaatgtatcattcatttactgtgattatattgcttttcttctttctttctttctttcgttctttttttgtttgatttttgagacagtcttggactggaatgcagtggcatgatcttggctcaaaggaacctctcccggttcaagcgattcttgtgcctcagcctccagagtagctgggattacaggcgcccgccattatgcccagctaattttttgttatttttagtaggtacaggtttttgccatgttggccaggctgatgtcgaaatcctgggctcaattgatccacctgtctgggcctcccaaagtgttgcgattacaggcatgaaccactgcacccaaccactgtgattgtatttttagtgcctttctttatccctttcattctattcctcaaagaaagcgagggagaaaaaaatgtatgctatttttccaaagagattattgtgaaaagttaaacagaaacttctttagagtaggaagattgattcctcaaaatttatttcatgaggtggtgggagtagctcccctgaactgctgcctccaaagttgtgacccacataacatgtctagagtggtctgtacacccatggcttatggtgaccaggttttcatctgggggtttctaggaagatgaggaataactaaggaaaaataaagatgaagaagacaaatattaccaatgatcaaaaagaacaacatacactgagctgatcaaattttattaacacatagggcttaataaacatctcaatgtatattttaactcacacttccagaaatttatttttgtggtttttgttttgttattttacaggcaaacaaagtgaaattttattttgtatattgtatttctgttataattaattttggtcaagaaaagagagaggcagtgatagaaatgagagagagagaatataaacagagaaggtggataagaaaatctttatgtaaataaatgcattatgagaaaaatgtataggtaccatatatctcagattatgaaaaaactagtgtcttgtttatcatagtaaagagacaacttgtaccaaaggtaagcaatacatttcaagacatttatagctagttttgttaaactttgtagtatgtataattttctctttattattttatagaaaatcttgttcttttgatgaaaatgttaaaattagaaatattacagagctcaggagttgagtatcctctgaattttagtattattatattcatttaaaactcaatccaacattttataacactgtgttgcattattggacacaaattcatgttaatttgagctaacatctgcatttattcactgcgtttccattctctgaatagggctatcatttgggtcatagcttagtctgagttactttccagtagtttcatatgtaaactcatttcagatatacatagtcacaattagaaatgtaaaaatgggctcgcatttttatcaaaatgccataagcttataggtacagatattttagctcatgcccttgtaaagttttcaagaaataacatatatattgcctgattgctcttttgtttcaacagtgatttttattttgggtaaataatgtaagcatatatacaaaaacctatacaatggagaaaagataagaaaaacatgattcaaaatctaaatgtaaacacaaatatgtatgtgtgtatatcacaggatagaaattattttataaacctgagaccatgacatcaattcagtttttagttaaactgatttcatttatcttttttgaggttgatagaaaaaagaaagtaactgattcgtttaagtgaataatgagtaattaagccataaatagacactagggaaatataaatgcatattgctaaatcaaagaaatcaatctgaaaaggctgccaactctatgtttccaactatctgatatgccaggaaaagaaaaataatgaagacagaaaaaaaaacattacttgtcagatgttaggacaaaggcagaaaaggatgaacaggtaaaggacaacagacacagagtttttagagcagtgaatcttttattctttatgatattgtaaaggcgtatatatgtcattatatttttgtgaaacatagtttgaacagcacaagtttgtataacacaaagagtgaaccctaatgtaaaatacagacttcagttaataatgataggtcaatattggctcctcagttaaaacaaatgtaccacattaatataaaatcggggtatatgaaaactcttatacttgccattaattttgtttttcgtaaagccccaactactcaaagtctgttaattaaaaactactgaagcaacaataaacttcaggtaaatgtgtgctcacaacaagattgattattagatggctatcattttaaaggttttgcaaaattcatgggctgtcaaggagaaaaaaagttgctttttttccttctcaaatgtcttgaatagaaaaaaatatatagagttttaatagaaaacaaatagacatgccaaaaattcattgcatttcctggatcaatagcatcatattactttgggaaggacaaaaaataaaacattaaatgaaaaaattatcttaattattatttgtcctaaagatgtaattaatagtatggaaatatcctaaagggatgtatcagtcagctttcaattacaaaaactgactgatacattccttgagcccaggagattgatacagaaataagccatggttatgccactgcacctgggcaataaagcagaccccatctcttaaaaaaaaaaaaaaagaaaagaaaagaaaacacaaacccctctaggtattttaatcagagggtatttaatacaaaaatttgattacataggtgactgaatagatcacttatttgggaagtggaacaagatggccaaatagaaccttccagctcatacttcattctcttcactaaggaatgccaaattaaacagctatccctccaagaaaacgccttcataagaataaataaatcaggtgagaaaccacatacctggtttaaatataatatcaagggaattcgcattaaagatgataggaaagacacttacattttctacaccacccctccaccaacccgaggcagagcagcatggaaagagaatcagtatgctcaggaagggagagtgaagtgagtgtgggtctttgcactggaactcagtgtttccctgtaacagcaaagcacaacacacgacagatttctactggtgttcgtggaaggaacatttagaccagatcttgccagaagaggattctccactccagtgggaggaaattgattcctggccagctttaccaccagctgattaaggtgcccactggtccagaacaaatttgagtgataggccacaataactggagtttttggacaaacactcatgctgcactgatcttggagccagtggacttgggatgtgcatgacccagtgcgataccagttgtggcaagaaaagggagtacccatgtcaaccctcacccaactccaggcattgcaactccaggagagattccttcaacttgaaggaaggaaagggaagagtagagataattttgtcttgccacttgggtaccatcttagcagcataaagcatcaggcagattcccgaaacaccaggcagattcctggagcccttgattctaggtctttgctcctagacagcattcctagacccacactgggccagaaggaaatctgctgtcttgaagagatagacctggttcttgcaggatttactagcttctgactgaaataaccttgggccttgaataaacatcagtgttagccaggcagtagtggccatgggccttggtcaagccccagtactgtgctggtctacaaggcttcaggtatgatcctatacagtgtcagctatggtagctatgggtaagcccatgtcaccattcccctaactccaggcagcccagtatggatagagactcctgattagggataaaagaagaaagggagagacttttactggtaactcaggaagttcttatcttactcaagttcaccaagcctgtatttcgaagagtctgcaagaaatgcagcattcctgggcttagggtgaccctagtgctgaattagttgcagggaccacaggatttggtaacaacactcaatcccctttaaatttgtgaaaagccttttcaaaaaataggtacaaacaagtctagactgcaaaaatatgaatcaacacccaactcttcaatgttcagacatagacaaataccaaagcaccatgaatatcgaaaaaaaaatgacctcaccaaagtgacaaatcttagagtgacagagacatctgatctttcagacaggaaattcaaaatagctgtcttgaagaagcttaacaaagttcaagataacacagagaaataattcagatttctatcagagaaagttcacaaggagattgaaataatagaaaaaagaaaaaattctggagcttaaaaaataatttgacaaactgaaaaatgcttcagagtctctcaactgcagaattgatcaagcaaaaggaataattagtgaattcgaagacaggctatacaaaatacgtggtcagagtagaagaaagaaaaaaggattaaaaaatgaagcacacacacaagatatagaaaacagtatctaaaggaaaaatctaggagttattggcattaaagggatgtacagagagagattagagtagaaagtttattcagagaaataattacagagaactttgcaaacttagagaaagataacaacatccaggtacaataaagtaaaagaaaagaaagcagattcaacacaaataagactgcatgaaggcatacaataatcactcaaaggtcaatgataaagaaatgaccctaaaagcagcaggagcaaagaaacaaacaaaaaacatataaaggagttatgatgtctggcagtagacttttcagcagaaactctacaggtttgaagaaaataggatgacgtatttgaaacgctgtagggaaataatttccaatgcagaatattacatcaagcaaaattatacttcaaacataaaggagaaataaaaacgcccctagaaaaataaaaataaaagctgagaaaagacctatcttacaaaaaaataataaagggagttcttcaatctgaatgaaaaggatgttaatgagcaacaggaaatcacctgaaagcataaaactcagtagtaacagtaagaacacagacaaatataaagtactctaacactgtaattgcagtatttaagactttcatattgttagtgggaagttaaaaagcaaacctatcaaaataataactaaaacatatttttaaaagaaagacagcataaaaagatgtaaatacagacaacacaatgtcaaaaggcagggttgaaggggatggggttaaagagtagaggtttttatctttgcttgttttttttttttcttttctttgtaatcagagttaagttgccattagtttgaaataataggttttattatttgtaacccttatggcaaacacaaaacaaaaaacaagaaattaaacgtatcaacagagaaaattactcttactcaaagaacataagaaacaaggagaaaagaaagaaccaataaaataaccagaaaaaaatactaaaatggtagaagtaagtccttacctatcaatgacattgaatgaaaatggtctaaattatccactcaaaagagatagaatggctgaatggattaaaaaacagaattcaacaacatgatacctacaagaaactcacttcaccaataaaaacacatggactgaaaataaagtgatggaaaaagttattctatgcaaacaaaaaccagaaattcacaggagtaactctacttagataaaatagatgtcaaatcaaaaattgtaaaacgagcaagaaggtcattattaaaagggtcaattcagccagatgatataatgattgaaaatatatgcactcaatgctggagcatgcagataaataaagcaaatatcgttagagctaaagagacatagaccctcatacagtaatagctggggactttaacatcatattttcagcattgcacagatcatctagacagaaagtcaacaaagaaacatgaaactctgtagtatagattacatggatttaatgaatagtggtaacattgtatgcaacatattcttttactgcagaatatattacattcttctcctaagcacatagaaatttatcagcacttccaaggatagactatgtgttaggcctacaaaataagtctcaaaaataaaaataaaaatattatatcaagtatcttttctgaccaagatggaataaaactaaaattaaacaacaagaggaactttggaagctatacaaactcatataaattaaacaatatgttcctgaatgaccactggggtcaatgacaaaattaaaagaaaattttaataatatctgaagcaaatagaaaacaacacaccaaaacctaggggacactgcaaaggcagtactaaaagggaagtttacattaataaaggcctacatcaaaaaagtagaaaaactttaaataaaatacctactaatgcatcttaaagaactagcaaagcaagaacaaacaaaactcaaaattattagaagaaactaaataataaagaccagacaagaaataaatgaaattcagactaaaaagtaatacaaaagatcaacaaaatgaaaagttgttttaaaaaagagcaacaaaattgataaaccattaaccaaacagaaatgaacaagactcaaataaaatcatagatcaaaaaggagacattacaaatggtactacagaaattcaaaggattattagtagtttctctaggcaattatatgccaataagttgaaaaacctagaagaaatgactttggagtctctcaactgcagaattgatcaagcaaaaggaataattgctgaattcgaagacaggctatacaaaatacatggtcagagtagaagaaagaaaaaaggattaaaaaaatgaaacacacatacaagatatagaaaatagtatctaaaggaaactaaaggttttctttagtttctttaggaaaataaagattttctaaaggttttcatcattttatgtgactagaaatgactagatacataaaccttctaaaattcaaccatgaagatatctaaaacctgaatagcccaataacaaataatgagatagaagcagtaataaaaaatctcatcaaaaaaagcatcttatctcaccacattccttcactgacgacttctatcaaatatttaaagaagaactgacaccaattctactcttcaaattattccaaatagtcgaggagaagagagtacttctatattaattctataaaacaagtattaccttgatagcaaaaccagacaaggacacaaccaagaaagaaaactacaggcaaatatctctgataaacatagatgcaaaaatcctcaacaaaatcctagcaaattgaattcaacaataaattaaaacatcatttatcatgatcaagtgggatttagtccagggttgcaaggatggctcaatgtatgcaaatcaataacattaaaggatcattcatcaaaattaagtaggctttatttcagggatgcaaaaatggctcaatatacataaaacaataaatgtgatacattatactatcagaatgaaggataaaagccatatgatcatctcaataggtgccaaaaaagcatttgattaaattcaacatccctttatgataaaaacctctcaaaaattggttttggaaggtgaaaacctcaacaccataaaagccacgtaagataaacccacagacagtatcatacggaatggagaaaaaatgaaagcctttctctgagatctggaataagataaagatgcccatttttactgcttatattcaacatgttactagaagacctagcaattaaacaattgaaggaaataaagggcatccattcatgagaaaccacccccatgatccaattacctatcaccaggccccacctccaacactggggattatagttctacatgaaatttcagcagggacacagatccaaaccataccaaaaccaaaaatcaatgatttcaaaacaaaacaaaacaaaaatcaaaattaattttaaaaatcaatggttttttgaaagatcaatagaatcgaaaatcacctagtaagactgataaagaataaaaagggaaaatataaattaccaatatcagaaatgaaacaggacatttctacaaacaatgcaaacattgaatggagaataaggaaatgatacagaaaatcctacatacataaagttgacaatatatataaaatgaaccaattcttttaaaaaatacaaactaccacagtttatcaaatatcaaatagataattatatccctggaactattaagaaaattgaattcacaatttaaagttctcataaagtaaatctccatgttcaaattatttgagttgagaattctacgaactctttaaagaagtaagcaattcaacacaggctatttcagaaaaagaaaaagaggaaacatttctaaatttattttatgaccctagtcttaccatgattccaaaaccatacaaggacaatacaaacataaggcaatgccaggccaatatctctcatgaatataaacataaaaatcctcgacacaatggtggagcaaaaataattcagcagtataggaaagaattttgtactacgattgagtgaagttttttcccagagatgcaagcctagtatgacgtttgaaacttaatcaaagtaatccaccatattatcaagctcaagaagaaaaaaaaccacaagatcacattaatcgatataggaaaagcatctcacaatatccaacattccattataataacaactttcagaaaaatagaaatagagggaactgtccccatttacatcaagtatatttacaaaaatcctaaagctaacatcctcttcttatttgacaaaggttgtccagaatatacaaaaaataaactctcagaactaaacagtaaggaaataaaaatcctattagaaaacgtgcaaaagacatagacctacatttcactgaagaggatatagtttcataagcaaatgaaaatatttttactttcattatccattggagcaatcagatttaagcctcaatgagatattgctacacgcttatcagaatcgctaattgttttttatgtgataacaccaaatgtggacaaggatttggaggaactggattatttacaaaatgttggtgggaatttgaatgtaaaatgctacaatcattctgaaaaacagtttgacattttctaagacaaactaaacattcaactaccatataactcaccaattgctgtcttgagcatttatccagaagaaacaaagacacgtgtttcacacaaaaacctatagaggaatgcacatagcaaccttgtttatggtagctaagaacaggaaacaatacagatgtatttcaatgcatgaattgttaaacttttgtgcatttataccactaaatactactacaacaacctacctgaatctccagaaaattgttcttagtgaaaaaactaattcccaaaagttgcatactgtatgattccattaatgtaacattattcatatgacaaacttacagaaaaggcaaagggagccagcccctccacacctgtgggtatttcttgtcaggtgggacaagagactgagaaaagaaataagacacagagacaaagtatagagaaagaacagtgggcccaggggactagtgctcagcatagggaggacccacactggcaccggtctctgatttccctcagtatttattgattactatttttactatctcagcaaggggaatgcggcaggagagcagggtgatagtggggagaaggtaagcaagaaaacatgtgagcaaaggaatctgtgtcacaaataagttcaagggaaggtactatgcctagatgtgcacataggccagatttttgcttttcttcacccaaacatctcagtggagtaaagagtaacaaagcagtattgctgccaacatgtctcgcctcccgccacatggtggtttttgaggatacaaacaaatggaagaacattccatactcatgggtaggaagaatcaatatcgtggaaatggtcatgctgcccgaggtaatttatagattcaatgccatccccatcaagctaccaatgactttcttcacagaattggaaaaactaaagttcatatggaaccaaaaaagagcccgcattgccaagtcaatcctaagccaaaagaacaaagccggaggcatcacactacctgacttcaaactatactacaaggctacagtaaccaaaacagcatggtactggtaccaaaacagagatatagaccaatggaacaggacagagccctcagaaatgatgccgcatatctacaaccatctgatctttgacaaacttgacaaaaacaagaaacggggaaaggattccctatttaataaatggtgctgggaaaactggctagccataagtagaaagctgaaactggatcacttctttacaccttatacaaaaattaattcaagatggattaaagacttaaatattagatctaaaaccataaaaaccctagaagaaaacctaggcaacaccattcaggacacaggcatgggcaaggacttcatgtctaaaaccaaaagcaatggcaacaaaagccagaattgacaaatgggatctaattaaactaaagagctactgcacagcaaaagaaactgccatcagagtgaacaggcagcctacagagtggagaaaatttttgcaatctactcatctgacaaagggctaatatccagaatctacaatgaactccaacaaatttacaagaaaaaaacaaacaaccccatcaaaaagtgggcaaaggatatgaacagacacttctcaaaagaagatatttatgcagccaacacacacatgaaaaaatgctcatcaacactggccatcagagaaatgcaaatcaaaaccacagtgagataccatc

SEQ ID NO: 4640 - DNA, 15044 bp, Homo sapiens
agtgctacgcgcctgcgagctcgcgcacatacacatatacatacatacacacatacatacatatgcacacacacgtacacgcagaatcacacacactctcctgggacatcaaagcatcagctctctggacctgggagctccaagatagtctatccgcatctaggtaaagcagattattatccacaatgttggtgagcctcatccaaattgttgaatacctgaatggaacaaaatttccaacctctgtgagcatgaagaaattttctagcagactgcctttcaacttcacctgcaccatcagctttccagagtctccatcctgtcagcatttggactggaacaatgccattggctgtcctacgcctcaaacctcctggcccgtgctgcaagattctaactcactagcctttgtaatcatgtgagccaattccttaagagataagaatctctttcgagatattaaacaagacattcaattggttcttttactctggagaacctaatacagctgtcatgaaaaacttggatattcaaattagataaaagtatatttcagaaatgtaccaggatcacattgttagcttgtctctatggctttatcctaagtccttaagtattctctgcttagacagcagggtttgcttagtggagagattgtatctctaactgtattgccaggacaggtttttgactacataccacctatctttctcaagaaagtgataataaaagcaatttttttcatatttgaaatcctagagtacaacaatagcaaatggaaaatgaagaaagagggaattaaaaatgagtaaaagtattaacattacttgttttaggaaaaagtaacaataagtagataaacaatggctagataaggaaaaatttttaaagtcactgttaaaacttgaattttcttctaaaattctcctgctgaacacctttctagatgggtaaaagagtgagaatattaaataaaattctaaacttttaaaaatataactggttttaattatctgacaggtaacatacaaaatttatatgtaaggacatttttaactatagcagttgttcccaacatatacttcaaaagtagtgttcggccgtcctaaaacactagaaaacttctacaggcctttgacctcttgtagattatgtggaaaacagtaatctatctattctgtattttttttcagaagtatccaaattttttcctcagggaaaaaaaatacaggtaataagtttcttgataaaatgtttctcttaaaaactgcatagattacttctactttcaggtaaggtcttacttctctccataaataattgaaaacttagataaaacatgtttttagatactagacaacagtaaatactgtgagctaaagaaataaaataggtaactacctacaatcattctgactttctggcctacaggatatttataaatcttggggcagggagagccaacccactagctcccaagagctgtagctaacattttatttattattttttgatttgaggagatggtgtttgtagcataaatctgagattgctagaatattttgggacggatcaccaatgaagaaagagttactcagagaaacagctccagaaatctacataacgaatcaacgaagtctttagttgaatgccaatctgcatgttaaggtgaaactccctgaggataggcaaagaaaatttctgaggaaagaataatttccaggtacatataagtcaaaacaatttccacaggacaaacagtgtcatgactccttccaagtgctagcaaacaaagtgaagtaacatcattgaatacatgggcagtagtagagacgcaagataggcccatgctctagtaattgggctaaactagtcccataaaatagattattctgtaccagggatcagcaaattaaggaccaatctgaaccactactttccagtaactaaaattttattgcaaaatggcttttcacttatttacatattatctatagagacttcagtgttacaacaatagagtgatagaaatcaaacggtctgcaaagctttagataaatactgtgtggctcttgacagaaaaaaaatcccttgctgattcctcctctagacttgccctaatcaaaggactttcatgcaactcaacagcctatcagaacaaaattcaacactgataaaagtctgacaacaaaattcagtaatcaaatatttaacattttcaatgtctgtcatccaatccagaattaccacacatacaaagaaggaggataaaatacctctatacccaggtaaaacaaatcaaaaaataacatagatgatgacaaaagtagaaaacattttttaaaataggtataattatcatgtgcagcatgtgcaaatattttttaaaatgaacataatgaggagagtcatagggatataaaaaaagaaccaaagggaaattctaaagataaaattatgataccaaaaattaaaattattctgattggtagattaggccctgaaatagaaagtcagtgaaattgaaaacatggcaacaaaaattaaaatataaaataaatataaataaatgcacaaaggtaaaaaacaagatattaatggcctcaatattaatatcagagacaatatcaattgcaacaaaatacatggggtggaatactaaaaagaaagagaaagagaaaaacaatgtgaagcaattcttttttttttttttgagacagtctcactccatcgcctaggctggagtgcagtggcgtaatcttggctcactgcaacctctgcctcccgggttcaagcaattctcctgcctcagtctcccaagtagctgggattacaggctactactaccatgctcagctaatattttttttttgtatttttagtagagacagggtttcgccatgttggctagggtggttttgaactcctaacctcaggtgatccacccgcctcgggattacaggcgtgagccaccgtgcccggcccatattttaaaaatatctatattttataccaagtcatcagacatttgagaacatatcctattgaagtaaaacacagtaaggatgtatttaaagaatgagtattgaagaaatactcacagaattgaaaaatcagagaatgttaaataattataatatattcatattaaaaaataatattcagtcttaaagcaaatagttaaagcaactaaaccagttgtaataggcagatttccaaaaaacggttatgtaagaaaacaagatacaaacattgtaatatcatttcatgttttcaatataaattatttaaaaatttcatatatgtatatgtatgtttaccaaactatgtgagtactgagaaaaatatgaaagaatgcatgcttgattgtcatatcccatgggtgtgtaatgggagtagtgaagaagataaatggggtagtataaaaaatataaaaccataatacactaaaatgtaatatgaatgttatactttacatttgtttaaaattacatatgtgatttgtacaactaaagtggtataaaaattagaagcaaagttaaatgagaaggaattgattaaatgtacatacatatacccacagaacggtatcaatacatgggtacacatacacacacatatatatataatgtttatgttcactaaataattatgtgtcacttaacgatggatatacattctgagaaatgtgttgtcaggcaattttgtccttgtgcaaatatcatagagtgtatttacacaaacctagttcacactttggctatctggtatagactattgcttccaggctacaaacctgtacaacatgctactgttccaaatattgtaggcaattgtaactggatgttaagtatttgtggatcttaatgtatctaaacatagaaaaggcacatacaaaaatacagtattataatcttatgagaccatggtcatccatgtggtccatcattgactgaagaatcgttagcatgtcatgactgtacatatacagcattcatatatttaaatacatgcatatatattatatatatatggggcatacacataagtaatatatattttcatacaccttgcaattttactgcttggatttattttcttagaaaacaaaataaataagatagtatagatttaaaaatctatggataaaataattcaaagcaatagtacttttgtagtgaataacataatatagtataaatgtacaaatacagtgatgcattacagatattttgcgtattttacagcatgcaagttatctctttaaaagagctttagaaatgaattcagtaagtgaaagaacaaaatatttttatatcaaattattttgccaaatttatacgttactaccgctagtaacgtatgagatcattcatctcaccattgcaaacattgtcattataattcaaaaaattgtatttactatttggttgacttaatttacatttttaagaatagtataaaatggctaaagtgatggcattttaattatttgattcatcttttttggctccacttaacaattgaggttctattaattattttatggatttatgtgggcttttctatcaagctacgttctgaaatagttgctcataatttagtactgctttctttttctcttaattttagttaaagcttctgacatacagtagttgtaaattatatattaaatctattggttttttccattatgatttttttccttattgtaataaagcttaaaatgaatatccttcctcttgaacaagtttcctatctagcttgtattaaattaatctcagtggaacttaaggatccatagcaaatggaggattcctgaaatccaactgaatatcaagtattttctgaagacatcataagtaatagtttgtgtacttttaattgtgtgaaatattttaagcttaataagccatatatgtatttaaaactaataaatttatagatagcatatgcaacattgaattgatctaacagataccaaaagaagtacacctataatgcaggcagttgaaatttattttgacacaggaacttctttatttttattttttatttttttgagattgagtctcaccctgtcgcccaggttggagtgcagtggcaccatctctgctcactgcaacctctgcctctccggttcaggtgattctcgtggctcagcctcccaagtagctgggattacaggcgtgcaccaccatgcccggctaatttttgtatttttagtagttttgaactcctgacctgaggtgatctgcccacctcggcctcccaaagtgttgggattacgggcataagccacggctcccagccaaggaacttattatactaagtgtggagaaccctgctatagaagtctgtcaaatatttactgcccccacccttttcttagtatttctgtaattcaaataacttttcatatttcatatttagtttttcatatttattattgtaatctattgggaagttatttttacatagaaagttggttaggaatacgatttatcttgtcaggttttatagtttttctaaaagtttacctacgtgttttcttttttcttttttctttttttttacttttttttcttattttgagatggagtctcacacttgttgcccaggctgcagtgcagtggcgcgatcgtggctcactgtaacctccacctcccggtttcaagcgattcttctgcctcagtctcccgagtagttgggattataggtgccagccaccacacctgaattttttgtatttttaatagatactgggtttcatcatgttgaccaggctggtctggaactcctgacctcaggtgttctgcccgcctcggcctcccaaagtgctgagattacaggcgtgttttcataagtttcttttctctataaatatcatattgtattactaaagtggagtcatttttgtttcattattacttaatagctttaactgtggtaatgaatttcagtgctttcctttcatactttatgatttttgcaccttcagcttgaaatcaggtactattaaactccagtaatttttatttttataacacattgcaatttttgttattttcttttccaataattctacatttttgttcattgtagcaacattagaaatatacttttattatttatttatttaattaattattattattattttttgagacagagcctctctctgtcacccaggctggagtgcaatggcacagtctcagctcactgcaacctccacctcctaggttcaagtgattctcctgccttagcctcctgagtagctaggaatacaggtgcatgccaccatactcggctaatttttgtatttttagtagagacggggtttcactatgttggccatgctggtcttgaactcctgaactcgtgatcagcctgctttggcctcccgaaatgctgggattacaggcgtgagcctccacactggcctcacatgcttttagttatagtgttttgtttttgctttttagtaattgaagtaattgttgttttcaaattccttcttctggtttatcaatttccttatatttttcttaatgtttttactgagaaatgctaacaaattttatcatgcaatcatgtatatttttattatattcagtaatatactaatgctttattatgttaattagctataaaaatatatttaaaagtcctgctttgtcatgttggctacagaataacactaatcactaatatgtcatttcaaatatataaatatcaaagtatatatgtgtgtgttttatacaccatatattacattatattaaatacatatatgccttatttatatatatatataatgtatgctgaattttctttctctttcttcccttcttctttctttctctctcactttatttcttgcttgcttttctgtttttgtttaatctgttttttggtgacccagacagcatccattttctcttcctaagaacattctattttttggggggagggatctatcacttccccttattgttgataaattgatagaatgataaatcaagttaccttgaccactcttatatagccaatgactcactctaggtcaataatactatcccaggactttgcatcttgactgaacatttgttcactcttcttgagtaaaaaaactccaaaactcggtgaaaacaagccaaaaatatattaattattgctcacatatctatgagttggtttggtttctgaccttccaggcaggactgtcacgaattattcttgtcattatacatctgagatgacaaaaagactagctgagatgataagttctgtgtttcactgatcatcgttggatgagtgagcttaacaagagacgttactctcatagcaacaccaaagatgataaagagcatttggctaactgacacttttctccatgtactatttgccaaaacaagtcacataactaagccaaaagagatggaggaattcatttccctcatggagatgagaagacttgcaaagttaaataacaagagtagatacagaagaaggagaagtattagagtcagtaatgaaatctaccaggcattgagagccacaaaggcaaaatgtatgtgtaaaatattcactttattagcacctaagaaagagagagttgagcaagctatatctgtttcctaagagcccagtaattgctggtatacatgttgtttcttatgctagttcctagtctctgtgtaaatttgaactaaacaatatataaaagattcccctcttcttaattttgtggaaattggtattgcttacttccaaataaagaatcctaagtggttaagaataaaacaaaatttgaagaaggtagaatatataaagaggctgacaaattctttgtgatcttggcttaaagaacaatacatctcactgtggcctttgctactttattacttttcttcctaagagccttaggaatttctaaatccagttttccagcttaatctttacagtggacagaaaacttctctttatactaactcccatttgagaatcctgtacttttcctcaaatatagagaacttcacttctctccttgccatggccagcttatttttcacttattggcttccacaaagttggccgtgacctgtgctctccacaacaaaaatcacataaactgatggcaatgcagaattcaagtaaacatatttagctagtgatgatgcttgatccagtagtagctgcactgttagttctctcaacttctattacttttgcttgctatttctcttagtttcctttgttttcccttcatagtacattctattgtattacacaatataaatatgtcattttattattatcatcatattacacaatacaaagattctacagcaatgctgtccaattgaaatatactgtgaatgataagtataagacatatatgtagttttaaattttaatacccatagtgaaataaaaagataaaatgaaatttagtagtatatttaattccaaatattcaaaatataaccatctaaaaatacaatcaatattaaattgttaatatgagttttttcttttttttggtataaagtgttcaatatccaatgtgcattttatacttactgcaagcatgtctccatttggactcactatatttgaagcggtcaatagccacacatggctagagactacaatattcaacaatgtaagtccataaagtttcttagggctgagttatgtatgtctaatttatttgcaaatttcataagggcagaggtcttttctatactgtttaccacaatacacatagaaccaatcagaaggtttagtctaaaataataggcatttaagaattttgtatcaaaaactcatttagtataatgttatctattttttctagagtgaaatacatagttccatcttttaaatttctaccttataagcactattatctaccataaaattatctgttcatttgtcttgaaattctttattaaacacttagatacaagtttttctttatttaaattctctcaataattttccatttttcccaatgctacgtgagtcaatcgtcaaggaaaaatatcctgttcattaagagtttaaatgttttagtataaaatgatgacctgttttatgatcaaacaatagttatttaccaaaggttacacattcccagctgtgtattattatgaaactttaggttatgtcaatcatcaatagagtttcttcatttgatacccttaacataattttttccagatatagatacattatgttcatatgttatctttagatttctggatttttgtgatatctgttctcatttatatggtcatgaacgattttaatagaaggtgaaatagaataagatactcttagtaatctgcctcataagtgagaaattcactatatttttttgacatttattagaatcattatttttaaattccatggctatagtgctatacttatcctactgagaactgctctcaatttaattaataaggacttgtctgttgaatacatcattccttttagtattcctcccatcttctcagggtatactggaaggaaaatttgtgtgcttttgctgaatattattatagttatacctttggatagtttaatacactgacatgattagttgtactgagtttatattttaatataacactcaaattttttactggattatgcgagtcaggtactcttacctgaacattttagccacttatatataaacctctaccatagttttacaatgctaggctgtctttaaaaagtccatggcatttatcaggaataagacattttaaaaatcaatttctagcagtttgagctatgagaatgcaaattataacattgtactacagttctgggatgtactaaaaaattaagaagaggcataacaataattacgccaggtggtgtgttttatttgtaatgacaaagcttatttctacacaaaatgcctctagtataaaagaatgtcaagaattactatctaacgcattgctgatttctttaattactctcattaatgtgcctttaatagctacccagaattaaatatttaaaatatattgtgcattttttattaaaggagatatttaaataaagcaaaataaatttcatatctataatcttcagttataggaatgaagatagaagcagtgtatatttatcttagggaagttgttagtaattactaaatttctttaacaaagcaaaattggattcaccaaaatataaacaatataaataatcatatgtttaagtggttcaacattttaaagtgttaattaccttctaagatatattctgcctcaaagcctccatacatgctgagaaacatactgaggaattataaacatcttgtgtaaaacatgttgtcatatattctccaacaactgtgtttcagtaaaatctgcccaaggcttaacaaaaaagtgtttaaagtattatctgtctacatcaagagcagcattttgtcagttaaataaattatgataactttgtgaaatacagtaattaaggtgcttctatgtaatagaataatgtgtaactggtagaatattactttacaagaatgtttaaggttattaaaatgttcagatatgttaaacaaagtgcacttgttgaataatatacagcttatgatgaaaattttgtgagtgaatgatgaaaattttgttgggtatatatgtaaatatttaatgtgtgtagaaaatgagagagagacaaagatggtaagagcaggtaagtactttaaaagaattataacccaaagaattataataatcatcatctgggtagtagaattaggtgttcttaattttcttcttacactttcaaaagcattttacagtgtcattatgaatatatatgactattttaataaaaataattgcacaaagtatgtattaatgattataaatagaatatattatttagtatatactatacttataattacttccttcaacagaactactttgttttactatgatcagacactaatattaaccaaattatatcttctagattcatctgctccatttataccctcttttaaatttacctccaagaaagcaattctgttctttcttgcacctctaatttctttccactgtatcctttctttttaattccataaatgagtatgaagtttgtcatggatgttctgtgtggccctaggacaaaatctatcagaaactgtattgcatgaagatggctggcagctgagtcctttagaaatgccttttgctgaagggagttgggccatcaaagatgtaatgatacatccctgggagaggtcagggtccaatgacggtttaatgtgaggtttgagatgcccagcccccttgcatgattcagaacttctctgtagggccgtctccatttcataagccctgtgtgattggctgaagtttctgttcctactgtaaccaattcctcccttctccttttccaattcagcttcttgtgtttcctcatagatactgcgactgaaaacgacccaatgcctttcctgcataaaaatgtctgtctcttagtctactttgcaggcaaaatgacaaagggattattcaaaggtacatccagctagtgttgcaaggaaatgtttattgggattacacacaaaaatgtgaaggttctgtataagaaggggagcccattttcagttcaaaccttaaataaactaaatgaatttttttttttttttttttttttgctctcacgcttaacacggcaaaataattaaagaagataggaaatatcagtacagaaaaccgtagtctaagcagacagacataggctttttttgtggaaaacaagtgaaactgtcagtcagcagttacagaaaatattgcagaacatctcagagggaagcaatgtccctctggacatcaattgtggtagatttacttaaagtaaattgtataatttttcatgacttcaaaggctaagtatttagtggtaatggctcttaaaactgtcatcagaaggaagaggatcagcagagttgggacaatctagtcaaattcaattaaatattgaatactaaattcttcctatattttctagctttgttctagatgttacttgggaggctgaggcaggagaatcgcttgaatctgggaggctgaggttgcagtgagccaagatcctgccactgaactccagcctgggtcacagagtgagactccatctcaaaaaaaaaaaaccagaaagcaaaacaacaacaacaacaacaacaacaacaacaacaaaaaacttaagctttagaaaatgttgtaatagagattttatggagggtaatatggttaacatttctctacttccttagtgatggagaatcaagagtttcttacctacctattctctatctacctctcagttttgaatccttcacttgtttactctgcatcatatctagcactctgccagtctgttttatatccctacccctcttgaaccttgatagctaaacttaagcatcatgtagtctacaactaatccagacttattctctctgtgaaataggttctagcatctatcaccatttcagtaaagggcaaatgaaagaattgtaaacacaccctcacattctaagtcttccatccactgagcaacaggaatttcttaatttatactccatatggtggccaaggactgatttattattatgtgagtaattcacaccaggtattcatgaccaggtaaatctacactcctcataattctgtggtttccctgttgtttgaaatagtctgtaaagttgtttattcttccctgtgtccttcgttttgtgcttttttttattcaattacttattacttatctatcctatttttctttcccctcccaccccaaactctgacaactactgacctgttcatcattcctgcagtttctccttttctagaatgtcaaataaatacaatcttaaaatatgtaacctttgagactggcttctgttacagcacaatgcatttgcaattcatctatgttgttgtgtgtgtcagtagttgattacattttattgttcagtaatactcccttgtttgtataggctaagtttgtctattccatcacctatgcatttgaattaatgccagtttgagttatcctggcataaacattcttatatagattttggggtgaaagtaacttttcatttctctaaaataaacatgtagaaatgggattgttgagtcagatggtaattacatgtttaactttttaagaaacagactgccttagattctttagtgttgctgtaatagcatatcatagactgggtaattttaaagagggtaaatttatttcttatagtactggagactggaaagtccaagatcaaatggcacacatctggataaggccttcttactgcaccatttcatggatgggagcagaaaggcaagaaaacatagaagtggggtcacttttttgtctggtagctttacttttaaatttttgaagaacctccatctgtttgtattagttcattttgtgttgctgtaaaggaatacctgaggctaggaaatgtataaagaaaagaattttatttggctcatagttctgcatgtgctgtacaatcatggcaccagtatctgcttggcttctggtgaggcctcaggaagcttttactcatagcagaagggaagggatccagcatgtcacatggtgaagaagggagcaagcaagagagagaaagtgccaagctcttttaaacaaccagctctcgcacgagctaacagagtaaggacttacttattcctgtgaagacaacaccaagtcattcgtgaaggatccatgtctatgacccaaacatctcgcattaggcctacctgcaacattggaggtcacatttcaacagaatatcagtgttttcacaatgcctatattactgctgagttttaggagttctttctgtatatctttctggatacaagtttttcattgatgttatgcttgataaagcaaacaaggtctgagggcaaagactagagtaaatacctaatgccttgatgcacagacattgatgaatgttcacaagcatcaagaatatgaaaggcattatgacttcatgaaacaaactaaataaggtgccagtgactaactttaaatagagggatatgtgtgacctctcagacagataattcaaaattactgctttgaggaactcaaccgactttaggaaaatacagagaaggaattcaaaattttatcagagaaacttgacaaagaggttgaaaaaaatcaaatggaagtcctggagctgaagatgcatttgaggttctcaacagcaaaattgatcaagcagaagaaaaaacatcagtgagctcaaagacagctatttagaaatatcaaaaagtcagagaaaaaaaaaagaatgaaattctatggccaggtgcagtggctcatgcctgtaatcccagcactttgggagactgagagcggaggatcacttgagctcaggagttcaagaacaactggggcaacgtggcaaaaacccatctctacaaaaaatacaaaaggtagccagacatggagatgcacacctgtagtcacagctactcaggaggcttaggcaggagaatcacttgggcttggaagatcaaggccacagtgagttatgatcgagccactgcactccagcatgggtaactaagcaaatatcctgtctcacaacaacaacaacaacaaaggaatggaatcctgtcattcacaatgtggatggaactggaggacattaagtgaaataaactatgaacagaaagttaaacaccacatgtgatatggtttggctctgtgtcaccacccaaatttcatctcgaactgtaatccccacatgttgagggagggacctggtgggaagtgattggatcataggggtggtttcactcatgctgttcttgtgatagtgagttctcatgagttctgatgatttaaaagtgtttggcagttcctctcctctctcttgcctgctgccatgtaagatgtgccttgcttcccttttgcctcctgccatgattgtaagtttcctgaggtctccccagccatgt

SEQ ID NO: 4641 - DNA, 5061 bp, Homo sapiens
cgagacttttattctcctcatgcatttcatgggtctcacccaatcacgtgaggaacacccagtgttccagtgcagtgccctgagaagaggaggagggcaggagggagcgtgggcatcaagttctcaggtccaatgcccttatttgctaaccagctttgtgaccttgggcaagacacttccctgccaggggcctcacttctattctgttaaattaaaaagctggactcattcagggatttccagatgttgagatgccagtgataacaggaacttccaggggtgatcattttttactatggccaaataaaattattaaagaaaaaacgcttagcatctaaaataactataatttcattataagaaaactttagtaccaaataaaaatacataaaaatgagaaaacacaacataaattttataaccttaaatgggaaaaaaacccttagttttataaaaacttatctcatcattcttcttgttctcatttctctagagacctttgaaaatgctacagagcagcatttgggaactctggggatggctctcagggcctcttgtgctctgacatcctgggactctctggttcattcagctgtcagctcacaccagatgctaatggtgccaggcataacccgggagatggagcttgtagtgagcccccatcgcgccactgcactccaacctgggcgacagagtgagacactgtctcaaaaaaaaaaaaaaaagagtttttgcagagtgtaacctccagactcccactctctcctccagttccccaaaggtaactgtcttggaggttggtgggtggggctgaaagttccagtcctctagtcactgttcttctggtgagcatccccattctgaagctaactaggggccccacccgaggtcacctcattagagtaaacacagatgtcattggaaggggtttgttatgaatatcaaagatactcctatcactcaggaaaattccaaggggtttaggagctctgtaccaggaacctgggacaaagaccaaatatagttatttttatacaacaagttcccactcctaacattgtgtgaccccgtttcagtgacttaggcccactgagattcaatttcttcatcagacaaatggtgccaacaatctcagggggttgcgctgatgactggtgaaatatggcacgtcaagtaatctggcacacctgggagtctgaggctgcacttgaccccttccccccctggggtccatctgtgacagaggctgctggcttgtcccaggcacatttggtcaccctgtctcttgctgtgcatgcaaggcaggccaggtacccaccatggctgcaatgatagggaattcttagaaaaatttcagaaggttgttgtgtgttggttatttctccttgctttcagcagagacctgagtgacatgcatgcaggcatgagctaacctgtctgccagcagtgctgggagaggcagccttgcccagcaaggggtcctcacctacagacttcagtccaagtctggagccctgcatgacataaaaaaccaaatgtttcattacgcccaactgaagttaccattagtggcttcaaagctacagcctcagcaggagataagattgatgctgggtgccatattgttttaaggtatccctcattaaatttagggagtggggtggagagagttcagaagccagcaagtaaaaacgagaatttcatacttaacatcatgtctagaaaataactttggctgggattaattcattgcacatggaactgactagaaatccatctaagtttttgagaggattgaattatcaaaaaaacccattagcctagactgaaaaacctatgaaagcaatctctggttcccaaatctgcatcagcaggaagcaggcagcaaaagatctgtagctctgtcaaatggggcttggatgtggtcatggaggaccaggagggtaaagccagagggtatgcgggacaatgaactgggtagttcatcccagacagtggacccagggcaaccaagggatgatacctccaaggcagacagagtctttgcaatacctcccagtagaatttgatagtggccagagaagtggctcttgttggtgctttgcattcccttttcctaatgtttgtatttgtttcaccattgcatatcaggtatgtgagaggacggattgcttattctttagtttataagtagctagatgacaaagatccacattcagacttgaaggagaggcctgtacatcaccccagatataactactgggcccttgtggtggtcttctttgctttaggactgaatgtgctatgtgtgaggaaaggatacacttggatatttttgtagtgaaagggatagactacatcacaaactgtatttatcccctgatttctgctctccattttttcccatagtaatagaacttggcttcccagataaggactatatctcccagcttcccacgcaaccaggtgtggccaggaaaccaagctccggcaaccactacagtgtttgttggcttacaggactcttcctggagagacagctgttttaagtcttttgaactttctttctccccttaccttctgttttccaggatgtagatgtgatggttaaagatgcagctgccatcttggattatgaagtaaccatggatatggaagacacatatgatgaaacaaggtagaagcagcctgggtccttgatgttacggccaacttacctctagacttctttgaagcagagaaataggcttgcttaagctacaggtactttgtgtattttgtaatgtgcagttgaacctaactctaagtaacaccaaaacaattaagaaataaggcaggattagattgtagtcagcataccaactttttttttgagacaaaggcttgctctgtagcccaggctggagtgcagtggcatgatcttggctcactgcaacctccgtcccccacgttcaagcgattcttctgcctcagcctcctgagtagctgggattacaggtgcccgccaccgtgcccagctaatttttttgtatttttagtagagacagggtttcaccatattgacccagcctggagtgaagtggggcaatctcggctcactgcaacttctgcctcccaggttcaagcaattctcctgcctcagcctcccaagtaactgggattacaggcacatttttgtatttttagtagagacagggtttcactatgttggccaggctggtcccgaactcttggcctcaggtgatccacccacctcggcctcccaaagtgctaggattacaagcacgagccaccacacccagcctgaatacagtatttttaaaaatcaaaattaacagaaataatccacaatgaataaaatacaaacattttcaatgaagacaggatctgtaactgtgccctgtggagtcatattggagcaaaaggaaaatcaatgatactgaccctgcaggctacttgcattagctcactgtcctcctaacttctgggctaaacaacccagctaaagcccactagaggggggctgctccccaacctttgctagccccctcctgctggcaactgctgatcctgggaccagtgatgggcaggtccacctttgccctcaaatggttctgaactaggtcattgcagtcctttaaataaattaaccaaaaccataataataacaacagaaacatttattaagagctaagcgttttacaaatattaattcacttaatactcacatcaatcttataaagtaagtgctcttgttatttccttttacaggtgaccaaactgaggcatgggggtttaataagcttacccaaaactacacagcaaggaggaggctgtgtcgggaatcaaactcagtcactgtggcccccaagtccatgctcataaccaccaggtaaaaaatgtgcctcctattctaatttctgtctgacagtgggcccagtcatggtttcaatacagctcagcagagcaatgcagcaaatccaggtggcaacactaaaatactcagaaaagaccaaccaagcaaccaaagcataacatcagcaatagcacaaccaatgtgaatcatgagaaccctctgtctttattaaatttgggggaagaaatcaaggtcacgaaatcaagtgactggtgatggggcctagaaatgagtgtctccccccacccccggtttccgctctggcaggcgggtgttagcggatggtgtacttgtcccacttcttctcggggtcataggcctcccagcggctggcggggaagatgtgcttgttcttctcgtaccagctgcgcagcaccaccttgcccgcgtgcgactcgtccttctccatggtggcgtcgctgagcaggcgcacgtcatcgtgcacatcgaagctgaagagcggcccgctcttgcccctcgccctggcgatgatgaagtcgtagaaggtgtggtagtgcggcaggatgaggtcctccttgatgaacatgagctgctccacgccggcggagcgcagctccaggaagtccttgcgcagcccctgcagcgccttcttcaggaactgctgcaccgtgttgcccttgcgcacccgcaccgtgcgccggtggcccgagccgtcccagtagctgaaggtgacctccatctcctcgtccttcactttctcgcgctgcgcctcccactcttggcgcagctcctctcggagccggttctcctcctcctcgcggtcgcggtctggcaggaagctggtgtccacgtcggggttcttgcccaggtttccggcgcgcctggcctcggccgcgtcggcctggtcatcgaggtcgtctagtgcaaaggacaggcaggagatcttacgcttgcgctcgcgccgctgctcctgctcccgctgccgctcctgctgcagccgctgctcctccaggtgctggcgcttggccagctgccgctcgcgctccctgaccagggcctcctgccgggccttcatgtcgttcagggtcaccaggcccaccgtgctggacttcagctcggcctccacggcgtcgtaatgcgccgagaacctcttgtccacctgcgacttgaggatggtctcctcg

SEQ ID NO: 4642 - DNA, 5250 bp, Homo sapiens
aaggttgcaaaatggcgaggggggaggtaagctgtctttgcttggccatcttgggctagcaggccttgcagagaactacctttttagctgagtgaagggatcaacctgagttggagttctcctatgctgtggccagatccactagaaattaacccagaatcttagcctctcagtggcctatcggtaagtgggtacaaaaatgaggaggcgatgatgactctgcaaaaggttgcggcagctggcggtgcgtaggaaatgcgtaaaaagggagcacttggagacaggccacatttgggcagtacgcattcggagggctctctggctttccgatcttgggtcgctgtacttggctctgaatacagtcaccccatcagagtagcaaaacactgtggttgtagtgtgagaatccaatgttaatgttggccgaaagctcttgattttcttccctgagaacataggcgtgaggatttggatgtgtttccaaatgcttgttactctttgccgtaaacctggaatttggacctatggctgcctgggactcatactgtcgtggagaaagattgaaaagtagttaatggcagtggtggtatgaaggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacacagttgtgttcatccattattgtcgatggcagctttcatgctacagcagagttgagtagttgggagagaaaccaaatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacttcccctctctggcttttttgcatatttctgcagatgtcttgacctttctggggagtaagcccccttagaagattaattttctgtagttctctattgaggaaatacatgacatttagctttttaataatttgatgccattcattgagtacctactgtgtgctttatgtaccctgtctcgttgaatttttacaaaaaactgaaagagttagttttgtgttattactacctccatctcaaagatgagtcttggaaagcttaagtaactttaggtcacattgtaatcagtggcagaactgggacttaagaacataattcatgactgcattttcttttctttctttctctttctttctctctctctcttttttttttttttttaaagagatagcatctcactcactatgttgcccagactggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaacccttcttctctgggcaggtgtggtggctcctacattatcccagcaccttgggaggccgagatgggaggattgtgtgagcccaggagtttgagaccagcctgggtaacatagcaagaccctgtctccacaaaaaaataaaaaattaactgggcacggtggtgctcacgcctgtaatcccagcacctggggaggccgaggcgggtggatcacgaggtcaagagatcgagaccatcctggccaacatggtgaaaccccgtctgtactaaaaatacaaaaattagccaggcgtgatagcaggcgcctgtagttccagctatgggaggctgaggcaggagaatcagatgaacctgggagacggaggttgcagtgagctgagatcacgccactgcactccagcctggtgacagagtgacactccgtctcaaaaaaaaaaagaaacgatcacatccagatgtcctgttactggaagggcaccatagtttatcctgcacctaacactaatacacctactctgggaattcttctacctacaactatttatttatctgatcccatctggtattaaagttctaaaagttaacagaattcttaaaggttcccaatgcctcccagaaaccccatcatctcaaaatcactagctattaaaagaagcaaaaaaaaaaaaaaaaaaaggtggctcctgacctagtctctttgagtatgaagacctatttactatgtaaagctgtcacctgccttgaaaagattaagacagcaagaaagttcttagaaagtgggtatgtggctggcctcagataaggataaattgctgagaagaaggagttgggttttttttgtgtttttttgtttcttgtttttgagacagggtcttgctctatctcccaggctggagtgcaatggtgcgatcacagctcactgcagcctcaacctcccagactcaaataatcctccctcctcagcctcccaagtagctaggactacaggatgcaccaccgtgcccattgtttctatatcagggtcttataatatggcagacacaatggcctcccacagagaaatgagccataaaaggaccctgtaaaagcaaggatggctcattgttttaagacagccaaatgtatggcacttggagaatttcaaagagtagaaggccttcttgattgcactcccctttaacagccttgcctcttatggggctatgtggatcgttgaaatggttcacaagtaaagtgaaaaatggttatgcgtagtgtgtcagccccaccctaagctcccagagcctccattctgagtacaaaggtcagttttcttctcgggacaggccaaggatgatggggttttaatttctctcctgatccatggcaaagcattcctaaactaggcactggaagtcttggtaactggaaagagacattcaccaagatgaggaaggccaaaaccaagtgccttatatagtccctagaaagcatttcattttatggaacaatctttggtctctctttttttttttttttttgtgagacagtgactcaggctggagtacagtgattaggtcactgctcattgcagcctcaacttcccgtgctcaggtgatcctctcacctcaacttcccgagtagttgggactgcaagcaagcgccaccatgcccagctaattttttgtatttttttgtagagacggggttttcccatgttgcccaggctggtctcaaacttctggactcaagcaatccacctgccttcgcctcccaaagtgctgggattacaggtgtaagctaccatgcccagctctggtctcctttcttaatcctgttgaataaggaagattttttttatctgaaccctcctcttactcttctttctgttctccttccatgatcactttgtccatcttcctctttgtcataggcatgtcctatttctaattccctttctcttttctttggtaggctagccttcgagactgcattaccctccccaacttaaaatcttttgataacccaggcagctgggttatccccaatttaaagtctttttgttgtagctgtatggcatttatctagagcatggggtacacacagtaggtttctctcctctcttttttaacatatttattatgtttatgcatgtaaagagtttgttgttggccaggcctgatggctcacgcctctaatcccagcactttgggaggctgaggcgggaggtcaggagttcgagagcagcctggccaacgtgatgaaaccctgtctctactaaaaatacaaaaattagtggaacagggtggctcatgcctgtaattgcagctactcaggaggctgaagtaggagaatcacttgagcctgggagctgagatcgtgccattacactccagtctgggtgacagagggaaactctgtttcaaaatcaacaacaacaaaaaaaagtttaaaaattggaaaccaccaaaaggtagtattaaaagggaaataaaaattactcataatcccagaacgcagtcatatgctatttttagtcttattttattcagccatttttctctttacacaaacttttttttttttttttgagatggagtctcactctgttgcctgagctggagtgcagtggtgcgatctcggctcactgcaacctccgcctcttgggttcaagcgattct

SEQ ID NO: 4643 - DNA, 6151 bp, Homo sapiens
gccggccccggttccagtaccaggcgcggagcgatggtgacaaggaggacgtattgccatcagagagtcagcaaaggtagttgaccaagcccaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatggccatccaggacatgtgcaagccagcgacactatgggcagctctgggagccagtttatataccaactcctgatggtacgtccagcctgctgcccaggaaggaagccagtgctggcacctggaaggcgcctggcgtgtatgggagcaccaagagcatggggagatgcactgcagcaggcagcacagacctacagtctgttatcacagtctcgctctctgtaataagcaggttaataaggactctggtcatctgccctcatcttccagtgctacaagtcaagcaaaactgtggtgcctgccagctgatttcattcccggaagcccaaagctttaccagcaggtcacttccagcacacagataaggagattagccacgcctctcacttcacctccagctcctcactgttccagaattaccaactatcctatttctgttcaaagcagccaaaattaactgagggctgctctttgagggcttctgcagggagcgtggaccctatggccagcaggagcagcacctccctccctccctccctccactaaaaacctgtggcgtccctgttacagaatggaatgtgctagatctctcagggatgctgaggtacgaaacagttcgggaagacagaaccagaagacggttcgggaagcctgggatcagagtggagaacgacagagctcttcagcatggtcctttggtttccgaagcagtgcctggcacctcatgatggctcaatgctcgtcattcattgccactatgaaatattcctgaagggcgtttcctccaggctgtggtactgtctggagaattatcgtggctccctgctcaagcctatgactctagggccaccatctctgacctcggcaccatccacccccagcaatgcgcagattggacgagggctcgctagagacttcatcctgcacgcaggcgctgccctctgttggccatactctttgtgtgcagcttaacttttcttggttacctttacttttttttctcagtggctttgtcctctgtctcagcgtggcctccaaggccacttcctgctctgccacttggtatggttcagggctgccctgctctcagtcacggcccatttttagagcttttttgcatcgtgtaggtccgtgagcatctgtgtcagaggctgatatttactgatgtgcctcccacattggggatggtgttgggggcacgggtggggtttgaaactgataactctaacagaagttgggtacatagtgactgtgtccaaacccctgcaccaagagactggaccaaccctagcatggcttctggcagcccaaagcggcatccctgggaccacctggccaccctttgagttcctgtctgaaaaagctcaaggccgtcaaaatcatttagtgtttgttcctaccaacacctgacaacaggcctctgaccaccccctcactttcttagagcatttacgttaaaaacacttagagtcgtacctccttcccttgtccctttgagatgtacatgcatgtgtgtccaggagtgtctttctcaagagcctgagagccagtcctttgaaatggcatcatcaggaaggatggggcctgtctcccaggctctgggggaggccagaacctaacttccatcactgccagctggcacacacagctggcccggccacaataacacagacagccctttgtaatttttcactcccatgattcctgagccctggaatgccctttcccgactcctacgttctcccattaaactgtccagtccccctgcacagatctgaatggagctcagcttctcccctgtcagtggttaatgaataaggtctgttttcgtagctttaactaaggtccagcttagtttatctttgacagacctacttaccctgcaggttcccacctcgggcctggagggaaagcctctgggaggaacacggtcctcaccaaagggtgggagaccagatcgtgccagggagtggagtggacatgagctctgggaccctctcctctctcccggaatggctgcacaggaaggaaggatggaagatgtgagaaaggccaccctgcctgggaaggagctaccagccctcagcagtccagaggctgcccagagagcagcgagcagctctccaggactccacctcccaggcccagaggatgccacccagggggctcagtgagaattcagccacagccacacacatcccgggagagtgtctaaagatgccaccaatccaatatcacagaaggcaagaacccaaagagcagaagccgagacaaggaagtagccattttggatacatgccccccaccccaatcctgggccaacgtggatcttcagcatcctgaacctgaagcccccatggtgggcctgtggcgggctgggtgtggcttcagaggtgcagcggcaggaactggcagagtggttcccccaggcccagggctgacccacagcgacatgggaaaatgggcccagtaggtccctccttgtttagctccctttggtctttccaggtccagcttcactgggtccacggggtccccatcctgaggtcactgtgtttctcaccccccacctgcccactcgctcccagcccactgcagtctgactttactgcccatcaccaaagatgccagctgaccttgacttcttgggggtagaggacaatgggggtctgtgttacctcaaccactctctcctgttgaacctctcatcctcctgagtgacactcacctggttgtcttccggctacctgcaacctcccggcatcctccacaggccaccttcacccacccaccccgtgaactcacactccttggggttctcttctgggtttttctcactctgaaccccctgagcaacctgcacccctcagggatcaccggttatttatgccgatggctccaactctgcctcctgcagcctcatcttcctcctgaccatccgccccaccgcccagccagccactacctacacttccacggggtgccctggacacacacgactcaccaggaaacaaaggaacacctcagctcccacagccactctcagacctgcccctgctgcactccccaccacgggcagcctcggtctctatgggtcacagccaagcagctcccccctcgcttctctgtcctcaccacttccaccaggggccctaataaagatgtcaaaccagcctgccgtccactgtgcagcttgtagagatagataatgctagaaatccagttggccatgtcacggccctgctttaaatccctttcacggctcccatggcccttgggatccatccaagctcctcagctggctttccgccctcagtgctctggtgcctccattgtgcgtcttccagtcccgccccaccctcctgtccctccagggaagttctttcagctctgccctgggctacaggctgggctggagggctgggctccctctgcccacttccccactggacctgcagcgagatgtgctggcagatcccagccctaggctatttcatgaaggaggctttgaagcctctggcgacctgcttcactgcaggagtcctgcactgtgtcctctggggcccagacgagtggtgctcaaagctgcacttgaacaagtcctcggtcttcctgccaggcctggttctccgccgaatccgggcagtcagcagggggccggattttcctccagatctcaggaaagtagtcctggatatctgtgttcataactgcagctcccagaatccttccctgctcccctccccagacccacccactggagaaacaagaatcaggtgggcggggcaggggacctgcacacaggcagaggccagggctttgtcaccaaacagtaatcttttcatcaccattatttattatatatgaaccaggttttcagcacaagtcacactcaacacccttacccaacaggaggggcgacggaggctcagagagggagtgtagggggaggatgtcaatgggaggccccagcctgagccctgagcagctggccagccaggaactggcatgtgagtgagaggcatcctattctcctgctgctccaaagacaatgcccgctgaacaggatggcaggccacatcagcagtccatacagaagtgaggctgtcgtttcttcccctggagcaccagtgaggacaggccccagctgggagccaggcaaggtgggtgagctctgtgctaaccacactgggagctcgggtaagcgtgagggcaaggctggagaggtccgggacccctgcgtgttgcttcccactcctgccaggctggcacgcccccattcttcaccatccctagcacagagcccagggccagggggcagagggcggggctggctcaggagcagggctggcccgtcccatagcgccactcacattgccccttcccctctctcatcccagctctggtcacttagatgctgccatgagaggctctgaaatccacccccactgcagccaaaagcccaagtcagagccaaacctgcactgtgctcggactgacaggctggggtcgggggagggaagacatccactgagggaggtccaggtggcaggaggcggaacaggatactctgaggagacacagcaaagggtgccaacatctaggactgaggccatctggacccacatgactatgttgctttttgtgtgtgaatgtttctctgcttcaacattttcagaaatttcacatctagacgtgtcagaaaattaacaattccatgccagagaaaaggccttgcctataacccaatagaggcccccccagttcccagcaggatggtggcagagctgctgactgggcactgactcccccgcctgggccggagcaccctctccatgaggacacgtgtcctcctcaggatgggctgagtcctggcatctgccccgtctgtaaagggaaagaccccacccataccagctccccagcagcatctccttgggaaagagggcaaactccagagcagtgcgggtattggagcaggacatcccctcggccgctgctgtgcccagggctccccagggcccgggctggctgggaagactgggaagacttccaggaaccaggcaggccctgcgggtccgggtctctgggtgccagcaggagggagctggtgaccagacatagttgtgtgggggagggtccggacgaaggggttgtcagggacagtggagccacagtcattccgagagctgggcacctgaaaagcacatcacatggaagggtcccggccttgcagtggagactccactgcccccaaccctccctggaaagccccctcacccctgcccagatagtcctcagcttaccctttccctccctccgtccaggttagggcccaggttagggtcttgccttggggtgaagcgctgtgaggatgggggaggggggtgctgggagcatggttcccatttcatccctggcggccaacacaggccaggcaggaagggagttgatgttcagtcccctccccaccttttcttttcatgaaataaatagatgcctgaatcccaacaagaactctaaccaaatgaaatcaaaaccaaacccagaagtgccataccaaccccatgtgcctgccggagtgtggatggctccctgggcccttcgtcaccctgggaacacaggccctgccatctgctgggttggccgcatccaaaataatatgaccgaggcctgccctgggtgtgggaaagccttgtctttcccctcttccccacccacacccctcgcccacacagtacctgggtcgggggcggcgggtcactcccacaggaagcgcacgtaccagatggtctcattcttcagctggggcccgaacagggggttcagctgcgccaggatggcgatgagccagctgccagggacagca

SEQ ID NO: 4644 - DNA, 2083 bp, Homo sapiens
agaacatatctatgagtgatttctgatagggaaacatgttgaccttgtcccaaatacctagtgctttcaaaaaatagtaacatgtctaacagtctatacaaattcttctctcttgtcaggtagaagtgagagcaagagtcgtaacagcaaacacccttctgacctctgaaatgcttcaaactttagattacaaagattttgttgtcacggaccgggacacagctgggggtgttggaaaccacacccacttctgcctgagggaaagacaggatagtagctaggtgaccactagataccctctctcagagttgaagggtccttaagcctgagaggtcattattgtcatcatctgtgccctgtaatgaggtgttagtaggggtgatatgtatttcttctggactgggaatttaactgctggtttatgttcttccagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaaacccacactttcccattttgtgcctcccttcctagagttttagccaaaggtttagctaagtaattggttttaccagcgcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggc

SEQ ID NO: 4645 - DNA, 864 bp, Homo sapiens
ctcaagttgaagggcatcggccacagcagaacagttccccacggctgatgggcactcacaggcaggcaggagggagcggttccgcacgacttcccggccccctcagtgcccattttacatctgaggctggcagaccagaagggccacgggattttgagccccagcctgaggccgggaagagggagctggggcaaacagagagcccaaaggcgggtccgattttgaagagtcaatttcctttgaagaggcatcacccacccggaggtggcatcacctgcccaggaagtatcacctgtgcctagaggaggcatcacccgcctagaggaggtatcaccacccagaggaggcatcacccacctagaggaggtatcaccacccagaggaggcatcacccacccaggaggtggcatcacccgtgcccagaggaggcatcacgcacccagaggaggcatcacccgcccaggaggtggcatcacctgtgcccagaggaggcattgccgccagcccaggaggcatcacgcacccagaggaggcatcacccgcccaggaggtggcatcacctgtgccagaggaggcatcactaccagcccaagaggcatcaccacccacctaggaggcatcacccccgagaggaggcatcacctgtgcccaggaggcatcacccgcccagaggaggcgccccaagttggcagggtggtgggggctgggcctctcagtaaatggtccagagcttcccctggcagatcaactgtttcttggggacttaaagaagaattggggtactgggactcccacttagtgaccccggagcctgaggtggcccacggaggagtgcccaagccctcagcagccagaccagctcca

SEQ ID NO: 4646 - DNA, 571 bp, Homo sapiens
gagttaattctaagatggaaacaatatgaagcatacgtacaagctttggagggcaagtatacagatcttaaactctaatgatgtaactggcctaagagagtctgaagaaaaactaaagcaacaacagcaagagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagacgcctgatggcatcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatga

SEQ ID NO: 4647 - DNA, 17053 bp, Homo sapiens
gcggcggcggcggccgcggcggcggcggcggcggcggcaagtgcacggggtacgcccgtcccgctccgcaggggcagagggggaggggatgaagctgcccggcgccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatataggtgagcttgggcatgccagtattgggtgcacgaacaaggacagcagggcttgggaacgaactccctcccgtcaccctccgaaagcgatacaccttctccccctcccaaacaaccccagtcccgtctccccgttcctctccccctcctcccccagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgggaattcctttatatggcggtgattaaacgagggagggacagacagtgatctcgaagaaaaaagggggagaccaaagaataaaagaagggtttccccactaaaatgacacggcgattccggctcttgttttgggggtctttccccgaaatggtttccgtcttccccttgccccgcagcgacccagagcgctgggggaagcggagtggggagaggcagaggcggtctcggcagccaatcagcgcctgatgtgtcctgtcgggcgcgtcgtggttggctggcgatgacctcatcctgcagcagcgggtggggccaaagccgtagggggaggctgttgcaaaggtagagagggagaagtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctctttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgattcctgttctttatttcagttttctgtctgtacatcccttaagaatatagttttgtcggtgggattcgctcttttgtgcccaggctggagtgcagaggcgagatctcggcccactgcaacctccgcctccccgggttcaggcgagtctcctgcctcagcctcccaggtagctgggattacaggcgcccacaaccacaccctgctaattttttctatttttagtagagacggggtttcaccccattgaccaggctggtctcgaactctcgagatccgcccgtctcagcttcccaaagtgctgggattataggcatgagccaccgcgccgggcctgctttttttttttttttttttttttgcactgggcattagtaatacggaataaaagccgtgttttaaactgtattaagttgtaagacttttcagtactttcaagtctgctttctttctgttgcccttttgtagtttttaaaaataaaagatgcaattataagcacttccggtgaatattattccttaaggttcctgcatcatcatgaaatttgaagcacttttatagtagtacaaactatacttttagcttttgaaatctcgataggagaaaatatccagcagttttaggggctattttggcatattcattaaggtagactaagtttgtttttcgtttttcccacttagccaaactagttaaagtagtcaaaactagcaaataatttttaaagggcttctccttttgggtggtgtagagggtggggagttattcaacaaacacatttgcagccaaaatctggcctacttcttggcagagcgcttatacttggtgctacgagaaaatgattgctggacctgaaaagaacctgaggtcaaggttgtgctatttccttaagtcttagttgtaggctcttggtagtttgaaaacaagattgggtttttaattcatttgtgtatccttaaatcctcactagtttttgtggatttcttttttcagttataagcaactgaatgtggatgagctataaatatttagtacaaagaatgtaatttgtccactctgaatagaaagtaagcattaagaactcttgaatgtcttcaagggttactttgttacgtgtaagatgtctccccttccttcatagcagtttttattcctgcttaaaaagggaactaaatatgaagtcagtagattttaaggtaattttcagaatgtttctactttcaccgtgccttaataaggaaaaaaggccattttccaagcgaatggaaacaccctttccttgttttgtgcctttaatcagcgtgtaccttcattgttcctgattgccaaatccacgaacttcttgagctctcaatttttcttgactttcctatggcattttaaatactgttcatacttggaattacttttctttgactgccttcatacattcatatattctgcctgggcaatttcatttgggcctattatgttccaatacctctccaattttcacctccatcttagctctgccagcttcagtgccacaggtaggcaatgtaaaagtttactggggaccacaggctttctgagctcaataaaaatactaagcttggtacttgttttttaagaattttcttcccccatcccctcacaaagattatttgagtaaattacaccccaacctccttttccttgtttttgttgaaattattgtctcttaactttggaacattgcagttgcggtaagcttactaggttcacatagcatatcttctggtgtgttaaaattaaaatgcacaccatctcaaaagtgctatgccatttcatacctttgtgcttttgtcctgctacctggagtgcgtctttctcacttctggataatacaatttgaaccttttctttgcctcttgaaactgcaaaatccctactcgcaagtaaatgtgtcattctttatgttgataacccagcctagtgcttgacacttgatgggcattcaggtatacatggttttttagagattgataagattaactgtgcagtctataaactgtaaatactggcttttaaactcttttaaaggagctcttttgataaacaatttggataagagatgaaaggttagggaggctccaggcaaggcagaagactgctgatggcccagagatagttctgccccaaaaaggtgggaagaagaaaaaaactgagctggatatttttaaggaaatatattttatagcatttttctttaatgcctagttttgctgcaagcactgaagtttatcctgcatttgtatttcttatttgaaaaagaaatggcctttggggtttgttttgttttttgttcctttgtaagcacactgcaaaagcggcgttgtcagcgttgtcttttgaggtatcaaacgtgctttcagtcagcaaatatcttgtatatagtaccattcctaataaactaaattggttatcaacctaatacaaacggtacttcatacaacttaagcctaaactagattagattatgtagaaacttattcttagagaatatatcgccttaatatttcttatcctgaaaagagtatttcttaagtgcccctctcaaagtatatcgattaatatttgtctcaaatttaaaactatatcctggtttttcccttacagttgtttagcaagtaaatgtttacttactaatttattttctcccagacttcattctaccagtttaagcttagctcagttttgttttttggttttgagaaggagctttgctctgtcactcaggctggagtgcagtggtacgttctcagctcactgcagcctccggctcctgggttcaagcgattctcctgcttcagtccgtgagtagctggaactacaggcgcacaccaccacgcccagctaatttttgtatttttagtagagacagggtttcaccatgttggccgggctggtcttgaactcctgacctcaggtgatctgcctgcctcagcctcccaaagtgctgggattataggcgtgagccaccgtgcccatcctaaacttagctcagttttaatgctacttccatttctttatgtatagtttgatgtaagaataacagttggaagtaaggatttaggaataacaagagtttgggatttttgtttttttaattagcaaggtaatgccacatcaggtcattagtgacattaatgagagaacaggggaattattggaaagtcttgacttaaggccagacgagaaatccttaactgctagtgtgacttccctccccacaaaagagaatgctctcgtaatacaccgaactgttggatgctgttgtatatactttatatataatcttacccaaggtggcagagcattaactttaacatctgtctccctgacctcaccagagttcataatctttgccctacttacactgtctgaaggatgacttggcctttttttttttttttttttttttaattgagacagagtcttgcacagttgcccaggctggagtgcagtggcacgatctcggctcacggcagcctccacctcctgggttcaagtgattctcctgcatcaccctccccagtagctgggattacagacgcttgtcaccgcgcctggctaatttttgtatttcggggtttcgccatgttggccaggctggtctcgaactccccacctcaggtgatccgcccatcttggcctcccaaagtgctgagattacaggcatgaggtgtggcacaggacagagaaagacttactttaaaacatacctgtcttcaacccagaagagactggcttttagagccctcaatgtagcaagaagagcctgaatcagagcaggagtgataaagaaggaatctaagttattacagaaacatccgtaattgttgcctgggtgggtataaggaagaagaaggaattgactttcaagaaaaataattgacatttgatagtcttcacagataaaagccaaaacagggtagattcagtcttaataggagacaaatttagcaagaaagctgagatcttgggtcggtctacattttaggccaaggaaaaggaactgattgcatttgttttttaagatagattatacgccagtgcataacatatttaacctaagtctgattagctttataataatttttaaattattcataactatcctaagcaataccttttattgttagattattatgtaatgcccacaaatgatagatagcatttgaaagtaattgctggctgattataggcatggtggcttatgcctataatcccagcactttgggaggccagggttggtggatcacatgaggccaggagttcaagaccagcctggccaacgtggcaaaactctgtctctactaaaaatacaaaataattagctgggcgtagtggtgcacatctgtaatccagctactcaggaggctgaggcatgagaattgcttgaattggggaggtggaggttgcagtgagctgagatcgcaccactgcattccaacctgggggacagagtgagaccctgtctcaaaaaaaaaaaaaaaaaaggaattgcaagtagcctgtaatcccagcacttttaggagtccgaggcaggaggatcacttgagaccaagctgggcaacatgatgaaacccctgtctctacaaataatttttttaaaatattagccaggtgtctggcacacgcctgtagtcccatttacttaggaggcttaggtgggaggatcaccacttgaggccaagagatcaagatcagcctgggcaacatagcaagacccccacctataggaaaataaatccgagcgttccaagtgttcagctattcacccactttaggtttccaccttccttagaaagtagagtagtataaattatttctgaaatttgtgaaacgatgtaccacataaccctctcaaaccaggttgctactacttccaatgacttcattgataaggggcaaagtaactcgaatgatgggtgagctcatgacatggtttagctccgtatcaaactctggatttgggaaaattgctactgatttattaaacacttgaattcttatatgctaggtcagaatttggcaactaaactctcagaaatttgtaaacttcctttttacatagaaaagtgaatccaggctgggtatggtggcacgtgcctgtaatcccagctgctcaggaggctgaggcatgataattgcttgaacctgggaggtggaggttgcagtgagcccaagattacactgctgtactccagcctgggcaacagagggaggctctgtctcaaaaaaaaaaaaaaaaaaaaaaaaagtgaatatactgtactgtaaagcctgtgcacctcttcatcacacataattgcctgtacattatgcccagtgcctggcccctattggatttctgacaagctttaatgttgttaggttaagagagaacctgttcctcaagtttagtcttatctctagtatttaaatttttcatgaaggaaggctgtgctaaggcgatacttcattcctgaagaacacttacttaaataagtaatgttcaattaattttcctcattctatgaaaaacttgaaaaggcaacaaaaatattcactattctctggttcatttgataacaatattgtggtagtctaggcatctctcccatgtcccaagcacagcttatctgaccacatctatacaacagacattctgtagcgactctctttgttctattccatgctcctactttatggccagtgaaagggcaaatggaagtcaaaagggtaagaggacacgttagatagctttgattgaagcattcttttagaagttaaatgactgaaaaaggttttacaaatgacatcgagtcaagggttcatctgaaagtatctaaaagttaactagttccctttctccacaaactctgcccatgtaggtaagttttatttttctgaggaataagaaacatatgcagttatttgcatttataatattttgtgaaagttctgtattttcttgttttttttgagacggagtctctgtcacccaggctggagtgcagtggtgcaatctcagctcactgcacactctgcctcctgggttcacaccattctgctgcttcagcctcccgagtagctcggactacaggcgcctgccaccatgcccggctaattttttgtatttttagtagagatggggtttcaccgtgttagccaggatggtctcgatctcctgaccttgtgatctgcccgcctcggcctcccaaagtgctgggattacaggcgtgaaccaccgcgcccggccaaaagttctgtatttttatgagctccaggtggtcttatataacccatagcatttgattcctaagaatacatcctcttggccaggcgcagtggctcacacctgtaatcccagcacttttggagaccaaggcgggcagatcacaaggtcaggagtttgagaccagcctgactaacatggtgaaatcccgtctctactaaaaatagaaaaattagctgggtgtggtggcgcacgcctataatcccagctactcaagaggctgaggcaggagaattgcttgaacccgggagacagaggttgcagtgagccgagacgcgccactgcacttccgtctgggcgacagaaggaaactccggctcaagaaaaaatatatatatatcctcttaaaactcctttgcttttatgctaatactcttaactagttgatttcttcagcttcttaaatgttggatttcccagtgttgtgtccccaccaatgttacgttatccattttactaactgcaataatcaattcccatacctttacctgtcgatgactctagaatttgtaatctctgaactcaactgaaactactaaatacattacttgtcctatgaagtacctcaaactaaacaaatttaaaactgaccttggccgggcacggtggctcacacctgtaatcccagcactttgagaggctgaggcgggcagatcacttgaggtcaggagttcgagaccagcgtggccagcatggcgaaaccccatcactactaaaaatacaaaaattagccaggcatgatggcacgtgcctgtaatcccagctatttgggaggctgaggtgagagaattgcttgaacctgggaggtggaggttgcagtgaacccagatcacgccactgcactccagctggggcaacagagcaagactttgtctcaaaacaaaacaaaaaaaacctttctttagataatggctaaaactattttctagcttcataaaatcaaacacttttccaaaaatatgtttccagaaaaatctttttaacttaaaaaactgttcattgaccagagatttgagggtcgagtcaaaacacactgtgacgtgccaggtccttcatctgacccctgctttaacctcccaaagtgttaggaacatcatgaacgctgcttggaactagaataatccaagtttgaataccacttccacttcaaggaagacttaggtagtttgctttctgggactcagttttataatccatacagcaggtaaaatattaactatataatggcgttaagaattaaattagatataaaacctttcaggagcaattattgatttgtaatcccaattttttttggtccagaaaataagacattcccttctatttgttaacatgtgttcctatcatgctgtcatgttcatgttcctcttttccattagtatatgagatcttgatagacacaatgtttttcatctttatggctgaagtgcacagttcctggcatgtaataggcatgcagttttgttgcacaaatgaatagataatctgctttgatgccagatgcctgaaaatgttgcccatagtatgtgtttattacaatagaaagtcccttgaatataaaatttgatgcaaatggtctggttgattctataccatcatcttgtaagacttcagagggttttcccacacttttcaaaaacatgtatctattttgttgcaagctagaaggactagtccctactctattcatttataatctagtttgggattaagccacatcagtaagtaaccaagtactgtaagcattcagccagatatcccagttcatggggtaatgtgtttcacagaggaaatagaatttttggattaggaggcagatagttctgggtttcattagggaaagggtggggcagtagagtacaacatatttgcagtcagcatggttttatgtgtaaaggcataaaacagtaacagagacaatgttttaagtaaaccaatttcactgggcttgtgtgacctagtacattgagagatgagactggaaagggggcggattggaccacataattttattttatttttaatttggagtctttttttctgtgagtcttaggccactactttctctattttgtttcttttatatttaaggaaacagtctcagggaaatgactgactgagtcgcagtgtaatgggggacagagccaggcctgaacccctaaatattgctgttctacctctaagttgaaaataggacagtcagtaaagagtctgttgtatactgggttataagatctcatttctaatctaacttggatggaatcaagattagaaaaagtacttgattcttacatttttttcttccttgttgtacataaaaagagattggcctggcacagtggctcatgactaatcctagcactttaggaggcagaggtgggtggatcccttgagtctaggagctcagaatcagcctgggcaacatcgtgaaaccccgtgtctactaaaaatacaaaaattagcttggcgtgctggcatgctcctgtaatcccagcactttgggaggctgaagcaagcggatctcttgaacctgggaggcagaggttgtagtgagttgtgatcacgccactgcactccagcttgggcaacagggcaagaccctgtctccaaagaaaagaaatgaaatgaaattaggagcaagcatgagttttaagtgtcagacttcctttcccagtacactcacctactacaggctgcatgatcttattacttcactgaactgtttccttatctgtaaattgtttgattatctacaaatgtgtagcttgctacctgacagcattagatattggataattggttgtcattgctattaataaacacggacttagagagttcttgaagttttagttttatgctgagaatccatgtaacactggcaatctgtgtctatacctgtatctatagcaaaagccagaatttaccacaaattttgctgttgtatcaggaaatacatcttgacaactgatacttattcttaatattattattctgttatttcttattctaggccccaaaaacttttattaaaatgcttcaaattttaggttagcatttttgttgatgtttggacatcttaaattcattatactcatgcaaaatttttttttttttttttttttggagacagggtctctgtcacctgggctggaaaatatatctttatagttttatgcacatttggcaatcagcagaaataataaattgttgtactatgtctatgctttgctatctttatgtgaccaagacattactgtgaaactgaatactatctggccacatatataaccattgctattaagaaagttatgattgtgacttggaaatagtcatatggagacagttctgatttaattcccaggtaactttcatattctcaccattttgcagtgtgcatttcaaaataatttttcatatcaatttgtagatgtgggaacacatcgattagaaagctgaagctaacttattctcagataacaatcatttaattgtaacattgaattttaagaggaaaaatacagtatgctgtcttgtctttttctgccctttcttttccatgtatggctggttcatgttttgctttaataacattttttgcctgggcaaatgtccatattatacattctgatcactttaattccatcacccttgaaattttaaaaagcaaacgtttgatttagtggcttttaagttaaaaaatatttatcgacatctctcatcattttatcagcttcgttggtacttaacatggtagttctactttatgaaagaagcccgtcactaaaatacaacattcaaaattaaaacataaattttcataaatttcacagtgcttttttgtgtttgttctagaaaccgtatctcactctgtggcccaggctagagttcagtggcagggcagtcatagctcattgtaacatagagctcctgggttcaagccatcctccaccgtcatcgtctccagtagctaggaaaggcatgtgccaccaagcctggctaatttttaaaagaatttttgtagaggtggggtcttgctgtgttgcccaggctggcctgaagcagttttcctgccttgacctcccaaagtattgggattacaggcataagccaccacaccaggctataagagtgcatttttaaaaaagataaaaatgtctaagccctgtttgagttgtaaggtgtcatcagatatgatgctgggtatatcagcttattcctttcttctgaaggttgtttttatgctatcttaatgaaccatcaaaggttctgaaatcaaacattttgaaaatacttgacttacggccattttatatcaagtgtatatgcttttattgtttgtgtgcttaaaactggttattttcatgaatgtactttctatggatcgctaaaggtcagaaccagctaagaatgaaaatgagtaccatttatacttactgtcagctgaacacttgcattatttttacctttatggtgtatcttacagaaattagtttttaggtcgtggtttcatacatagcagagcagctccctccctgccatctattcaaagtcagccctggacacagggtttgtccaccccctcgcgcatgcctggcgtctccgttgccatccgtctctcttacttcctccctctcaaactccctcccaacacccctgggggcctccttccctggtccacgcttgcccaccctctccgggatcccagagcaagtggcgggtatctcgtcgaaaagcgcccgtctccatccgatgcctttccaagctggcggtgctcaggggcatggtgccatgctgggggtggccgaggttgcaggggtgcccatgcttggtgtcccacctctctagttctagtctcctcccccaaccctactaggggcttgtccctggtctgggacaggcttggaaagtgtggcgcgagtatggctgaggcgtggttgtttgagggtgtgaccctgcagtccctgtcccagggataggggtggccgtgtggcccaggggtggccgaaagtggcactggggtccagccctctcccactctgtggtggagtggggcagtcactgcccttgagcccttttaaaaaaaaaaagaaattagtttttagtgataggagagagaatctttttgccaatgaggtagttgagataaattgagataactcagatataggtactatattttcctgggtattatcaaatttgatctttttttatctatcaaattggattcatatgaatcaatttattcaaataagtggttacattaagtttttttttttgttttcagtactttatcctgtgtcttgctctcatgggtaatccttaacgtagtcacctaagttttagttcccattcttttccatcctcctccttttttccatccctgtactctccagacttccctctggatcaactatgcaatttctgtatgttaatgtaacaacatatactccttctgcaaatattaatagatgtatgtcatagtgttctaaatttgttatctttacccctgggggcaagaattcgttttctttttaactggcaagtcatactttggtactataggaagccctcaagcctctgtgaccagaggttagcatagggaaattgagacattttaaaacgtttttcatattaaggtatgaagaaaactgaccttcattgtactttggtagtagaccgcttcctaattcattcctttaggtccaagtagccttctctgaaattaaaaacaaaacaaaacatattgaaaaagattgtagggtgaagttatatgccatcaaaatgatgatgacatacaggtatttttgtgtatctctgtcttttttgacaaccaatcaaattgaattttttttttttttgccagttaaatagaaactggtggccaggtgtaatggcttatgcctgtaaatcccagcactttggcaggggccaagaaggatggattgcttagcttaagagttcaagaccagcctgtgcaacatggtgagaccctgtctctacaaaaaatacaaaaattagctaggtgcagtggcgtaagcctgtagtcccagccactccagaggctgaagtgaaaggatttcttaagccccagaggtcaagactgcagtgagccatgttcctgctattgcactccagcctaggtaacaaagcaagaccgtttctcaaaaaatatataagtaaataaatagaaactatcaaattattttcaaggataaggaaggactaatcagtagtttagtcagaggcctagatcaaaacataacatgtatttttaaattaatctctttaaatgcatggttaagttacctgtatatgtgctcagtaaaatcggtcatttgtggggaaaaaaatggctatttggttttctatgcataaaattaagatagaagtctttttcctcctaacagccttcatcatagtggatttaaaaaaaccagtgtcacttaggctgtgtcttatttgtttctaaaacaatggaacaagtcagatgtttgtggaatacattttatatttgcaaataaagtaaaaattttttcttgccttttttatgaaataactataatttgtgtgaagattaaaatactctaaaacatgaattgacaaagcaaaatgaaggagccagatttcaaaatcaagttgtggggtgaggcatgaggatgggaagaagagaattaagcattgatatatggagttttaatttatttccttaaaattcatagtgaaaagaataagattttgggggggagggcacggaatctcactctgtctcccacgctggagtacagtggtgcaatctcggctcacagtaacctcagcctcctgagtagctgtaactacaggtgcctgcaaccacacctggctaattttttatttttagtagagacagggtttcaccatgttggccaggctggtgtggaactcctgacctcaggtgatccgcccacctcggcctcccaaagtgctgggattacaggcgtgaaccaccgcacctggccaaaatttggtactttataactcaataattgcaaccagaccagctaactttttgaaaacttggggctctgtaatgttcagatgaaggtaaatgtagggaatagaccctctttagattgagggagtaggagttttgacatcacaggtcgtttggacttaaaggtatgaatttgaaagtagtttggttatacatgtcctttgcaacctagcctctctttcattagcggaattaattttggtggagggattcattcatattgttagtatgtatcgagggaggcattgtataccagaaggctttgaactggttgggagaagtgttcttataagaacagggtaattattaatcataataatctttgtcaaggtgcctaagtaactcccttatgtaatagcagccagtgattagatagcttcacatcaagcaggttggatttgttccttttgaatcaaagaaccctttgcttcataatctaggtcttgtgtctcaccgaatcctttataatatagaataaatggttgaaaggaaaggctcacattctgtattcctgaaattcaaataggataactttctcaaagttttaggatagaccaaataatgtatgtccatgtagctctaagatatgagtcaacaaagcaaaataattatgaaactcttgtgggatttttggtagagtttttatggagatccagtgtatatgagaagcaaactaaagagagttgccaagggttttagagccagtcaaattcctagactttaggatttgttgaatgaattgaatggaaaccagtatagttgtcagttttaagttcactcagtattagcattcaattagatactgagttttaaaatagttttttttttttttttttttgagacagagtctcactctgttacccagactggagtgcaatgttgcgatcttggctcactgcaacctctgcctccaagttcaagcagttcttgcctcagcctcccaagtagctgggattataggcgcccaccaccatgcccggctaattttttacttttagcagagacagggtttcaccatgttggccaggctggtctcgaactcctgacctcaggtgacccacctgcctcagcctcccaaagtgctgggattacaggtgtgagccacgaagcacagcctaaaatggatcttttaataccaaataaggacattgtcttatgatttaaaaagtgtctttttaaaacctggctacattgttcttattctcactttgctatagaataatgaaaagttatccaacattcattttggaatattgttttggaataattcatgtatctcggctgtctgattttaccaacatggaaagcataactcaaagacaattctttaatcagtttttaaaatgaaactacttttctcagctgttaaaaaaatagatttataataatagtcatcagcattcttttaaattgtgacaagttagtcttagaaggatacaaaaatgtataaaagacttgtgaatttctgacaaatttaaattaggatatgtccataaatagcaattaaaattgtttccaaagagttatttcaaagcatcacatattacaaaaaaatggtgaaaatataaatataggtcacaatttataggacttttgtatattgtgtatgtttccatagaaataggtaaaggaaataatggtttctttttgggttataggcttacagatggattttctatagcaggcgtatgttaccaaaaaaatgggaatgggctgatgcttggatattaacttaaaaatgg

SEQ ID NO: 4648 - DNA, 468 bp, Homo sapiens
atggcgaagtccaagaaccacaccacacacaaccagtcccgaaaatggcacagaaatggtatcaagaaaccccgatcacaaagatacgaatctcttaagggggtggaccccaagttcctgaggaacatgcactttgccaagaagcacaacaagaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccatcccaagcttgggaagcgtgctcgtgcccgtattgccaaggggctcaggctgtgccggccaaaggccaaggccaaggatcaaaccaaggcccaggctgcagctccaccttcagttccagctcaggctcccaaaggtgcccaggcccctacaaaggcttcagagtag

SEQ ID NO: 4649 - DNA, 2673 bp, Homo sapiens
attgtctgtcacccagtagcacatgggcacttgagggacagagagctttgccctattttgttgctggctgaatccccaggccctgggacagggctggcacacagcaggggttcagtgaccagatgggcagggcaaacacatgtgcattgactccagggtacctctggctagaaaggaggcaaatatgtcacttggagacaaactgtcatttatggcagaagagtccacagtagcttggataggagtgtggggcaaaagttaggcagcccagacattgcacgccagccttggcccctggcccgctgcccgccagctcagacatgctccctggaggaggagggggacagccctttgtaaactcataaagggcagctagctatggccacagttgctctaggaggcagcatgaggcccataaaccccacctctgacagctttacagggcttggtgtgagtatgccagagatgccatgcatagtgccatcagagttcccaagtaccaaccagcaagggtggaagagctcttacacacaaatctgccaggctgtcattttccgaggtggccatcaggtcacccggcttcccagcatctgggttccctgactccctgtgctgctgcctcttctctaagagtgctggattcatgggcagggggtggggggcagccttccaggccaggaggggctccctaattcctccccagcttggtgtgcagtccttggagccttaatataattatgataactggcacttatcatgtgccagtcatcataaaaaacacgttacatagctgtccattttataaatgaggaaactgaggctcagaggggtaacttgcccaggattatacagcgagcagctagcaggtgtcagagctgactgttgctcaaaataccatgctcttagccacatgccccatttgagtctcagcttccaactctgacccctgcttggtggttgtccaaggaccactgagaggccccatgacagatgatggacagaatgggagcaggacccaggagcctgggcccaggcaggaagaagccaagggtcaatggctccacctgctggtgctgtgtacaacccacagccagccaagcccaggaagctcctgacagttttgacctgggcacacttggccagtatgccttggacaaaaggttcgggggcacaggccaggatttctctgagggtcgcttccagatcccttcccaggaaacaccggtgctggctcgcctgctcaagaactgctccctaagactgtccatcttccctcctggtcagaaaacacgttgttatccaaacacacccctcgcttccccacctctagatctctactcatgctgttccctgtgcctggcatatcatctactctccttgtgcgccaaaatcctactcatgctttagagcccaactcagatgtcacttcctccctggtgccttcactatgtggaatgtatccactgtcattgaatttcatttattcatttgctcatcatagagacccctgggccaggctgtgaccatttccccttcacatgcctctggtttgtctcctgtttcagtcctgccttgtggttttcacacagctgatgctcaataaatgcgtgctgagcaaactcacaaggctggggtgttcaggtctgatcatgtgcgtgtgcgcaggtggctgcacttacagagagacgcctgaagagggcagcacactggggcgctaacttggagagtgaggccgcgtgatttgttagaggaggaagccggagggcggagggagggccagcccctccccctcaactcgggctccagacgtagtttgagtcccctgtgcccccactttgctgggtgaccttgggctttggggttggttccaggagccactcagccaggccagcccgcctggcggacgccattcccaggagatgaccaggccctggacagccgacacttggaagactgccacgtcctgcctccgcaggagccgcagctccccggggctgcagggaagtggtggctgggctgggggggtggggggtgagcccgcggggactccaggctccaggtgcccacaccatcccgggggtgggcagtcagggccaagaacgcacagtaaacccccagcacacacaagcgcacacacgcacatgctgacagcactcgcatttttaagatggggaaatagaggctcagagggggcatgcgcgttcctgcccctcaggatcaccagcctgcccccaggagaaaagggaagggaacaaggctgatggctggttccaccaactgggcgcccgggctcagggtgaatgtggggggctgtgacccctgagacgttggatctgcctccctggtatggtttggatgtttgtcctctccgaatctctcactgaaacgtgactcccagtgttagaagtggggcctggtggggggtgtttgggtcatgggacagaccctcatcagtggctctttgcagtaatgactgaggtctggttgttgaaaagagcctggcacctccctccccgacttgcccccgtctcgccatgtgatgcgccggatccccttccccgtttaccatgcgtaaaagcttcctgaggcctcaccagaggcacatgccggtgccatgcttcctacacagcctgtagaacaccaagtcaaataaacgccttttctttataaatt

SEQ ID NO: 4650 - DNA, 3470 bp, Homo sapiens
acaagtatgaagagaatgtcgggagaggaagtggtggctatgagtcagcatgagtcatctcgttccaatgagaatgaaggctgaggtgtgcgccttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttcctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtcttggacgagcctgaggatgtctacaagtggaagaaaagaagccactggagcagaaggtggggaggataaaatttggagcaagattctcaaggaagcaacaagatcctaaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatct

SEQ ID NO: 4651 - DNA, 5252 bp, Homo sapiens
agcgcgcatgcccgggcccggggcgcctggacctcgggagggagcggagggcgcctacctgcaggccgttggggtatgcgtcgccctcggagagcgagtccaccaggtcctcctcgtccagcgtggcccgcttgtacgtcgacatctgcaaggccaaatgcagcacggactccctcagcgcctccatggctctcgcgcccgaatggggaagcggccccgaccctggcgccgccgccgccgcgccccgccccggcctggacacccgagaccgagaccggcccacggagcggcccgcgcggggaggggtcccgcccgcctcccgcccccgccctccaggccgcgcccgcctcacccccagcgccgacagcagggcggacaccgggggcggccacacgccccgcatgctgtgccccagacgcctggtcccgctgcccgggtggccgggatgggatgggccgggccaggcgttgcaccaccttcgcgggcggggcctgatcggttcgccggcgcccggttcccaacctccggcctcccggggagaccccaagacccgagaggcccgggggagatggggacccctcccttccccggaggtcgggagtgggggcccccaaactgaagcccctagcaggcaggaaaggccctcacagtgacccctccttcgagaaaatcttaagtcccccttcaacaaccgggtccccagtggcagataacaaaagtatcaggaaggtgccctcgatgtggcccagagcaatcaagacaggttccccccggcatcagcccttaggtgtgtctagggggttaatgctagaaagaccagacaaaaaaggtggggtaaaaaggtaggtgtcccctttcagttcccctttctagctcagaggcctttaagccagagttcgtgaatgagtttcagaaaatttcagagaactccctgacacgggatgaaaggagctgtgtgtgtgcatttggatggctgcagggtggtccggtggtcacccccgtgctcaaaggtgtcgccctccctgcaacacaagagaaccattgctccagggggagtcagaagccaggaaggggacccttctttcccatcttccccctcaagactcggagcctcagccaggtgcccccctccccagcccctgagccctctcctataaccctaggcagggaaagggggctctctcggatatgaggtgttcagttagggactcaggcccagcactgtcccaaccaagaaccccagagaggtctaacccagcagatttccaaaggactctccgcttctagcaaggcgggaatccctgcatttatgcgtacttttcagctttgcaaagtgcatttctgctcattccaaatttgattctcacagtcacacatatgtgtgaataaacaggtttagaggggtgaggggcctgacgtcacagggacagtgagggcaatggctccagatggtctcctggcttccactcctgccctctgacagccccctcagcagccaggatgagcctttaaaatgaaatctggctgaggccaggcaccatggctcgctcgcgcctgtaatcccaacactttgggaggccaagttgggtagatcacttgaggtcaggagttcaagaccagcctggccaacatgatgaaaccccatctctactaaaaatacaaaaaatcagctgggcctggtggcatgcatctgtaatcctagctactcaggaggctgaggcagaagaatcgcttgaacccaggaggtcgaggttgcagtgagctgagattgtgccactgtactctagcctgggtgacagagtgagactccatctcaaacaaacaaaccacagaaatctggctgggttcagtggttcacacctgtaatcccagcactttgggaggctgaggcaggagatcacttgagtctaattctaggccagcctgggcaacacggaccccatctctacaaaaagaaaatatatatatatatatttatatattatatatttttaattagcaggacgtggtggtatgcgcctgtagtcccagctacttgggaggcttaggtgggagaatcgcttgaagccaggaggtggcggctacagtgagctgtgattgcaccactgcactccagcgtggacgacacaacaagatcttgtctgaaatccacagctttactggggctgggaccttgtctggcctgtccaacagagactctccatcacccggcacagacctgtctgtggacagatgatgcaggaagctcacggaactcccaagcagaaatcagcagagatggagcctggttatttttcagcacacaaaagccgagggccccttcctgagatgcctgcctcagcccggtagtgaaactgaacccacctcagacgggaaaggcttggcgggctctgcttggtgggaagtccacagtggtgcctcgtccctgagatgagaatcatcacctccgctttacaaatgagatgaccaagggtcagagaggagaaaggacctccccccagccctgagtcacctgcctggagactgagggagccataatgcgaatcttccccttgccaaacccactgactccattacgctgcctccagagaacccgagccccgcggcgagaaagtggtagagctgggcctcgaacctgggtcctggactcttggtcctgtgctccttgtggaagatggaactgcttcttcagagacaaggtctcattgtattgcccgggctgttctaactcctgggctcaagcgatcctccggcctcagcctcctaaagtgatgggattacagtcatgagtcaccatgcttggcctgggcaggactttctcaagtggaactgcctcacacacagactccctggagctggcaggatgaagcccatgaaccttggcctggcttgctaaaccctccctcccgactccctcaggagttcgagtctgccttctttctccggctggctcctcagcttaacgcgctttcctccaggcagctctctcgggcttcgcagtgacccttcctcggtgctccgcggcagcatgcttctggcatctcatcccaacacagtgaagagcagccaagtgcggctgtgtggccctgaccaagtcatttcacttcaattttatgctttggctttcacatctttccacggacgtgaatggagatgatcatggtgccgaccccaaaggatccttacacgtcttaaaaaagtgagccacggaaaggcctcagcccagtgcctagcagagaagcagcacatgggagggaaggaacgaccagagaagacccgtggtgtgccaggcactagacctggggctcggtggcacatgtcagctccttgcaagtgtgaaacaactggagtgcagcgagcatcagtaactcaccctaagtcacacatctggtaaacagcaaagcctggatttgaacccaggttttcccatgacatcagataagacggcaatcaccacctccttctaacccaccctgcctcacctgctccatccttacgacttcaggtgtcacctcccagctgggtttaaggggctgagttgtccactctgatcttctccaagcacaaactgcaaagcagaccagaaagcagctggtcctgactccagggctacccacagatgcccctgcacctcctcatgctcctgtgctcctgtgtgatgtcctggactgtgtgatgaccaggctggggaagtcccaatctgaagagaccaagcgctctctgacaatgtgctgatctaatcacgtacaacttaagacaaagttaacccgtctcattgaatgatatggtataatggtgatgactgagctgcccagtaattgtgctcaaccaggaagcagctcatggagtcagttgtaattagtatttgtgttacacaggtgagtgggtgggtgagggctgggcagagggaggaggaagtgggtggggcaggaagctctggggactccttggatccatgaaccccatgccagccaactcatgtggttgatcctgtctaaccttcatgatgacctcatgatgtactgttatctctcttctaaggtgagaaaacaggctcagagaagtccattcacttgtccaagatcagacagctagaaaatgacagagccagggttccctcttcagcccaggcgatgtcttggacagcagaaggaacaggaatagggctgggaggctggagatccacatctcggtcccagttctaacactgccttaccctgggcctcagcaagtagcatccctcttcaggatacaaagagatagtatgtctgtcaggttgcagacggctgagggtgtggacttgggagctaggctccttggattctaatccttgggcaagctacttcaccatctgagcctcagtgtcctcatctgtaaaatggagatgacaacagtgtctccctcataggcttgtgaagataaaacgagtaacaagacttagaacaatgcctgaatattattgtcatttatggggaaaaaatgagctttgctgtccatttttcatctgtaaaatggggaagtagttgctggatctgaacagtggtttgcaaacagattttttttcattccatagagtcctttatttaaaaaactaaacacagcaacccaaaatacaaaagagatgtaagtggagctgccacttaggcactcaatgagctcatatcctgaccctgaacccagctccctcaggggttctaaggaatggagtttgaaaaatcactcaactgtctctgagaactggtggctctaagctgagatcagggtcgggtggaagcaggaaaccatggcatgggccaggatgctgctcacccactggaggcagcacatgggggctgtgggacacgcagggttccctgctgctggcctgctggctgccaccattccagctggacaacagtatccccaggaggcggctgagaagcagggagaagaacaccaggcttggagtcaggtgggtggctctgggcaggtcgtgtccctctctggggcccattttcctcacctctaagagagggatggtaacactgcactcatcaggggtcctaaggacaaaattgcatcacacatgtgaaaaggctttgcaacggaaagactgccctgaatgacttttttttttttgagacagagtcttgctctgttgccctagctggagtgtagtagtgcaaactcagctcactccaacctccgcctcctgggctcaagcaattctcctacctcagcctcccaagtagctgggaccacagacatgttcc

SEQ ID NO: 4652 - DNA, 539 bp, Homo sapiens
accagttgtcacacactgctgtcccctggtctagttaaagggttctgaaggctgatagaagttaacagtgtttggtggcttaccatggttcactgggacttaaacagaattgacaaagagtaaaggagaatttgctgaaatacttatttaaagtctagtactaagctgtcgggtaccatagtcactagctacacattgctactgagcacctgaaacatggctattctgaattgagatgtgctatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactg

SEQ ID NO: 4653 - DNA, 5510 bp, Homo sapiens
ggcatttggtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttctgacaacaaaggagattgtgacatattgctgggcctaacactaaggtgatgttagttatttgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctcataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttagggagaccgaggtgggtggatcgcctgaggagtttgagaccagatggccaacatggtgaaaccccgtctctactaaaaatacaaaaattaatcgggtgtggtggcgggcacctgtaaactcagctattcgggagcctgaggcaggagaattgcttgaacccgggaggtggaggttgcagtgagccaagatcatgccactgcactccagcctgggcagcagagcaagattccatcttgggaaaaaaattacaaaaattagccaggcgtggtggtatgcacctgtagtcccagctacttgagaggctgaggcacagcagtcacttgaacttaggaggcggaggttgcagtgagccaagactgtgccattgcactccagcctgggcaacaagagcaaaactccatctcaaaaaaaaaaaaaaaaaaaaaaaggttgtgtcatattcctggctaaaaacccagatgatgtgactctcctctctccctattcataggcaggattgtaaaatatatctttttttttttgagacagtttcattttgtcacccaggctggagtgcagtggcatgatcttggctcactgcaacctccgcttcctgggttcaagcaattctcttgcctcagcctccttagtagctagccaccacacctggctaatttttgtatttctattagagatagggtttcccaatgttggtgaggctgatctcaaactcttgacctcaggtgatgcacctgcctcagcctcccaaagtgctgggattacaggtgtgagtgactgcgcctggcctgtaaaatatatcttgacctagatcacagatgcaatgattactctcatacctcacagtatttaataggagagatgctctctcttgctctcgctctcttttttctttttttttttttttgagacagttttgttcttgttacccaggctgcagtgcaatggcgtgatctctgcccaccacaacctctgcctcccaggttcaagcgattctcctgcctcagcctcccacgtagctgagattacaggcatgtgccaccacgcccagctaattttgtatttttagtagagatggggtttctctatgttggttaggctggtctcgaactcccaacctcaggtgatctgcccacctcggccttccaaagtgctggggttacaggcatgaaccactgtgcccagcccaagatgctgtctcttaacagctaggcctagagtcatgaatatgattctgggtctccttgtacaaaggtcatgaagaattgccactttcttgcatactgtataaatctcttgtggtacagagagtgtcattacagggttcagcatacagatgagattgtttctcatatacactccccaccaactgttagaattgtcaccctcacacatggacagagcccactggtgaggccctgaatctcacacacacacacagtctacagttaaaattgtgactgtcatatgtgaacatctggctagagttgaaataatgacttatttctaaatccagttcataggtgagaattctacctgtctaagcctaggtaggatagtcaacatgtccctaattggctgggggacatgttgactctcctacctgggcttagggccaaacagttcatggaagggatgaaggctctcagctctcatgcacagatccagttggtgagattgtcactagcatacttagacccaacatactctgatacctagaactgggacatgtgcaggatttttaattactggaccttcctgcaggtgtgattgtgacatatgtctttgttacacacctgagtggtttgatgttcctgccttggttcaacccaaagtgaagattgtgatgtgtcactggacccagcatctcagtgatgtgactcttctttttggacaccacaaattttgggtattgtcaaatattgctggatcctgtacccatgttatgtgactctccaacctatgtcctgcatgttgtgccatattgcagcacaatgtgtcacattagacatcattacatattgctgggctcaacacccaagtgatgtaacattttcctgggccttgactacagggggctttgtgacataactgaatgcccataaccatggtaatgttactcttctcctgcctggtctctgctcacagggaaattgtgacataccattggcctagcatcttggtgatgtgactctcctctttttctcaggccccacatatttgggtattgtgacatacccaaatgtgacactgggctcaacacctaagggacgggagttctctacctggccccttcctgaagggggcattgtgacatacttctgcacaggtatgtcacagttattacctaggagatgtgactctcctcttttgccagcaccctgcttacagggaaaattgtggcacatttctgtggccagcaaccaggtgatgtgtttctcctgcttgggtctttattacagaaaagatggttgacatatcactaggcccagcatctaggcgatgtgactgtcttcttctgcctggtccctgcttacaggaacattgtagcatattgctatgcccagcacttttctcttcttttaggttttgcctgcaggagactttgtgacattgctgggccctgcactgacattatctgactcttctgtctctgcctacttgggccattgtgacatattgctgggtccaacatccaggtgatgtaacttttatgcctgggtcctggcaccagaggacattgtctttgcaccactcacacaggtgatgtgattttcttctgttacctggtctctgctcacaggaagaattgtgaccttggccaggctcggtggctcacacctgtaatcatagcactttgggaggccgaggcgagtggatacctgaggtcaggagttcgagaccagcctggccaacatggtgaaacccccatcttacttaaaacacaaaaattagctgggcgtggtggcaggcgcctgtagttccagccacccacgaggctgaggcaggagaatcgcttgaaccaggtaggcggagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagattcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttaa

SEQ ID NO: 4654 - DNA, 13283 bp, Homo sapiens
gcgccgaccttgatctcgtagccggcgccagcagccgcgctttggggcgtcggctcacgtggggccggcaacgcgtcttccaggatgttcgcgcgctagtcgccgctgaggggccggcgatgcgcgaggagttccggcgaggaaggtcggtcagtggacatggccgaggcccgcggtgtccgcgtgtgggagctgcagggctgaggagaggccgcccgcaaccctcgggaatcgtgtgaggtgccactggggtcgcttcacatcaggaggccccgtctcgggggacgcgcgcaggtgaccctgctggtcgtacctggccggggtggcccggaggggctgggtctcggcgccaggaggggccgtgtgggccgcctgttaaaggacccctcgttcgctgacatttgattttgcattgggtgccttctcttctgtttttttcagccagtgagatccgtcctgggcactcagctgtagagcaggggaacgagtcctgcgctttttgcgctgaggtctcctggcccgtaggccaggcagcctctgagctcctttctcaccagcagcttgcgatccctcatccctggccctgtcactcccagctgtttccagtgccgccctttttttttttttttttttgagatggagagtttaacttgttcgcccaggctggagtgaagtggcacgatcttggcctactgcaacctctgcctcccggattcaagcgattctcctgcctcagcctcccgagtagttgggattacagtcgtgcgccaccacgcccggctaatgtttatatttttagtagagacgggttttcaccatattggtcaggctggtctcgaactcgtgacctcaggtgattccctccccccgccccaccacctcagcctcccaaagtgctgggattacaggcctgagccaccgttcccggcctcgagcgccttcttataaactggatggtggtttttgttttcaccttcaaagtcgaatctccctagtccgtttattaccagaaagaggtctccactcagacccagcgagaggcttcttggatgtcgcgtaggaaagaattcggggcgagtccacggactaaagtgaaagcaagtgtattagagaagtgagaaagcaaaagaatggcagagcagggcattcctgaaagcgggaggaggaaggcgcccgccttaggtacagtgcttgttcaaatctaaggtaacacagccaaagaaatcttgggggacatgggctctaccacgagggcccacgaccaaggtttcatgcgcgtccgtgtgaagagaccaccaaacaggatttgtgtgagcaacatggctgtttatttcacctgggtgcaggcgggctgagtccaaaaagacagtcagcgaagggagataggggtggggccgttttataggatttgggaaggtaatggaaaattacagtcaaagggggttgttctctggtgggcaggggtggggggtcacaaggtgctcagtgggggagcttctgagccaggagaaggaaattcacagggttaatcacttagttaaggttgggcaggaacaaatcacgatggtggaatgtcatcagttaaggtggggcagggccttttcacttcttttgtgattcttcagttacttcaggccatctgggcgtatacgtacaagtcacaggggatgcgatggcttggcttgggctcagaggcctgacacaaggattgttcatctttgtttactgactttggcaaagatctatattatctttaaagcgaaacctaaatgaagaatgcttttgatcttaagatattgttaggttttgaagggaagacgagagttaaagaatgacacacaggtcgggcgctgtggctcacgcctgtaatcccagcactttgggaggccgaggcgggtgcatcacctgaggtcaggagtgggagaccagcccgaccaacatggtgaaacctcatctctactaaaaatacaaaaattagcggggcgtggtggcacatgcctgtaatctcagctacttgggaggctgaagcaggagaatcacttgaacccgcgaggcagaggttgcagcgagccaaaatcacgccattgcactccaggctgggtaatacagtgagactgcgtctcaaaaaaaaaaaaaaaaaaaaaaaaaaacaaagggcagctcaacagcaacacaggtatatggcaaaaacctacagagatgggggatcagcttaatgccagagcccactgctgcttacaggctggggtacttatagggcaggaggggaatgggcagtatggcttgccatgtgaatatacttaccagtatatctatccataaaacgttctatgatcaggcagtttggcccttgttccctcagaaagtgacagtgatgttccttgcacctttgctgagcaaggtttgatagggatgttccttcaattgggcctttacccaacagggtttggtaagaaagttgggcaggaaatttctcacggcctgaacccccgtggaatgtttcgctttgaccagtgtctgcgaaatggcggggggcttagaaaatggtgcagtttggcagggcgtggtggctcacgcctgtaatcccagcactttgggaggctgaggcgggtggatcacaaggtcaagagatcgagaccatcctggccaacatggtgaaaccctatctctactaaaaatacaaaaaattagccgggcgtggtagcgggtgcctgtagtcccagctactcaggaggctgaggcaggagaatggcgtgaacccaggaggcggagcttgcagtgagctgagattgccccactgcactcccgcctgggcaacagagcgagactccatctcaaaaaaaaaaaaaaaagaaagaaagaaaatggtgcagtttggactaacagatacagcgacatcaaaatgtttcctgggtctgttaagtcctgggtttgtttagtgaacgttattaatctgttcctgtaaccctaaacatcttgtgactactaagaatgcagccaacaggtctctgcctgattttacctactgcctcttcaagatggaattgctctggttccaatgcctctgacaaactggctgcttgatctctaggttgtgaccatgtcagggatagaggcagcttaggtagaggtagactttcttgtactcaacattgaattgtggcttagttaaaatcagaactttcattcttggaataatacagtattgtaagggtaagccaaatgattaacacatttacttaattacacattgtagcattgaaataactgatgcctttctaatgcaaataaaaaagatttatgtatatgatagcactgtagctgtcttgcgccttactggatggatttcattgctggctaaaatgacaactttaaactggctataactcagaagaatggaggcactttgcacgcagacatctacctccattgaatttggctacttccttttaatgaagctcaagtctcatgttatgaaatactcctccaaaggtgttagcccttttttcctatactctgcctttcaaaaatccctttcaatttgcttaacccctgagagccaaaggactgtgatggttgttaggctgggtcattgtcatcatgttcagtaaataaatacccagacatgtcagtttacctactttacctgattccaaatgagtccatggtgatgtgatcctgcctttctttctgctgttagaggtccatgccaggagccagctttgtatcagttttgccacagtgatcaggtcataaatgtctcagatcattcaagcccagtttaacctagcaaagaaaatggcaagataatattgctgtgttctagctgtgttctggccttcattttaggtaggcttaaacctcgacctggagtcattcctgttacgatttaccagaaaacacccaacaggaagcctacagaactacactttgctcctaatgttaaggaatgaaaacaggaaatgttctgttatctgcctggcagtggggctttggagttaatctcctggccgtatcacttaccagcttggcagccttggacaaactgagctctgagctcaagtttcctcatctgtaaagcgagggtgtattatgtaccttcatttggttgtacagattaagtgtgaacacttaggtaaagcacacagtatggggctgagtaaatggactgttaaataagacagtatcacttgtttttaagttccttggagctttctcccctaaacagctcaaaagattttcatttttttctaatgctaatatttttctaattcttgttttaaaatattttactgtaaaatattttggccaggtgtagtggctcacacctgtaatcccaacactttgggagaccaaggcaggaggattgcttgagcccaggagttggagaccagactgagcaacataatgagacctcgtctcgtcaaaaaacaaaaatggaaaatttttaaaaaacaggccgggcatggtggctcacgcctgtaatcccagcactttgggaggccaacgtaggcagatcgcttgaccccaggagtttgagaccagccttggcaacatggcaaaaccctatctctacgaaaactgtttaaattagctgggcgtggtggcacgtggtggttctagctacttgggagggctgacgtgggaggattgcttaaccccgagaggtcgaggttgtagtgagctgtgattgcaccactgcactccagcctgggcgacagagcaagaccttgtttcaacacaagtaaaatatttgtgaaatgggaattcagtttcattttttttttaactgatcaaaaatataactttcacccccactgaggcttaaaagaacaaaaacaaaaaagtgtgactgacattcggcggttttggcttctagaccgccactaatattgagctgagttcctgtaactctggctaaaagcaaagagctgtgttttagccagagcagttttattatgagttagatttatgatttccagtaggctttttgaaatgttggccagaggtcagggactccctgtccccattcatagattctagactgaatctctttcaatatgaacacatttggctctttaagaaagacttaactaaactgggattcaactggattgcctcgagactttgggcagagcacatgacttattttgtcctagagattccaatctgctggacactcagaaactttcacaacttctatttttcacattttttcatattttaggcttcagtgcagaaggattaaaagtaatggctaagttttctaatgctgttatttattttttcttgaggctttatggtcactaaaaaagtaacaatatatagtacgtaaaaaaacttaaagatactgtggcttataaaagcgtatcttttttctgagaacaaaattagccaattaaataataaaaccatcaagagatgtcaccagtcaatgatgatggggcaaaaattgttctgcattccgaggagggagaaatcgatgcaagcagaagcgattaaacattcacatcttggagctaaatgacctcctaggatggatgggttttatagaggtggagaggtggggggagggtgctggatgaaataactggaaaatctcctttttcttactatttttcttcagtccctttataggcacaactgcttaaagaaaccagatggccccaggatggtgccagagcttcctgaccccttatcagataccagaggaagataagactgcagagcggaacaggataggcaacccctggttggcttcagatcattatcatgtcgttataatgctaaaattccttctcctaaaagaaagtctccaccattttgtgtacatgtgatgtatgaagacgtatgtttatgaattgtgtgtgcacatttagagtctcactttgcacatgctaacattcctctcctgtcccacacctagtcctaaaaactccatgccttctagtgtttggggagaaggggcatttagagttaagagccccttccctggccagcgactaaaacctggttaccgtttacagttgaatgtcctctgcgtaaatcgatacaaagtggggaaagagctgagtttaccagtgacgactggaagaccctctctttgagatttgtaccaaaccaggtctcagtctgcctgtacatgctctgtcattgctttcactgtgttgacctacttgctgctttaccctttgtgtctggccctctcttgtacttagttctttcctcctgtccgtctccaccctctttcacatactttttctcagttttgtgactttagcagaccttttcggctggcccccagcacatcccatggcctggcagcaggtggtttctgcctggagggctcagccatcaaaagatttcaagatgtatattttgtaaggcaaagcctatactcatagactttgtgaaggacctggttggggagacaggagaaaaaatggatgggaaaaaagtagtaagcagttttactgtgtgagatattagtgggcgagataacattgaagcagtgcttgattaaataccaaatgaagttccaatggtagctgagagaagggaggggagagaccatttcagactggggcctgtgttagtctgcttgtgctgttgtagcaatgtagcacagactgagtggtttaaacaaaagattgatttcctcaccgtcctggagtctggatatccaagatcaaggtgtcagcagggttaatttcttctgaggactctccttggcttttagatggtcactttctccccgtgtcttcatggtcttccctctctattttgtctgtgtctctaatcccttatacaaacaccagtcaggctgggcacggtggctcacacttgtaatccccacactttgggaggctgagacaggaggatcacttgaggtcaggagtttgagaccagctggaccagtatgttaaaaccccgtctctactgaaaatacaaaaattagccaggagtggtagctcactcctgtggtcccagctacttgggaggcaaaggcaggagaattgcttgaacctggggagggtgaggttgcagtgagctgagatcataccactgcactccagcctgggcaacagagcaagactccatctcaaaaacaaataaagccggacgcagtggctcgcgcctgtaatcccaacactttgggaggccgaggcaggcagatcacttgaggttaggagttcgagaccagcctggccaacacagtgaaacctcatctctgctaaaaatacaaaaattagctgggcatggtggtacacgtctgtagtcccagctacttggaaggctgaggcaggagaatcgcctgaacccaggaggcagaggttgcagtgagccgagattgtgacattgcattccagcctgggcgacaagagcaaaactccgtctcaaagacagacaaacaaaaaacaccagtccctggatttctaactgcctcattttaatttagttacttccgaggccctttctccaaatgtagtcactttttgaggtactgggggttaggtcttcaacataagaatttgagggaaataaaactgagcccatagcagggtaataggaaaggctttaccaagttaaagctgggattggaaataccccatttctgtgattaaaaaatgtacctttgacatttctgaaatcagtatatttctgaccttcagggtacagtttaaaaaggcatactgccctggttttaccattagtggttgaaaggatggacagtacagacttctactgggaaagaggtcttagtgttagatgcatcagcttcttgggtcaggggcaagatttttctctaagttgcctatcggaattgaatctgccttgcctgagcctctcctttcagactttcttccctctccccagccatcagtgacctttcagtcttcatcccaggtcctctttcttcctctgcctcagagcctagttaattgcttctattcagtgaaattagagttcaagagtctgggactgggattccttctcagagaatgcaggagtagaaggcaaacacatctgacttcttgcttacgtcatagaacattacaggatgctgtggactgaattgtgtcccccacgaattcgtatgttgaaaccctaactcctagtgtgattgaatttagagtaagaaagtaattaaggttaaatgatgtcatatggcatgtgaaaacacagccagaagctggccatctgcatactaccaggaactgacttgccagcctccaggactgtgagaaaataaactgttgcttaagccatcagtctatggtgttttgttaaagcagtccaagctaactaacacacagaggtacgagtccctctgaaaattgtcagtgttccttcagttctctttgggtcaacttcagtctaagaataggtcttaggccagtcaagctgtacccctgacactgaggatggttccactaattcgccatcccctaattcaggagggggaaggatagatacgtgaacaaaattgagatccttttgagaaggaagaggaagggaatcagtgctgggcgcacatttagcaatgtccagatgcccatatgcgatacgaccatgatatgatcttaggtggcattaattgaatactatttagaaggaggaaaatggcctttttctactcccagcagttgagaccaaacttgtagtaggcacaaggagaggcagcatagagggtagaggctaagcatgcagggccctggagattggctgcttgcattttaatactgtctttcacatcctagcattgtgactttgagcaggatacttctgtgtctcctcatctccaaaatggagaataataatagtaacctagctaatgggattactgaagattcaagtaatacaattgaaatgctttaaacagagcctggcacataaatactaaataaaaattggtgtttataattagtctgctctgggaaacattctttcaagaagcatacagactaagtgcaacagatttagagaatgtgactgaaaagggaaggggacaagccatgtcatctaagtgaaggctgaaggagccaggggtgttaagactagaaatgggaaaacaggatataaaacatttgacacatctggaaaagtctcatattgtttgttgtctgttatgtgtgttttgtgtgactcagaagtagataagacgaatagtcctagaaggaatgcagaagacagtgagatggagttgagagtgtgatttcacagtcataaagactcaagtctgaattccagttctgtcactgattagttctgtgcccttggaggttttactcacattcatggaacctcagtttgtctgtctgtaaaatggaaataatgacttctgctgtttggttgagcgaggtgatggggatggttcatggtgaagcagaaaggtactaccagatgagtttactggctgcgatctggccctcaactttgcaggtctaaacttttgtaattacccagagatgagcttggtggcagaccgacactaatacctctttcagggttgtagtgggttgaatagttagtggccctcaaaagatatgtcagcatcctaacccactcaactggtgaatgtaaccttatttggaaaaagggtctttatagatgtaattaaggaacttgagatgatcctggattttccaggtggacactaaatgcagggacaggtgttcttaagggaggaagagcaggcagccatgggaagacagcaagagaatggaggtatgcagccataagccaaggaacacctggagtcaccagacactggaagaagcgaggaaagattctccctagagcctttggagggagcgtggccctgctggattttcaactttaccctccagagctgtgagagaataaatttctcttgttttaagccaccaagtttgtggtaacttgttagagcagcctcagtagccactaaataaagtccagttgattagggaaatctatctggcttaactaatgataaaaacaaatttaagaaaataattcctttgggaggccaaggcagcaggattgcttgaggctagatgtttgaaaccagcttaggcaactaagcaaaacgccatctctgcaaaaataaaaaaaaatagctgcacatggtagcacatgcctgtagttctagctactagggaggctaaggtgggaagattgtctgagcccaggagttggaggctgcagagagctgtgatcgcaccattgactccagcttgggcaatagagtgagactctgttgctccaaaaaaaaaaaaaatagccatcagaagaaggtgttgttaataaaaaccagataaactgggtttggaaaagaatattttgccatatgaatccatccctgtccaggtgaaagagatgaggagcctagagacgaaagattttggttactactgaagtgttctgttcagtgggtcatggacgtttcattattaggctgcttcctggtctgagtgaaatctcttcaagacgattcctttctttgctgcagttcagcatttatcaaaaaatagccaatggaatgccagtgctgagaaatgctctgaagtaaaagtattccatggttaaataggctcggggtgtcgtatctccccagtcttagagcttcacaagcacatcatcataggagccaagaagttatgacataaagctgtttgaactatttaatattttcacaaatgtatttgagcccaggacctttgtatagcaaaataataccacattagaaacattaataattacatttcccaagtatcctggtatggggaaagaatgccctggttaagaaattcaagacaataaaagctgagtgcggtggctcacgcctgtaatcccagcattttgggaggccaaggcgggcagatcacctgaggtcaggagttcgagaccagcctggccaaaatggtgaaaccccatctctactaaaaatacaaaaattagctgggcgtggtggcgggcgcctataatcccagctacttgggaggctgaagcaggagaatcacttgaacccaggaggtggaggttgcagtgagctgagatcgcgccagtgcattccagcttgggcaacagagtgaggcttcatccccctcaaagaaaagccaaactaataagattcaaaatgataaaataataaattggtgtttttttatactttgccctatagtagtttccttgcctcttccagcttctggtggctgccccagcattcctgagcgtgtggctgcgaaactccagtctctgcccccaccttcacatcatcttctccatgtctccttaccttcctttgcctctgtcttgaaaagacactgtgatggcatttaggacccacccagctaattcagtgtgttctcatctgcagatccttgatcaagtcacatttgcagagacctctttttcaaataagagacgaggtctcactatgttggccaggttggtctcgaattcctggccgcaagccgttctccagtctgggcctcccaaagtgctaggattacaggaacagaattgccattgggcccagggagagactacacttcttgtctgctttgttgctagtgcggccttgtggccaagcacagaacgtgtgcagtgatgatggtgcaacttctaggtcgtccccagcatggaaaatgagccctgggcatggaagatgagccctggtcctgcagcggtgctctttcctcttctcacaagctggaatgtgcatgtgctcccacccagctttgaccatggggcgaaaacagtactctgcagtctggcagagcaacaaggtggaaagggcctgggtccttgagtgacgtcatgagccctctcactgtcccgactttgggactgttatatgataaggactttctgtgagtcactgtcttttagagtctctctgttttagctgcctggactttatcctgaataatatggctgttatcatgggtatagtgttactatgagcctcatctaagtaatttctactctgcctttgaccactaaactcatgttggacaagagtcacttagcattattttttcctcaatgaagaggttaagatggagggagcaggagaaattgaggcctgtgttttaccagaaggtgaagggctgtctttgcctttcctacatttatgaaggataattctagacaaaaacattaagttcatatcaaaccatctgctttgtgaagccatgggctttgctagaactttctgtgacatgacatttattaacccgagtctacctggaagttagagctgaggaagttttcctagagtggaaaaagtccaatgcacttgtaaaagtcagaccaagctcagctcagatttcagttttattagaagtatgtcaccttcctgagcccttattatttccccatctgtgaaatgaggacaccgttctctctttctaagcattgctgggaagaccacacaccactgagacagaaggtggggctagcgcagttctgggcattttgtacacccccaacaaatactgatttatttccttctttttccttgctcagaaaaaattggagaaggctttattttaaaattctgcctgaattactttattttatttatttatttatttattttttggagacagagtgttgctgtgtcacccaggctggagtgcagtggtgcgatctcagctcactgcaacctcctcctgctgggttcaaacgattctcctgcctcagcctcctgagtagctgggattatgggcgcccaccaccatgcccagctaatttctgtatttttagtagagacggggttttgccacattggccaggctggtctcgaactcctgatctcacgtgatctgcccacctcagcctcccaaattgctgggattacaggcatgagccaccatgcccagcccttgaattactttagatcctactttttaagaaaatatttggccgggcatggtggcacacacctgtaatcgcagcactttgggggcctgagttgggtggatcacttgagtctaagagttcgagaccagcctggccaacatggcgaaaccctatctctactaaaaatacaaaaattagccgggcatggtggtgggcacctgtaatcccagctacttgggaggctgaggcagggagaatcacttgaacctgggggggcagaggttgcagtgagccaagatagtgccactgtactaccgcctgggcgacagagcaagactttgtctcaaaaaaaaaaaaaaaagaaaatatttgactttctttttaaaatgtatatggtttacaaataaagtttacaaatgcttttacactcc

SEQ ID NO: 4655 - DNA, 18202 bp, Homo sapiens
acaaacgtattgtattttagacacattacaaccaggagaacaaactggaagctctataggtatgttctgaccattaaaatatctggacagtgttaaaaaaaaaatcaggagtttaacataaagctagttttccgccttgccctgaaaacctggatgatctggactctttgggtctctgttcccagatggtccccagcaggcagagccaggagggtggcccatcaggagtggcacggtccttccactgggcacatcccctccccaggccactgtactccttcattacctgcatggcccctgaagacactggagttgatgacttcctggagtggataaaatgggcttttgtgagctagcctgggaaccaagcagtatgtttgatattatttcattgcaaaagtggatctcagcttttaaagtaagcagatgttttaaatatcagcaatgcaaatttgggaatacttagcctcagctggaatgtgtgtgttctccatgatggactgtttctgatgcttttcctgtgctgtatcttggcttagcacttagtaggtacttaataaatgatttacctcaggtggtaaccaagcgcctgttgtccaccagctcccagggagtgaacagaaatgccatcttgctgtggactgggcctgtcagttccacctgagaccagatcgctgccagatttatctagaacatccactctagctctagataacagagattggaatgtgtcctctgcacagcttccctgtctggagagcgaggtaaagacctagaccccgtcgagttggccctaaagaggaaacaggacagggaggccggcatgaagccggcatgaagactgcttttctggctgttgcctgccgaactggagtttgtggccggtacacagtgcttgcattccacaccctgaacaagggcgggtcaaagttcagctcattcccctttaaagaaaaaaattctttgtctttggcatttcgaagttttgacccagatcagtcggaggccacggaatgctcatgaagtctggagagtttgtttagttcctgagtccggtagctgccgaggagccaaagagagccggcaacctgttgggcttgagctgaagccttgccttttcaagtttgtgctggcctggcctccccaagcctctgaggaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtaagtattcatctgcattcttttacattcctttatttcttcgaacatcagaaatgggtagatgtttattgagcccagccacctgctatgccttctccattcttctcccacacaccccacccttagtcctccagaagagaggactagattgattttctcatgctactggatagctgcagagaagctagaatttgctgttcagcccccacacatccccctcacatttgggagaagttgattttccctaaaatggagccaacagcctgtgtccctcagtgtggagtgttaatgggctgcctggaaggaccctgtgtgccctcacggcccccagccgggaagtgaggctccccattggctggcagtgggaggatggtccttgccagcacctagcatggttctctgccaagttctagctccacatctccaggctggtaggaacctagactatatatagcattgtgctaagcaattcttatcagacgtgtctgccctcccctgtgggagtggagcacttctatcagagaaccagaacctagagagcatgagccatctccaagggccttttattctgggaaggggtgtgtgtgtgtgtgtgtgtgtgtgtgtgtgtgtgtgtgtgtgtgtctgtctgtctggttcagggctgcttactttcctcctgtattgcagatgctgatagattgaaaggtcgtgctagatgaaggtgctgatgtgggatgagggccaggaagggctaatagctctgcgatggatattgagcttagagggagagaagctaggggcatgtgacatggctgagggtacagttgagccctgcctccgctttctcttcctggtttcctgtttgccatgctttgcctaaggatgtcttttgacctctctcttccttctttcggacctcttgcattccctgccttcctccaccacttcctcctccctttgattttctttaggatatatgagggcaaacacagtgactggcatcctgggtctgtgtctactcttcatccttacccatttggggtttctggagatctggctccagttgggcagagagggctcagctgtcctctggaggagttttggtggtgggtgagcatgttgtgttggctggttcagggcagggtgggttggatattcccctctttcctctcataggtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggaggtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatcatgtctgtgtttttcatctattatttcccattcataattctgtgatgataagaagtgggtcctgaaaaattaattggctgtgcagatcttgcctacttcataaagaatttgaagtaggttacagccagccagacattaaaaatgaagcccattaagagaagaatgaaattctatgagccaagaaataaaatgagagaaaagattagggaagagaagaaatgttgaagatcaaggctgagggatgctccctactgaatgggaaaactccttagttccacatgggctgtagacacagcccttctgccagcaactgttcctgcaaggaactggtgctcaactaaacatactgtcacatggttccttgaaggggcacagcactgatttcacttgcattataaaagattgagtggtgcttttgactattagtttatgtcaacacttcaaaacaagatgagccagtttttttttgttttttttttttgtttgtttgtttgttttagacggagtctcaccctgtcacccaggctggagtgcaatggcactgtccccgctcactgcaacctccgcctcccgggttcaagcaattctgcctcagccttccgagtagctgggattacaggcgtggcacctccacgcccagctaatttctgtattttgtagtagagacggggtttcatcatgttggccaggcttgtctcgaactgctgaccccgtgatccacccacctcagcctcccaaagtgctgggattacaggcgtgaaccacctcgcctggcccagtgagccagttttgtaaagctattcagagattagccagatttgatttgataggggatcaagcttgtaggatcttcaggaaggcgggctgtggccccttgatcaggctttttgcacaggaggtgcatgactatgaactaccctcagtagaactcttttaagccagtggcttgcaataaatgatggcaaatcagccacctaggaagccatttctaagcccaaccccctgccacagtcttcctctagatggctgccctgcccagtgggctgagagtggggggcggaagtagcatttgctgggaagacttgccagtacatatgttgcaccccctcactgcagctgcagtgctatttcaggctgttgatggaagaacccatgttctaatccccaggatgtggtgggaagaccctaagtggtggtgttagttaagaccctaagttatattgttttgttcacttcccactgagataggctacaatagtattaaatacctataggtcagacatttttggggtctgttgtactacctaccaattaaacagtttttgatccgcccaccacgctcaaagctccagcctaggtgttgcaaatacagacgacagatttttgctctcaggaggccctgattccagtcctcaaacgaggctgtccgtctcccagatgctgctcttcagggctcctggcgccagtgctgaggtgacagagc

SEQ ID NO: 4656 - DNA, 259 bp, Homo sapiens
agagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccac

SEQ ID NO: 4657 - DNA, 5964 bp, Homo sapiens
acatgctttgcccagctcagcctacatgccctctcccgatgtcagttaccaggctttgctaataaaacgtctctcccggctcttccagagagccagccgcagagtctctgccgtctccccgtgcgctcaagcacaagcccccaactaaaagccttgtctggaaaatctgcttggtgccataacagattatctggtgagccaggtaggagcacaaggagtaatttccctccctgcaggggaggcttgtgagcctgcgagccggagggaggccccactgattcagcgctgccaccgcgactggcgagttttcctctagtctcgcgactggacactggtcagtagaacctggacctgctgtaaggctgaagaagaaaaagaaaccatccaagctggcactcggttttggggagttctcttcactgctcacgccggccctcttgtgtgacctgtactgttgtgctgtgtggggctgggagccaactctcttttcgtcgcctgacacctgtgcttgcaccctgcccctggtcctttaataagacaagcagacacaggggctacagtcatgggcaatgccccaggcatcttccaagactcacacctgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtctcagctactcagaaggctaaagtgaggatcgcttaagtccaggaggttgaggctgcagtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatctcctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagcggacctccacagcctcaggccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggaaattacagaaaatttggaggccagaccccagaccctgctgttgactttggcagaggcggcttttaaggttttcaataacggacaggacacagatggcaggtaagaagaggagactgaccaagacagcacagcttctggctgccctaattcatccaccatctcagggtgaccctaggattctcaggagaccaactaatcgaagacagccaaccttggatggagccaatgtgcctactgcaggatggagggggtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcaggtaggaaaacagttcctcgtggacagcagagctgcctgctcggtcctgacccagcctatttgcctcctctccaattgcaattgcagggtaatgggaatagacaggtgtcctaaggtaagaaaatttactttccctcttgcttgtgaggccatgtctaggcttttttctcctcatttctgtatgccccccggaatgtcctactccattgctgggtagagacttattaagcaaaatgggagccaccatctccctggaagaggacagactgcaggtagaggcagagccagaacagggaatccacctgctagcactcttaaatggacaggaacttgagacccaaaacatacccaaagaaagcaaggatcacatcaccccttccctatcggacacttcagtcctaggacaggctaataaagttccgccagtaaagacagacctgaagcctgggatgggctatccatggaggaaatcatacctcctaaaacctgtggcactgaatggggttcagccattactccacaaattcctatagcaagggctaaaccctgccagtccccaggcaacacctcggtcctccctgttaaaaagcctaatggagaatatcagtttgtgtaggacttgaagggggttaatgaggcagtcattcccatccacccaacactggtcccaagcttgtctgtgctcagatacctggagatgctcagtttttcactctactacacttcaaggatgctttcttttgtgtagccctctccacccagaatccctgtatctttttgctttgaatggagaaatctctgatacccagaaagccacatagtacacatggactgtgcttccccagggcttctgggaaggcccccacctttttgggaatgcagggagctaagcctacagaatgggacttttattacaatatgtggatgacttgttcattgtcagccaaacatggcaggattcagattttaatatcattaaaaccttgaatttcctggctgagcggtgatacaaggtcagccccatccaaggcccagatttctttacagaagttccgatatctggggttcattctgaccccaggagcccgaacactagttgtggactggaaaaagcaatcacttcattgctggtcccacaaacaaaaaggcagccccagggtttcttgggaatggtgggcttctgtagtatttggattccaaattatggcctgacggctaaacccctatgtgagacccaaaagggggaagaaagagagcccttgtactgggagaagaaatgtcaacaatcttttgaacctctaaaaactgagctgggtcaagcccttgtccttggactccctgagaaaaaccacttaccttgtatgtttgtgagagactaggaatagctttgggagtcttaactcaaaggttaggacctgttcagaagccagtggctcatttttcgaaacagacaaatccagttgcacagaagcggcctggctgctggagggcagtggcagccactgccctgctgtttagtgaagcatctaagctgacacagggacaatatacagaagctatgactccccaccaggttcagactgggttagaagtcaagggacaccattggctcactgcagggaggctgaccaactaccaagctctcttattagacaccctggatattactttaagggtatgtcagactttgaacacagcaacctcactcccaaccacagatgatgaggactcacagcatcaatgcacagggcccacaaaacagactccagcaggcctagcttgtgagataagcctcttgagaatgcaaagacggaatgatatcctgatggcagtagctttgtggagggagacccaaaaggcaggacatgcagtagtaagcctgaaggagactacagaaactaaagcccttcctccccaaaatggcacaaaaagcagcactagaggccttaacagagcctcacaactgggagaaagggagggagtaaatttatacaccaactcaaagtataggtttctcctgctgtgtgcccatgcagccatatggaaggaaaagggaatgttaacagttaaaaattccccaggcaaacgtaaggatccaatccaacttctcctggaagcggcacaacttccctgccaggtggcagtcattcactgcaaaggccaccagagggactggtccctcatcagccaaggaaatagggccacaaaacaggcaacctggttataggaatccagcaatgtgttggccttaatgacagaccctaccaaccttcctaatcacctacaatactcacaacaagagcaagaggaagctaaggggcaggggtaccaggaaaacagtgctggatggttcacagatggtgacaagttttattccaggaactgaccagttgaaagttactaagcatctccatgatgccactcattaatggagacatgttttatggaattctgtccataaaatattcaccagaaagaaactaagaaaaagtgtaaaacaagtaacctttgtcagtgaattgtgttcccgaaataatccccacacccatccaattcccccttcttgacttaaactggttcaacacaggggaacttatctgggagaagactggcaggttgttttaacccaaatgactccaaatctagggtacaaatatctcctggtgtttgtggatacttttactggacgggtcaagggtttccctacctgtacagaaaaagcagtagaagtctgtaaaccttcactaaaggaagtaatttctcaatttggactccccaagtcccctcagagtggtaacaggctctccttcatgggtaagattactcagagcctctccacaaccttaggaatagattatgaactggcaccccaatcatcagggaaagttaagatgaaccatacacttgagacgactctagccaaactctttcaggagacgcacgagtcctgggttaagatgctcccagtcttctcagggtccgcagggccccttcgtgcagcctaagacttagttcttctcagatgatctaccagaggcctttcctcaccactgacctcctgttaggtgaagaattacataaaaaattacagtatcgatttaggacagattcaaaaggtgacttcagaatatggaaacaaaatcctgccagtccccactaaggatgggaaaacccctttacaagttaatccaggggaccaagtcctcctaaaggcttgaagggcaggctccccggaggaccaccccttgcttaaatgggagggcccttactgggtgatcctgaccactccaactgcagccaactcacaaggaatcactagctgggtacacctctcccgatcagaaatgctttctcctaaatgtttccagactcgcccagatggcccattttactcctgaaaacctgtggaagacctcaaattcaggagagccaattcatcatcggagaagtaatgtggttagagatcttgagtccaatacttttccttgtattactaattggtttactattattctgttgctttgctcagcctcctccctcaggtaaagacttcgtttgtccctgctgggtataaagatgctactctttactttgttcctactcctccccatcagggcacagggtaggctaggcctactaaaatgag

SEQ ID NO: 4658 - DNA, 2224 bp, Homo sapiens
gcttagatcagggaacatccgaggcaggcgggtgccttcgcagctccagtccttcctcagccttgcaacagcctcctgctcttcccagtgcatcccctctgggcagcaggctcaggcacgacgcaggggtgtctggcagggccagggccactgatgctgctgctggccaggactgaaaaatgcagactgcaggcaacataagcaagcaggacaaccccgctcagattgtgtgtgtgtgtaaagtttgatggaactgcacgggctgggggcgtctggggaagtatctataagtggcaatcggctgagcagctgggaggaacttcagagaagagacagaatattaagagccaccacctcccacagccatctatgcagttcctcagtgctccccgcaccctctgcagcctggaaggcccaggacgatgagggcaccatctccaagcggccaggcctgggcccagcagggaggctgcaccgcacacgggcgtggcgtcagaagtcagatgcgtttcggtgtagttggtgagatggccacagggtcctccaccacaagccctgcggggaccagcacggaggaaggaacaggaactccggttagctttccgcacctatgcaagaaggctaagtgcccagcactggctgctgaaaacgcagcgaacacagaggagaaagtccccgcacatttctcagttctgcaacagtgaactggaatagacatgcaccggccccatctcacctgctaccctgggggataggcagacctcaacattcattcttcaagatgctcacaccactgaagaaagctcagagtgatttgggcaagacagcaaaagccaaggctacttgttgccagagacagggactgctgtggcatcgagccttcaagacctccttagacatgcagcccagctgaggagctgtcttcaaacccaggcagggccaagaagcagggcggctctggtggcagcagtgagggctcagatatcggggaaatctggaaggatggctggagccagaatgccacttagacataagtggatggcagtttcagcaggaactttgccaaatgactctcccttcaatggtcggggcttggtttcaagtgaatgctaccgttcaagtcgaggattccaggcagaaactgagaggaacatggtgttatctatttggcccctgtgtgcttgtggtcactgagtaaagacaaaatacatcttcaccactctgcaatttcttcctttcctcgagagcaatgaagatgaacttctttcctgatgaaggagctagcctgtgaatcttcagtgtgtggccaggccagagatgcatcctgtttccagaaaggcgatggaggaaccactctgggcattctgctgggataaggaatgagctacaagcctgggttcctgcagcacagcccaagagaagaggcacaggacagtcctcaggtgagctcttgcactctcagtgggaagccagaaagcagacagctcagagcgcctggagctccttggcagaggtggaatggtgagccttgaccaacgtcagaagatgggggagaaagaggctttccaatccttgatgccagcaagggaacaaagcccaggagcctgcagccagtgaagacgccctcagcacaccaggcgaggggagaggacaaggggaaactgcaggaaagccccccagtggctgaggcatgctcaccagggtcagcaggcagtcaggtttggcagaatcagctagtaaagggaaaagcaggctggatgtggcacttggtctttctgctacctgactcaaccttctcccccaacctctggttgttctttaaaacactggtgttcccaaaggctctgagccctctccctttccatccaggttttcctcaaatggctctgtgctcaagccttcaagccctgactcgctaaactaggacctctaaatctacatctctcggccgggcgtggtggcgcatgcctgtaatcccagcactttgggaggctgaggcaggaggatcgctttgagcccaagagttcaaaaccaggctgggtcacatggcaaaaccccatctccacaaaaacgcaaaacaattagctgggtgttggtggcacgctcctgtagtaccagagaggctgaggctggagaattgcttgaacccgggagacggacgctacagtgagcccagatcgcaccactgtactccagcctgggtgacagggtgagaccttgtctc

SEQ ID NO: 4659 - DNA, 4064 bp, Homo sapiens
gatttctccatcctgaacgtgcagcgggtcttcctgctctgtttcccaggctggagtgcaatggtaccatcatagctcactgcagccttaaacttccgggctcaagtgatcctcctgcctcggcctcccaatgcattgggattacaggtgtgagtccctgcgtctggccaggatgtatgtgagctttatttaggtttagcccctgccctagaatgcaagctcccccagagatctttgtctgcctgactcgatatgtatctcaaggacttagtgctcaatatatatctttgagtgggtgaaaaacaagcggtcttaaaaagaaaggaggtgagcccggggagataaggtcgcattcagtgccagtgcttggtcagccatgaccctgcaccatgcgagtgacattgggactggagcaaagggacacagcagagtggcccctggtgcccaggacccggcagagctctcggactggttgcaagccagcaatagtggctatgcccgtgtgggagacgcagcttgccttagacttcagcgggaaccaccatgtccggcacagccatttccatccttcccaggggtgcttacgtgatcctggcagtctcagtcaaacttccaaactcagcagggaatgtgtgtgcttgtcctccaatctcaacaccctgggatgcagtgtcaggtgcaggtcagagacagcagtggagacccgattcccagccctgggctggggcccccacaaggcctccagcatctccccatggcccagtttcctcatctgcaggacaggctctcttgagaatttggggggatgatagacccaaaagcattctggagccagaggcttctgccttcgtcgggggcatcagggagtgtcagtcatgaattcaccatgacttctgaccacctctgcctggactccctcacctcagtgctgcctaagctgggtaaccaccagcttcctgggccttcaccccgcagggccttcctctccagtgatgcgcctggaaagagggatttctctttgcaaaggtctctggaattgccaagttatggctttaagcatatgtagggaaactccctcccctttgcacttttggagtttttttccagccctcaatagaaatcaatacagtgaccaggctgcccttttcaccacactctcaggctcctgaggaccctggtggaagatggactaagcacatcctgggcatcggggacaggcaccggctcctcaagcgtggacagggacagggatggggcggggcagcgctgcaggaggtggggcctgggctgattttcttgctgtactactttcagtcactacgtacctgttatgggttgaactaggctccctgtattagtcagagttctctagagggacagaactaatggaatataaaaaaataaatatatacatatatatggaagtttactaagtatgaatttacaggatcacaaggtccacaataagcaatctgcagcctgaggagcaaggggagccagtgtgagtcccaaaacctgaagaacttggagtccaatgttcgagggcaggaagcatccagcacaggagaaagctgtaggctgggaggctaaaccagtctctcttttcacatttttcagcctgctttatattctagctttgctgacagctgattagatggtgcccacctagactgaaggtggatctgcctttccaagccactgactcaaatgttaatctcctttggcaacacctcacagacacacccaggatcagtactttgcatccttcaacccaatcaagttgacactcagtattaaccatcacacccctcaaatgtatatgttcaaatcctaacctcagaacctctgaatgtgaccttagttggaaatagggtctttgcagatgtaattaaagacgaggttgttttccagtagggtgggccctaatccaatatgactggtatccttataaaacaggaaaatttgtttgtttgtttgtttgtttgtttgtttaacttctattttaggttcaggggtccatgtgcaggtttgttacatgggtagattgtgtcatgggagtttagtgcacacattatttcatcactcgggtaataagcgtagtagccaatggatagctttttgctcctctccttcctcccaccctctacccttgagtaggctcaggtgtctcttgttctcttctttgtggccatgtgtgtttaatgtttagctcccactaataattgagaacatgtggtatttggttttctgttactagattagtttgcttaggattatggcctccagttccatccatgttcctgcaaaggacatgatctcattctttttgatggttgcatagtattccatagtgtatatgtaccacgcttttttatccagtctaccattgatggccatttaggttgattctatgtctttgctattgtaacggtgctgccatgaacattcgtctgcatgtgtctttgcggtagaatgatttctattcctttgggtacatacgctgtaatgggattgctgggtcgaatggtaatcctgtttaagttctttgaggagtcaccagactgctttccacatggctgaactaattcgcactcccaccagcagtgcagaagtgttccccaaaaggggacatttggacacagacacgcagaagcccactcctgcctcctcactcagcctggatttgtctcagtcgccctcgcttgcctctcacacgtgtgcaccctcacactgcttcagcatctgccggtcctccggcctttgctcttagagcagagattctcaacctttctccatttgggcttccctgagtggttccgtagttcatttatggtgcccgccacccaaaataaattcctggcagttctatttactaattaggtaggtccaaacaactcagtaatagtaggctgggtggtgtccaacagctgccttcgtgtatcactgggaaatcttaaagatcccacagtggcctgtgagtttgctgaaataccccaggtgcacagtttggggaacatagtcttatagatttgatgaattccctttttgcacctgtatatcactcacggggctgatctatgactggtgtgctagtccatttgtgtcacgatagaggtaaacctgagactgagtaacttacaaagaaaagaggtttagccgggcacagtggctcacgcctgtaatcccaacactttgggaggccaagtcgggtggatcacctgaggtcaggagttggagaccagcctgaccaacatggagaaacctcatctctactaaaaatacaagattagctgggcgtggtggtgcatgcttgtaatcccagctactagggcaggcagaggtccttctcagatgctttgggtcctgccattgaaagggaagaagagaagtcccttccctgggagagcctcagtgatccctgcacaagaccagccgtcttcctccgccccatattgttcagccctggcaccctgtgttgtgcgtggagtcccttgttttcctctatcttatcaggaaccagttctaggttcctaacctggtctgaccccggcaccctgtcctgttacacaagaaacccggatgctgatatatatatgtcccaacattgcccttccagagcctctccagctgtgactcactgttgacatggcaacccccaccccctggactcctcgctcaacccacaaagactatctcttgcgtactctgctctgaggtgttttaaaaagcgccaccataaacctgtaacacaagaatgaaacccagcaagaatcaggggacaggaaccaaggaacatgacatcacgtgagaactaagggccgctctgattgaccatagcatttggctctcagcctcccacggccaaggctaagggaggataggacaattgtctctctcactcttgaacaagagggagctcctggattcaccgggagagtaaatttgactagcttggacttctgcaaggtaatttgttgtgactgcatattaaggagactaatcttaacataatcttaacataatttctttatattaaggagattaaataaatccatggatatgtt

SEQ ID NO: 4660 - DNA, 2184 bp, Homo sapiens
gtgtggctcatgcctgtagttccagcactttgggaggccaagggaggcgaatcacttgaggtcatgagttcaagaacagcctggccaacatggtgaaaccccgtctctactaaaaatacagaaaagtagccgggtgtggtggcgcgtgcctgtaatcccagctactcgggaggctgaggcaggagaatcgcttgaacccaggaggcagaggttgcagtaagccaagatcacaccactgtactccagtctgggcaacagagcgagactccgtctaaaaaaaagaaaaaaacatatgccatagctcagatgttttactatcaaattaatgcattttatacaaatattccaagtctgaaggttttagttttatgtacccttgttggatagcatgacgtaaagtggctactgaaattaataggaaatgtgaatttaaaaattcttcctgtattggcccaaactctatatactatcaaatagtaggtacttaatacatatttgcagaaatgcctgcgtggatgactatctagcacattcattgggtgcagtaacctcagcgccacgtcttagcaggagccccagtaagctctttttttctatttgcattgtagcattgattgtttaatgttgatttgagtggaacatcctctcaaaagtaaggtaaccgattccttgctgcaataaaaaacattttcttggagatctccattttcaaatatttctttctcacatatacatacattctgccaactggaaatgagtccctttattaaaatgattgggagatacagtgataaatgtttgacaaaaaaattagtaaaatggttgggagggttaagggaattcagccatctaccctagaatgaattacttcagttagataatcactacttatctttttccctgtctgaaggatcacacaggggatgtgagagctttagttgtggccacagagtaataagtttggaatttggaacgtgcatctggagggaagatgagggaactggccatttaagggcagtaagaaccagaaaaggcaaaacagtaaagctatattttgactgactttgtaagttttcctagggcttggcttgacagggaaacagtgtgataagtgagaagagatttgttcagaattcagctttgccttttattttttgtaaaacataggttagtttacttcaccttcctgatccttggttacctcatttatgaaatgggtttgggaacagtacctaactcatagagtcattgcaaaaattaaataatagaattcatataatgtatctggcagtttaggtactcagtttttcaaaaaattgttaccttttatctgtttggaaggccaaaagccaatagtcttgattgctaaaattctggcgataagatctctctgcagtggtaagtgttcagcatgtaccttaatttcttaccacggttgtagttattgattgtatgccaaaaatatatgtccctgtagggcacagtaggtgtctaaaaaactatttattgaatgaaaactttgaaatgaccataatggtctgagcagctctgttttcagacactagcataggaagtgaagagagctttgtcattttatttttacctctttccacgcgtcagcctcatcctggctgggtcaggcctattttccaagtaattaatgttcacttcttgtttgtaaagcagagcaattcagtaagatgatgggaggaaataatttcatttctgggtactaattccagtagcagctgttttctgctaactgagaaatatgcctgtgctaacaactttacacttccagcaaaaacactggaaccatggtgcacactaagctgtctaaagacaaatgtgcggtgtttattttcttttaggaaacacagaaacattaattgggattgactcattctgtttctgcatgcatttctacttacttatttgatgattttcctagctaaacagccactttctgttatgtcagagggatatcttcatcacttctcttcatgaaatgtacccagagcttccctgattgaaacattttcaaaaatcaaaaacttgaataggtttgccttttgtctgagggtgtgtaggagaggggtgtgtaaaatgaagacatctgtgtatattgttaattgggaaaaacagtttacaaaatagtatatacaagttgaaccaacatatgtc

SEQ ID NO: 4661 - DNA, 11636 bp, Homo sapiens
acctctagccagggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaagcggatcctgttacagtgcaaagaagaaatggcaaacggataacagctactgtgcctagaagatggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttgaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattagacatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaagcctagagatattagcacaataattaaggcccaaggtaaaagcaacagcagcctgaaaatgcaaaagaccatacattttaatggtaagtcctccccaggaaggattaataaatctcaggaggaagatttattatctgtaaatccaggaggaagaaatcaagatgaaaactatcatatttataaatttgattgttgcaattttatagtttgacatagtgcaattgctttagatttgaaggggaacttactttagagtaagtcactcaatctcttttttggaaaggcaaatgccacacctgatcctcatcactcccttctcctttgtccatagcctggctttattctgccattaacacacacacacacacacacacacacacacacacaaattgggaagaggatttctcattttacagaaagtatgctgggctacacaggatattctatcaggtttcttccagctataaaattctgagactaaatatcaaattaaagaaagtactaattgtcagcgatgggggatgtactgctatttgcttctagtggtactcactgctcatttcctatattcactggtataaaaaaatttcaaacaccctcaaaaaagcctatactggtggtaccaggaaaacgctgaaaatcattactttctgtgtggtgtccagctcttttggttacatcatcacttcgaccattcacttttaaagaaaaacttttgtggaacaaaaatataaagatttattttttttcttggtggcttagcacagtggcctaatgtggctgaccatgtgcacctgttgtgtgagtcacttagacgtgctttgtttcttggtcacagttgatccctcaactcaagcatctcaccctcaaaatgtttgtttgggacccaagaggcaaaccttgagatgggttatttctttcaccttggattggctcatctgctgggagtggagccaagctgacatttcctttcctttttgtctgcctatcactacgtagaggcagcacataagagagggaaagccatgcgcgtggagtccagcacatcacccagaaggcagatgttctatctccattttactcattaaaacaaacaaaaccacacctggattgcctggtacttaaataaaatgcactatgatgattgaagaaaaatatcttatatttaaggaatagttttaatagcttacatctgtatttctattagcttccgtttctatttttaatatttgtataatattaaaagtaattttaaaaatgaactaatctttttacatctcttatgagaatttaatggagatatgatgtttgaagatcaaagatacgtggtatttgaaatcagaaaatgtgtttgcttttctacacagattacaaatatcatgcattatttcacaaactcttctcaaagtgttgattttaaaattagtaaaaggagggtatattcatatcacatcctggcatttttataggcaagattgagcagctataacctctaaagtgctttgatccctataagcctcaagaagagaatggtgcaatttgaattaataactacccattatagagcatttgtatcacagtattttccaaatactatcttatttaaccctacagcaatcctatgatatggggattatgtacacattacagatgagaacttgaggctcggagaaagtaaataacttacacaagatcacaaagcaagtgactgccagagccaggatcagaacccagtcaggcttcattaggagctctgctgaactctgtctagagaattctcaccacctgctgcaaaggctaaaagaaagggtcatattccacatgtagattttgagaaatatttgttatttttcttatgataaaggttatgcatacacactcacacacacacacacacacacacaactagaaattacagaaaagaaaaaagattagccagaatgtcaccacctaaagacagataatattttggtgttttcaaatattcttttatctatacttttttgaattattttattttaaaaataacttttactggttgcctgattatgaagtaataaatattcaccataaatattttgaaaaatataaaactgtctataaaagaaatttgaaatgattgctaatctcaaaatatagatacctgtcagtactttggcattttatcctccttgtggctgaggtcacatatcttgagactgaagcacaaaatttctataccatacagtttatagtttaggccacaacatcatttttaaaattgtttctttggtttttacttgatttgctgatgttttattttttagaaaattgcagatgtgatttttaggcagctgattggaatgttctggttgctctgaataggactagctactttgttttttactgaaggacaaatattattcctacacacataaaaaacctcaaagaatgagtaatgatactgtttaaatctgcccttataactccaaagaatgacttcaaattttctttcttccaaagcaacttttaaaagcctttccactgcacagtgaaagaaaaccacaaactccttgtttaataagtgggatcacgtgcttttaacacgaggaaaaggtcaatctgaagcaactgatatggaactgccagagtaggtacgtaaatttaggagttacatcaatttgggagggctgcagaaatgtggatcagattttaatcacactgaggaagtttctttgagcaaaagacgtgatggttgttctctagaacctttctgtcctgtccgttgctttgccaagggagctagaaaagaaataaacatttaagaacttaaaaggcttctggataaaactcagcttggtgcaacacattttagctatcacagctttactcccaagcttccacctttcctaggagcgcagtaaaaacctgagccaaagaaaccaaacaatagaactgaaattctttaaacttgagttcttgaggttatagtctttgtgcactccataaagtcaaagccctaaaaagatttttagaaaacaaaacacttgtatctgtatctatttccccaaacctctctacatttacttaccttttgcagactcatgctttctcttttccttgtgattgcatttggatagaatgaagacctctcctacagttctcaacttaaattctttcttttatttcttagctacgaaagaaaattcaaaaaattcaatgctctactttgtaactccctggacatagtgagtccattatgtacatcatgaggagggagtggagaaagtggaattcttatgtaaattcatacagctttggaaaatggtttagcagtacctactaaagctgagcatatgcaaaaccagtgacccaggaatgtcatgggtacataacctacaaaaatgtagacagatgcgctaaaagacatgtacaacatgttcactgcagcccagttcatcatcaccccaaagtggaaacatctcaagcgtccaccagctggaggctgcacaataaaactgtggtactttcgtcggtagaaacatgccacagcttgaacacacgctgaaaacataacgtcaagtgaaagaagccaggtcccaaaaaaagacatactgtatgattgtatttacattaagtcccaaaacaggtaaactgaattcatgcaatggaaagtcatgagagtagctactgcatctggggaggcaggtggtggagtgccagggaaggagcaccaggatggctcatggtgctatttttatgacttgatgtaggggataggtaataggtaggtccactttggaaaagttcatctagctgtgtatttgtgacttgcagtcttttctgcatgtgtcaattccagtaaaaagattacttgaaaatcaagtataatattattgtatttacaaagccctttctacgtagccagaaacagggttggtttcccaggtgactgagaggtcgtcaggagcttagtgagtggagggcaggggacaagtgtgttcattctctctccctctctctctgctgttctgtaaggtgacaagttaggcttactgccagtgtgaccttaaataagccatgcatgctttctgaatccttttttcttatttggtgagtgacgtgctagttaaaatggtgtctccagccctttcccgtcctcgctgctgtgattcaagccccctccttctctgtggggcttcctccgacctctcgatttcactgtcacctttctctcttcctctctctcctgcttcctccctgtccacccccatctctgtccccccagggccgagtttgttttatatctcttttggtatctcctctggttttctggcaccatgtcttacgtagagcaaataataatgctttaaaaaattctcgataaaggaaaaagttcagtaaagtgtgaatttcacattgtagtcagtggttaaatgcctcaaacacttaaaaagtagaatttatctcaacctgggcagaaggcagtccatgccaatttctaaatggaatccaatagcaagaatgcacaaagaacaagcaggagtggtgaggatttcctcactctgtccctcagaggtggcgcgtctcatctgtgaggtgaaagtgtcatcacgtcattgacataaagtataagtacagggaacataatcatctgggagattttaatttgagttaataagagatgagattttcaggctaaaagtcttggggctggacaaagaatatttaaaaggagggttggtggataaagaaactgtggtatatttatacgatggaagactacttggccataaaaaggaatgaattaacagcatttgcagtgacctggagattggagactattattctaagtgaagtaattcagaaatggaaaaccaaacatcatatgttctcactgatatgtgggagctaagctatgaggatgcaaaggcaaaagaatgatacaatggactttggggacttggggggaagggtagggggcggcgagacataaagactagaaatatggtgcaaagtatattgcttgggtgatgggtgtaccaaaatctcacaaatcaccactaaagaacttactcctgtaaccaaataccacctgtaccccaaaaacttatggaaaaataaataaaagagggttggatgataagaatttgtcatcttgttttctgaattgttcaattgtacttaattgtacttctttccttaaggagttgaaaatcttcctaaactgctggaggatacacctctgatagcttgagacaaatatcctcttgatcattgtttcaccatatttgtctttgctcatggagaaccattttgatccgtggtttagcctcccaggtgattgaacaataccggtgatctgaggcagaccctctgtgacggataacaggaaagaatattgattgaacatctactcaagaactgcaaaacagagattacctgacctaaagcatttatattgccaatcatgttggagagtccatgtggtgatttctgaaaacgagatgtgagaaagaagaggataatttaagtctagacctacagattgtgctgataaagtgatgaagaactacaatcttcttagtcatttcattgtataagtgcaataaaggattttgtgtctttcctggcaaacaacttgtgaccacagtgatggctccagcagaatggaaaagaccctttacctcacatctcagaagtaaagatgctgattatttgacatcgccattggaatctcaaaacagtgtaaagcatttgctaaaaagagtcactttctgagaaatgactcagaattcgacttacgtactagcagaacttattgcccataaaaggaaaggccacactttttgtgaaaacttaataatccctaggatgtaaaattatactgagttaaatcctagtcccatttttagtacaagaaactggaaaaaaataatccactctcaaatggtaagacaaattgagatattgctgaaaagcctcttgaccctgaaaagttctgaataataaactgataaaagcagcagcagcatctaacttgacaccagtcatgtcatttgtaagtaaggttggtaaatagtaatgaaattcaagcaatattttcagctatgaagagctgctcaaaccaagcaaaggccaagatctactttaaattttgtctacgtatctttaaacaaggcatctgtcttgggggcattgtgttagcatctgtaccggtaacacctcatccagggttggcttgataagaggcttcacattttttgtagaataagaaaaaaacctggcattgtcacaacacactgatttgttcatgcagtagtgcttggggtcaaaaactcttggaatgaccaggcagagtggctcacacctgtaatctctgcactttgggaggtcaaggtgggcggatcacttgaggtaaggagttcaagaccagcctggccaatagggtgaaaccccatctctcttttttttttaaattatactttaagttctagggtacatgtgcacaatgtgcaggtttgttacatatgtatacatgtgccatgttggtgtgctgcacccattaactcgtcatttacattagatatatcttctaatgttatcccttccccctccctcacgctgcgacaggccccggtgtgtgatgttccccttcctgtgtccaggtgttctctttgttcaattcccacctatgagtgagaacatgcagtgtttggttttctgtccttgcaatagtttgctcagaattttttaaaccccatctctactaaaaatacaaaaattagacaggtgtggtggcgggcacctatagtcccaggtacttgggaggctgaggcactagaatcacttgaaccaaggaggcggaggttggggtgagttgagatttcgccactgcactccagcctggacaacagagtgagactctgtctcaaaaaaaaaaaataaagaaaagaaagtaacaaaaggtttgaatgctcctgcaaatacagtcaaacagggataagttcaactgagatttttaaaattttgtgaaaagtcagataaagagacatcatcttctcctccaaacagaaatgtcatgactgtgcttgagggatactttcaagatgacacaaaaccaggtttttggagtgctttgaagatggagaatggcttattaacactagtcacattggcagatgtttttcataacatcaaccagttgaataagcctctgcacagccctggagaaaatgttttcaccaaaaatgtcaagagtttttggatttaaaagaaaactaaagttttggaaaaaaccatgaggcaaaagaaatccttgagatgtttccattgttgcttgggcctggggccatcagtaagtctcaattcttattgagcagaacctggcagcactgtagaatgaaactgaaccatacctaccctctctttaaacacaagtgcatgaccaggcgagggagcgtttcgttgaatctttgactcagtctgagaacagagtctggagagaagaggaagaatcctgcaccccatgcaaccccagactctctagatgggactcacatatcactctggaggcgagtcctgggtttctgggtaagagagtgctctgtcagcctcagggaaaccatgaacacttcactgcagttgcaacttcccgcacataggaacaaattttctgttatttaataaacaccaagagcaagggaaaaagttgtagcccttcagttgacaatgacatctgtgtgtacctcaagtttgactcagaattgaatttttaggcagcacatgtgtcacattaaagaaggtcaagttgatcaccaatgaccaatggtttaatcagtcacggcttcgtaaaaactaaaaaggacagaattcagagggcttgcagttagtggaacacgtggagggccctggagggtgtcatgcccaggacatgatagctctgtaccccatcccatgtatctcaccatatgcatctcttcatctgtgtcctttgcaacattctttagaataaaccagtaaatgtgtttccctgagtcctgtgggctgctcttgcaaattaatcaaacccagggagagtcgtggaaaccctgacttgatgccagttggtcagagttcaggaggcttggacttgcaactaggaggaaggagggggttggggactgagcctacaaccaatgggattggtcactatctccaggtagatagagttggaattcagttggaggacacccagctggtgtccactgcttggtggtgagaagaaactcccacacctttggtcacagaagtcttctgtgtttattgttctagtgtgagaacagaggagaagcctggtttgagtgagtttttcctgaagcaaaagggaagagcttaatttcaaaaggaatatcttgaaagacgcatcaactcaccattagaaaacatgaaacgacagattatatcctaagattgtgtgaacctcttacctggaaacccgtacaattgctttatctaccaatcctaaactattatatcttgatctttactcaatcctaattacacacccacattgaaagacctatcttaattcagacttcaaaatcttacaaacgtccaagtccctcctttgaaatgctactaagactgcagtaagaatacatagcatgcagtgactgagaggaagagagatactaacacttgaagtaatccagtctatcaataggagatggactgctttgatttaaagcgatttacaaaaggatttggatacctcatctctcctgtttcgccaaggtcttgactcatcgctgcaggttgtataattagtctcattaatctagcaaatgatggcaaaatgcttggtaatgatgtctaactggggttcctttccaaggaacctttgttgtttaattaggagataatggatgagcttgtagagagaccagggttataaaaggcagtagcatgtcaatgtgcccatgcctagttcaatacaatggtttttaagccaagtattcaaataaattgacattatgtaggtacatgaatttaaaaggggtcattattcactaactatattttaacatatgcttagagcaacccattactgctggggataataaacggtgcccagatgaacaaccacattgcatacaaaggatggtgtctgagatcactactgggcccgacttagccaccatctttccaaatagaatcataggtttggaaatttatcccttctatggatgaagcaccaaactattaaactgcaaaaccattctgtatttattctttccag

SEQ ID NO: 4662 - DNA, 2401 bp, Homo sapiens
gccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatataggtgagcttgggcatgccagtattgggtgcacgaacaaggacagcagggcttgggaacgaactccctcccgtcaccctccgaaagcgatacaccttctccccctcccaaacaaccccagtcccgtctccccgttcctctccccctcctcccccagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgggaattcctttatatggcggtgattaaacgagggagggacagacagtgatctcgaagaaaaaagggggagaccaaagaataaaagaagggtttccccactaaaatgacacggcgattccggctcttgttttgggggtctttccccgaaatggtttccgtcttccccttgccccgcagcgacccagagcgctgggggaagcggagtggggagaggcagaggcggtctcggcagccaatcagcgcctgatgtgtcctgtcgggcgcgtcgtggttggctggcgatgacctcatcctgcagcagcgggtggggccaaagccgtagggggaggctgttgcaaaggtagagagggagaagtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctctttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgattcctgttctttatttcagttttctgtctgtacatcccttaagaatatagttttgtcggtgggattcgctcttttgtgcccaggctggagtgcagaggcgagatctcggcccactgcaacctccgcctccccgggttcaggcgagtctcctgcctcagcctcccaggtagctgggattacaggcgcccacaaccacaccctgctaattttttctatttttagtagagacggggtttcaccccattgaccaggctggtctcgaactctcgagatccgcccgtctcagcttcccaaagtgctgggattataggcatgagccaccgcgccgggcctgctttttttttttttttttttttttgcactgggcattagtaatacggaataaaagccgtgttttaaactgtattaagttgtaagacttttcagtactttcaagtctgctttctttctgttgcccttttgtagtttttaaaaataaaagatgcaattataagcacttccggtgaatattattccttaagg

SEQ ID NO: 4663 - DNA, 1785 bp, Homo sapiens
ccagaaggaagaaactccgaacacatccgaacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggtgagaccatcacctatagctgagcggcgagaccatcacctatcaccaagcaaatcaaggccatcaagctacagatgggcttacaaatggaacccaaaatgagttcaactaacaacttctaccaagggcccctggaccgacccactggcacttcccctggcctagagttcccctctgaaggacactacaactgcaaggccccttcttcaccccatccagcaggaagtagctagagcggtcatcggccaaattcccaacagcagttggggtgtcctgtttagaggggggattgagaggtgacagcatgctggcagtcctcagccctcactcactcttggcacctcctctgcccgggctcccactttggtggcacttgaggagcgcttcagcccaccgctgcactgtgggagcccctttctgggctggccaaggccagagccggctccctcagcttccagggaggtgtggagggagaggctcaagcgggaactggggctgcgtgcggcgcttgcgggccagctggagttccgggcgggcgtgggcttggcgggccctgcactcagagcagccagccggccctgccggccccgggcagtgaggggcttagtacctgggccagcagctgtgaagggtgtactgggtcccccagcagtgccagcccaccggcgctgcactcgatttctcaccgggccttagccgccttcccatggggcagggcttgggacctgcagcccgccatgcctgagcctcccacaccccctccatgggctcctgtgcggcccgagcctcctcgacgagcgccaccccctgctccacggcacccagtcccatcgaccacccaagggctgaggagtgcgggcgcacgcaggggactggcaggcagctccacctgcagccccggtgcgggattcaccgggtgaagccagctgggctcctgaatctggtggggctttggagaacctttacaatccctgagctagacataaatacaccaatcggcactctgtatctagctcaaggtttgtaaacacaccagtcagcaccctgtgtctagctcagggtttgtgagtgcaccaattgacactctgtatctagctgctctggtggggccgtgaagaacctttatgtctagctcagggattgtaaatacaccaatcggcactctgtatctagctcaaggtttgtaaacacaccaatcagcaccctgtgtctagctcagggtttgtgagtgcaccaatggacactctgtatctatctgctctggtggggccttggagaacctttgtgtggatactctgtatctaatctgatggggacgtggagaacctttgtatccagctcagggattgtaaacgcaccaatcagcgccctgtcaaaacagaccactgggctctaccaatcagcaggacgtgggtggggccagataagagaatgaaaccaggctgccccagccagcagtggcaacccgcttgggtccccttccacactgtggaagctttgttcttttgctctttgcaataaatcttgctactgctcactctttgggtccatgctgcttttatgagctgtaac

SEQ ID NO: 4664 - DNA, 3540 bp, Homo sapiens
gcggggttggagggactcagctacgcgcctggggaggccgcgggccctcgcagactaccgaacttccattctgccgccgggttttcacacctgccggccccgaggaaacaatgacgttgggattttggggggccgccccttgactcgggcgaatgggacacgaacggcgaccccttgctctcttccatccgcctgccgccgttgctgcccaccgactcctacagctcatttctcgctcctgcaggctccaggaatgcaaataatttctcactgggttttggcgggggcgcggagctgcggcgaagcgcgcgcccgacagctttcgccgcagctgggtccccgggcgctggcggctgcggcccccagatacgggcggaggctgcaatatgcacatgcggccacagtgtggcgccaggggcccgccgcgggacacgctcggagcgcgacgccccatcccatcatttacggatcaaaccaaataatctagaatcaagttgctgtgtgtgtcatactcctcctgttttttttccctaaacttttagtagagtcatttacatagttcagtttttacctcagctgttacacagtggcaggaaaatattttgtctccaaactacagcccaagtatgagagcagcgtatcctgaagctaattagtaaccagaaaatcaggaaggtaaagcaaatctctggaggcaagatctggactctatgatatcgccgcttctccccacttgaagcgtctctttgcagtgccgcacttggagatttggacttaatcgttaaacaaaaagaacagttacattctgccttcctacagggcaggggcctaggactggcagcatttttgttgtctctagaaatagaggggttatgagagagcctcaaaagagagggcaagaataacacatccatttctcatcatgagttacccccttgtatgcctagaacgcgtatggagacattctcttttagtaaagtcaaagagaaaagccatgaactaagtatcctgaacacagaggcgtgagccctctcagtctcacagtcccttaggagtcatttatctcagaagttggttgaaacaaaaacagttcatacagcatggtaggcagaattctaaaatgatcccaatgactcactcccttgcataatccccttgagtgtgggtggaacctatgacttgcttctagccaacagaatatgacaagggtgatgaaatgtcactcttgggattgctacattatgtaagactctatcttagcagtctggatggaaagtctcctcctgaacttgaagaggtaagctgccacgccaggagagggcctacaagagtgccacaaggcaagggcctctaggagctgagagtggccccccactgatgggcagcaagaaagcaggaacctcagtcctacaaccacaaagaactgaattctgccagtgaccttgtgagcctggaagagctgcaaaaagaaacacagcaaagtcaacaccctaactgcagccttggaagactctcagcagagcactcagctaagctgtgatgggagtcctgacccatggaaactggaagatcttaaatgtatgttgttgctaaatttgttacacagcaatagaaaacaaatacactccaactcttgacaaatttgttaataggaccacgcatcctgagacaaacacacagaagggcaaacatccagatataaacatcctactacattgatatgaatactcacatatgtaagatcaatgatatcactagcaaaacaagctccaagtcaatgggtttttcctttcgacaaacacctctacacataaccaaaaatgcttcaactacttttcttttctccagaggcagttggtttggctaagtaaaaatggggttcttaggagactaaggcggaaaagagacaatagtgcctttttcccctccagaacttatctaagaatggaaggcaggtgtttctatgctatacatagcatgaattttacagtcatggatactgatataatgcttccaaatagaattaattctcttccctcccttattcccacccacagccagcagatgctgaaagactgcactgtccaaacactgccatctttgctttatatatccaaaagagtgggaaatgctgtcacatctccatcagaaactgtcaaacactagtaatggtagaaaatatctgaatgacacaattaataggcttgattttgtggatgctctactttagaaagaaaattcatatgcttttcaaacacacatgcaatattagaaaaattaagtgtgaactaggccacaaagcaattttcaacaaatactaatgaactgataccatgtttaacacaaattctaaccaaagtgctataacattagaaatcaataacaaaaaactaccctccaaaaaacatctaagtaattcatgaataaaataatgtataacagaaatttatgagttttaaacttaaatggtaatggtagtattatatatcaaaactcacgagatgcagcttttagcagacattactaatttcctactcaacaatcattcccctaccttcatgactttggtgtcagccatatgattagggctcgggtccaccaaccagctgcattttcttggtcttagcatatactgattaaattgaaatgactaagagtcagtgagctgcaattgaattccccatggctgactgtggcggaacattttaaaatagggcatagacagcaccaaccaaaaatgttggtgtattgtactgtagtaaaattaacaagtcttgttcattgaaaacaaacaaaactttaatattatagtgaaaagaaaagccacagagtgggagaagatatttaagacacttgaaaaaggacttatatccagaatatataaataactcctataagtcagtaagaaaaagacagacaatagaaaaattatcaaaaagagcttacaaaaaaggatacccaaataggtaataaacgtgaaaaatggtcaatatcatagtcattagggaaatgcttaatttgcatttgtatatccaaaagagtgggaaattgtaacatacctccatcagatactgtcgaacattagtaatggtagaaaatatttgaaacatgtaaacaaaaatatccacagcattactatttgtaagtggtcaaaaccagaagcaacccgagcccctcagcagaatgggaaaatatgaaatatacagtaataagaacaaatgaacttcaatttacaacatgtatactgttcacaatcataatgttgagaaaaataaaccagacacaaaagagtacatcctgtcccataccgtagccctttatatgaagttcaaaaataggcaaaaaacctatggtgctggaagtcagtgtcaggggtggactagaaatgggcaagaaggagtttctgaggtgctggaaatgtctaaaatagatctggatgctgtttactttgaaaaaatttactgtggcgtacatttatggcttgttgtacataagttatatttcaatgaaaattcacattaaaatgtaatgtaaaaaaga

SEQ ID NO: 4665 - DNA, 3309 bp, Homo sapiens
ttggctggtgcacctaaataatacatatatcctcctcaaccccatcggtctctctgattcctaaatcatccccaaacatttctggtggcccatatggggattggagataacagatttactgtctcctttgcccatgggactagggccctggggctgtggaagacctggcatccaaggcatgccatgggggagtttcacccggatggagactggctctccccgcatcctgcccagcagtgcaactgaacctgagatggggctgcaggatgacaccagcacttcaggaaccgcgttgcaggtgtcacaccttggattcaccatagctggctgaaactagcagcagcagtgactcccgactatgaccagtggattaaccaacaagaccctgattgccccacccgaatagacctacggcgaatcccaaccaccagtaagaaggacaactgccctgctctgaccacactggaggctggtcagtctacacatggctgaagcttgaagatcttgcaagctctgctctagtcacatcctggaagctgactagtctacacacagccgaagctaagaggaccatctctagataagtaaatgtagataaaatttataagcctagttataattgttctgttgttacattattactgcaaatgctgcaaatgtccatgcccagaggaaggtttgccattcctatgtgtagtgtaagcatgtttctattacatacactaatgttgttaccatttctgcctatactagaaggggagaaatctctagaaggatgcccacactgtgtacatactacctgggtaaggaataccatagttaaaactctactgtaccatacctacagtacaggaaccaagttaggaacctgcacatacaaccagaccacctattcggtctgtgacccaggaaataatcagctatatgtatgttatgaccctaagctcttaccctatgaattctggtttgaaatacatattaaatcagagggagaaaaagaaggagagttatagctcgaacaaaagaagcccctccctcctgtaaagggcctatttccttgtactttgatgcctgctatgctgcatatgttcacaatcctaaaaaaaaacagaagcagtctgcaatggtgtaacacaagagaggcttagcaggagcagccctaagcatctgtacaaagaaccacaaatcggatgcccagactgtaacattcagtggtccacactaacacaactccaatatttatattcaggaaggagtgctctgctaagtagtatgttaaccaaaccaaactgtaagacaagaacatgcaatcctttacattttactatcttaaagccagagatacctttctggtctacaggacagacagcactataacgacttgatagactaggagcaggccttggagttccactactaattgtcaaaaagactaaaaggactcaaatgcatccaaccccgcaattctgggtccataatcattctataagcatttggataagccagtgcctgagcttcccccaccaaccaaaaacttatttgctcaactagctgaaaacatagctggcagcttaggaatttcctcatgctatgtacgtggaggaactaatatggggaaccagtggccatgggaggcaaaggaattaatgccacaagataacttcacttcgcttaaccctgccagtgaaccaacagcctcagccagtgtttggttgttaaaaacctccataattggaaagtaccgtatcgcccgttggggaaaggctttcacagaggcagtaggagaaataacctgcctagggcaacagtattatgatgagactaaaaacaaaactctatggagaagcacccagaattactcctacttaccagatccaaatcctttatctccattctctaccctaagccacacttggcatcaactagaggttccaaatgcttcgaaagcaccctctggcctatattggatctgtggagcatgggcatattggcaactgccagctaaatggacaggagcatgtgtgtagtaacaatcaagccattcttctttctaattcctctaaagcaaggggaactcttatggtatccagttgatgatgaaaataaaagaagaactagaagagcataatcacaaaaatagacacaaatgtcaaaaaggatgtggacataggagactggaaagataatgaatggcctcctgaaagaataattaaatattattggccagctacctgggtgcaagatgggtcatggggttaccacaccccaatctatatgctcaactgcatcataaggttgcaggcagtctttgaaattataaccaatgaaacatcaagggcactagatttattggcaatacaagcaacacaaatgagaaatgctatatattgaaatagattggcattagattatcacttagcctctgaaggaagagtatgtggaaaatttaatttaaccaactgttgcctagaaattgctaataatggccgggttgtcatggaaatcagagctagaatgcacaagttggcccatgttccaattcagacttggtcctaatggtccctggattctttgtttggaggatggttctcaacctttggaggattcaaaaccctcactggtgggtttttgtttattcttggcatctgcctcatcctcccttaccttttacccctgtttattaggaggattcagtcaactatagaggcagtaataactcaacacactaccgcacagttgatggcattaaccaaatatcagccactgccagtagaagaagctcagctctgtgaagaggtggcaaatagtggtgctttctattaacacctttgttataaaaagcaacaaaggggggaaatggaacaggaattaaaagaaattaaagaatgcataagcaaaaactcaattgtatgtagggaaacccaattcctcctgaggaagagaaagaggtggagtcctttaaaaattcactgcctgtttttccgtctgtagctagtgagccttatctctccctttcccaggcattgtgaagaccctgtttctccagctgtgcagctgcatggtcactagacagataaactcaagttgtaaaacatgtttttccttgaaaagtaagaaatgatgtaatacatgtctcaactgaataactgtctttgtttctcacttctgtagtaagcttccccctgcacagatctcccctctcaccccatgaaatgcttaaaaggtaacctgactctttgttcagggctcagtcctttggatgttaatctgactgggctggtgcacctaaataataaatacatcctcctc

SEQ ID NO: 4666 - DNA, 33112 bp, Homo sapiens
ggatttgccgccgcgcttgggaagccgccaccgccgccgctgctgcatggcactaggctcccggcggggcaggttccgcagccggcaccgctctggctaggcgcacggaggcgccttgcttagtctgacccttatttggccaggcgtaaaacttgtcctgcctaaaagcctactgagacctcctaactggtctaatccgcgggagacgccaaaggcggcggccgtttgtgcgcacaggatttttcttggagctgtagcagtctaggaagccagggtggaacttttgctaagctcccgttgtaagcccagagctgtaataactgctgagacacaaccagcagtatacaggctccagttggaaatcgagaactttccagggctgtcacccaggctggagtgcagtggtgccatcacagctcactgcagcctcgacctcctaggctaaagtgatcctcccaactcagcctcccgtagctgggactacaggaatgtgccacgcccaggcaccatcccctgcagctgtctccccagcggctccctctcttgctggacaggcctaccatgaaatcagccctgggatctgacaatactacctcctcctgccacctacttaaaagtgtaatagtttcctgtggttgcttctctggggaagaatttcccctggattcttctcagtttttccatcacctgtgcaacagattccttgtatcacattctttgtttgaagaaataagtgtggtttctgtttttctagttgaattcagcagatttatccattttgtgttttcgtaagggtcttaccctgcttaggggagaaggaatgattttcacaggaaagcagtcacattcagtttaggaatctgcctgtgcttcccccgatggctttagtaatgtcattattttttccacctcttactccccatgcttgctcctcacctcccatacccaacctgtgtctctcctgcttcctccattcttagagcatatgacacctatcttctggggtcacatccccagaggtacacaatgatttgtttttgtttatttttaaatttcttttcatatagtgtccttaacaagaatgtcactgctgtaggataggatagcaaaagagcactgggtttttcattcagaatgtgaatcagtgtggcttgtttgaatcctatagccttgtcctgcacaacagtgcccttgatagcagaacaggaaaaaagataatttcaccacaaatctatgaggagaaaatgagatgaaacatatgaaaggattgtgcaaaagataaaaggctaaaagaaaataaaaagaaaaggccaggtatggtgtttcatgcctataatcccagcattgtgggagcccaaggcaggaggatcacttgagcccaggagttcaatatcagcctgggcagcatagagaggtcctgtctgtatttaaaaaaaattttttttaacgataaaatgctaagcaaataagaagttattattttgaaatagtaaataagcctaaattagttgttttccttgaaacaattgtaattttaaaagttaccacaaaggtatttctcaactagaatttatacagaagcttaacaacatcacagtcttgatttaacacatgatttctcaatctcagttctattgacctttgaggttggataattctttgttgtagggagctgtcttgtgcattgtaagatttttggtggcatctctaccagtagcacccacctgtctagttataacaaaacatttctcaacattgccaaatgtcccctaggaaaaaaaaaaaaagagacaaaaccgccccaaattgaaaaccactgatttaacaaaacctacttggaaagatgtgccttctttttgatataagttgttaaaacaaacaataattaaaagaagtctggcttttcatagattatttgggaaaaatcttttaaaaatgcagttcagtcataaaatataaccttaaagatccaaaaaccctacagtgaaagtcagtggtgattgtcacagcagtagtgtgtgttactaagtatttacgttggagaagctaatcttcctgttaagtattgtggtcggactacctaaccaagatgtcctttcttcttcatacaattaataacattgttatttttactaggtgttaaaaaaaaacacactaacactttatatctgactactgtatgttgaaatcctttgatgtcctttaaaaggcaaggtaactcagattgaatattagtaggaacatatatttcactcttgactcatatattctgggtttgtacttgtatggactaccttgagtagctgcaggacttagaattttatgagcatcacagctaagtcatggtctgtagaatcattcatatttcaattcctaatatggtagtcttagctaccatttaatttctagagaactggaaaccaaagtataactatgtaaagtctagaaattattgtatttaaaatattgattccaggtctccaaatatgtctcttctagcttatatcaataggtttctaaaaccagtttttcatctccactgtgtcagttagctttcttcccagctaaagaaaatattgaccaaagcaagttgcaaaacaggtgaaactggttgtagtaaaagagttactttttgctgggaagataaaagagatgtaactactgtccttgacatgagtatattgctaagctttgtggacaaacattctgagattggtaaaatacttactgcttcaggaaaattacacttatttcctcatctatgattttgcattctcctagttaatcttcttttgggggacagtgagcctcctttgaaggacttacgggcattaataataatatcactgtacaaaaattaataatatgtattgctcttttaaagatacttttgtacaagatattttaataaaacaatcttattcagtgctgcttattgtggttggtgaaaaataaataaataaaaactatcttataactgaggcgggtggtcagagttttggatgcagacagtgggattaagttcagtcagaaagttagggcacttttatttgccgtcatgcttttgaatttgaaggactttggaccaagcctgcctctccagttcactgtcatgttctcagttcatcacatattacatctggcctacgcttcacatctgtcaagcctctgtgcagacatttggatctgtaaactctgccaggacaaagcttgggctagcatcccatactataaatgactattcctcagtggaatattttgtttccaaaaaagaaatctatttgaggtatcagtgcttgccccatctgttttttaagatctgagaaacaactatgtaaatatacatagaaatgatttgagtcaaagctctcattctcatcataaataaggaaggaaaggcactgacgatgggccatttcagagtcctccctgctatctctgatttagaaaaaatatatgatcaaggtggagtaatagaactagatttaccctcctacctgtaacaactaaacaacaacaaaaacagacaaaagacatgaaacaatggtttttatgacactagatatcaagcaatggacatggtgattcttgaaatataggaaataaaatggatgagacctactattgccccagtttactaatttgagagagttttcaggtcatgacatgtggtaggagaacagaggtgaagcccagttatgattctgaattgaggcaacattgctgagagtccaggaagatcaacgcagtgagatttcttaggaaagagtgatagaggagagagagagctacacagagtaaagcctgggggtctgcagagggatctctgttaagtattcagaagagttttgatcatgactatgaagaaactacatgaggcctagaaaaggaccatctggaggaggtagagagaacatgtggccataacatacataggaccagaagtagtgtctgttcccactaccggccagattggaaaaactcataattcatagacactggataaagtactcaagaaggtcttgcctcagtggtgggaaataattagccctagcctgagaactgctctcaacctgccaaacaaatcataaaagcaacatctgaaaagatcaaactgtttccaagtaacttaacatcatacctgaacaaaactcaagaagatttatgagagttcaaaagtatccagcacccaacaaattcacaaagtatgcatgcaatcaaagattaccgggcatgcaaagaaaaagaaaaacatatctcataatggggagagcaaccagtcaatcaaaacagacccaaaattggcacagatgatataattagcagagagagacactaaaacaattattgtgactatgttccaaatgttcagaaagctaagtagagatggaatatatttttaaaagacccaaatctggttggaatttctggtgggaatataaaatggtgcagccactttagaaaagtctggcagttcctcaaattgctaaacatatagttactacatgacatagcaattctactcctaggacgtacccaagagaaatgaaaatattttcgcacaaaaactcatacatgaatgcttatagcagccttatctttaacagccgaaaggtagaaacaacccaaatgtctatcatctgataaacagataaaatatggtatatccataaaataattgaatatatttagtcatagaaaggaataaagcatggacagacactgcaaccttgcaaactgctaagcgaaagaaccagacacaaaggcccatgtattgtatgacttcacttgcatgaaatgtccagagtaggcaaattcatagagacagaaagaagatagtgattggcagggattgggagattggaaagtgactgctaataaaggtgaggtttctttgggaagtattgaaaatgttctggaattagatggtagtgatggttgtacaatcttttgaatacactgaataccactgaattgtatactttacatgggtaaatttatggtatgttaattatatcacaacaatgatggttaaaaatagatgcaatcagaatcaatttatctttctactaccatgttagttgtataaactatcttccatttcactccttctattctgtccctaacccatcccatctttccactaataaggttacacaaggttaccaatgacctgaatgtatctaattcattgtcagcctctgttcagtttttcctaaatctctcagcagcatcaaaatctctcaacattgcatccttttagtaacagcagcatcttctatagatttcatgaaatacactcacctagttttctcttaccagactttatagctgcatactcataatcttcacttaaatgtccagtaggtacctaaagcctaacatgtatatgacagaattcggatctacttgctgtaaccacatcctacaaatacgcattaggtaggcccatacctactcctgccctagtctttcccatgagagttaacacacaatcatatatccaggtgctcaggccaaaaactagggagttgtttaccatgttttattgctctctttccctaatcctaccacatcaaatccactggcaggtcttaatagttctgcctccaaaaatctatgtggaacctatctccattctccagttatttattcagaggttaaagaggagactggaatggtgcctgagggattagattctatctggtcttgtgaactgttacatgaacattcacctttattccgaataagatacagagttttgaccaaagtaataacatgatctgatttaagtcttaaaaggatcactctgacttctgtagtgaaattagactgtgggggaaaatgaaaatagggaacccaatcaggaggctattgaaattttaaagaaggattatggttcggactagaaagttgggggcaatggaggtgcaagtggtgactgagttctatttatacttttaatataaatagagccaaaaagatttgctgataaagtaaggatgtagagtgtgaaagagaaattaaatgatgccaggactttggtctgagcaaatggaatgatgagtatgccatttcctaagtagaagattattgagtgagcatgtttggataggaggatataaatttggtttttaaaatttccagttggaactatttatcaggtaccagatagagctatcaaaaaggatagtggatatataagtctggaatttagaggtgagatcaaactggataaataaattctggaattttcattttatatgtgatattgaaagccacagaaattaacaaaatcataatgtaagcagcatagatagagaaaagttcatgggcttagccctgggggccctccaatagttagaatcaaagagacaaggcaaaactagcaaagtaggttgtggtaaagtagccagtgaagtagaataaaaaccagttgagcatattatcattttcagataggcagaattgcagcatatttgactgctatgaagagggaaaaatttgggacgcaggtagagcaagatgaattgctagaattatatccttcagtggggaggaaagtataggattagaactagaagacatgttggtctggataggcacagggtgttcatttatagtaacagaaaagaaggcagtaggtgggcacagatgcagagatacaggtaggtatttggtaggagattctggaggttctcttatgaaggacagataagatcattgaagaagagaagagagaaagtcaaggaactgagaggccatggagttgaaaggatcatccacgtgaatattacaatcaccaagaactattataggaatagtgtttgataaaatgtcaatcagctaaaggctaaatctttaaggaataaggaggagtggtcaagggaaatacagtgaatcatagcaatatggtgggaaaatatgatattaaaagctggggttttaggggaagaagagaaaatgatctggaagcagtaaggagccccccactggcctagtggtatgtggcatctgagagaagatattggctctacttgagagggctacaggaaaagctgtgtttccaggggagagagaaagacacgtggaaatatggaaatgcatgtattaagtttttggctgtcacagtaactagtggaattctgtgtccaaagaagagacatgctaaacatcctgaaaggtaatggcaagattatatgacatggacatatgctacccaaatgccagtagcacccctgttaggaatctaaaagtagaaagaacattcagagaaaaggcttggattgattgtcttagttgaatttctccagaaacaaatcttgattgtaagtaatttattcagaagtactgggaaaaccagtaaaggaagagggaagtgatccagggaaaagaaggcagtcatccaatgcagtatcgagccaaggtactgccatgggcaactggagtttaaccttatgggaagctcaaatgaggaaatctgagaaaggagaaaaacacactcctcacagttatttaacctcaagagtgaggtagctgaagtgaatacacaccagcttctgagagtcattggtagaaggctgcagatctgatgaacatgagcagagcactgacagcctctgttataggatgtagaataaaggtttatctctaggataaattacaatgaggagaatcttctgggtctaagaataagtgcttgtgtgattttgatagatacctgcaaattgtccatcacagacagtatactaatttacattcaccccagaaatgtatgagaatatttctttctaccctccccaagtttatattctattaagctctcttctttttgctaatctttagtaaatatacatttcagtgtaattttcattttcatttatcttattaagagtgaaatcgaacagcttaacatatatttagcattttttatttccttttctgcaaactgcctgttaacattccttgttcattttactttcagttaccagtctttttcttactgatctgtagaaaagcaatatgaggttcaaatattttcccagtccgttatgtctttggaatttctttttcttttttctttctttctttctttcttttttttttttttttttgagatagagtcttgctctgtcgcccaggctggagtgcagtggcatgttcttggctcaccacaacctctgcctcctgggttcaagcgattttcctgcctcagcctcctgagtagctgggagtacaggtgtgcaccaccatgctcagctaatttttgtattttagtagagatggggtttcaccatgttagccaggctggtctccaactcttgacctcaggtgatctgcccgcctcagcctcccaaagtgctgggattacaggtgtgagccactgcgcccagcctgtctttagaatttctttatggaattctgtccatttctcttcatctcctctactgatccaagcctccttctctcagctcccacttacactaaaccctcgcctcctattaaatctctccttccactctgccaccaagacactattattttctatgtacaagatagggagcaatgtgaaaaatatgaatcagttcatactacatccctacaaaaaataccccaaggactgcttcctagtacacataaatctagaccccatgttatggccattttggcctggtatgattcacaccttgcctcctcatgtcctacccctaaaatttcacattgtttactttcttcttcatttagcaatcagcatgatatcaccctctgagaaaagccaaccactgccttctgagtcaaaatggcatgcacaccacagtgtgtgagataccagtgaggtacccacatctccagctttctgatctctttctgcctctttgtattatatttctcttattatttagtatgatgccaagcacataatagactcttaatactttgtccaaaagtattcctcaaaattaaaggatattgtcttacattcacattcttgtaagtctttcacattttagagcattttctaaattactttattttgaacaaatattatttggagaacacaaactgaaataacccaaatcaatactagatttatttatttatttatttttccttcaacttttaagttccacggtacttgtgcaggatgtgcaggtttgttacacaggtaaacatgtgccatgatggtttgctgcacacatcaacccatcacctaggtagtttttatatatatatatttttattacactttaagttctagggtacatgtgcacaacctgcagttttgttaacgtatgtatacatgtgccatgttggtgtgctgcacccattaactcatcatttacattaggtatatctcctaatgctatccctccccactccccccatgccatgacaggccctggtgtgtgatgttcccctttctgtgtccaagtgttctcattgttcaattcccacctatgagtgagaacatgcggtgtttttttgtccttgcgatagtttgctgagaatgatggtttccagcttcatccatgtccctacaaaggacatgaactcatccttttttatcactgcatagtattccatggtgtatatgtgccacattttcttaatccagtctatcattgttagacatttgggttggttccaagtttttgctattgtgaatagtgccataataaacatacgtgtgcatgtgtctttatagcagcatgatttataatcctttgggtatatacccagtaatgggatggctgggtcaaatggtatttctagttctagatccctgaggaatcgccacactgtcttgcacaatggttgaactagtttacagtcccaccaacagtgtaaaagtgttcctatttctccacgtcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgttggttcatatccttcagccactttttgatggggttgtttgtttttttcttgtaaatttgttttagttcattgtagattctggatattagccctttgtcagatgagtagattgcaaacattttctcccattctgtaggttgcctgttcactctgatggtagtttcttttgctgtgcagaagctctttagtttaattagatcccatttgtcaattttggcttttgttgccattgcttttggtgttttagacataaagtccttgcccatgcctatgtcctgaatggtattgcctaggttttcttatggggtttttatggttttaggtttaacatttaagtctttaatccatcttgaattaatttttgtataaggtgtaaggaagggatctagtttcagctttctacatatggctagccagttttcccagcaccatttgttgaatagggaatcctttccccatttcttgtttttgtcaggtttgtcaaagatcagatagttgtagatgtgtggtattatttctgagggctctgttctgttccattggtctatatctgtgttttgttaccagtaccatgctgttttggttactgtagccttgtaatatagtttgaagtcaggtagcgtgatgcctccagctttgttcttttggcttaggattgacttggcaatgcaggctcttttttggttccaaatgaactttaaagtagttttttccaattctgcatcacctaggtattaagctcagtgttcattagctggtcttcctgatggcctcactccccctacctccccacatgaaaggccccagtttttgttgttcccctccctgtgtccatgtgttctcattgtttagctcccacttataagtgagagcatctagtgtttggttttctgtttctgtgttagtttgctgaagataatggattccagctccctccatatccttgcaaaggaaatgatctcattcctttgtatggctgcatactattccatggtatatattttctttatccagtctatcactgatgggcatttgggttgattccatgtctttgctattgtgaatagtgctgcaatgaacatgcaggtgcatatatctttataatagagtggtttatttatttatttattttttgagactgagccttgctctgtcaccccaggctggagtgcagtggtgcgatctcgactcactgcagcccctgccatccaggttcaagtgattcttatgcctaagcctcctgagtagctgggactaaaggcacatgacatcacacctgtctaatttttgtatttttagtagagatagggtttcactcgttggtcaggctggtctcaaactcctgacctctagtgatccgcccacctcagcctcccaaagtgctgggattacaggcatgagtcgctgcacccggactgtaatagaatgatttatattcctttgggtatatacccagtaatgagattgttggattaaatggtatttctgcctctagatctttgagaaatcacaacactatcttccacaattgaactaatttcaattgaactaatttactaatttgttgaactaatttacactcccactaacagtgtaaaagtgttcctttttctctgcatcctcaccagcatctgttgtttctggactttttaataatcgccattctgactagtgtgagatggtatcactttaaatccctatcaaggtcactggttttaaatgcttatagaactggtttaaagggagggaaaataaggcatgataatgtaaaagattcagtttttctgggaggattttacaattgcaagaataccatgtaaacacgcttttcaaatatcacttagaaagcaatgtgacaagtataaatattgtgaagatacaatgaatgaaaacaaatgaagtgagagacaaacctaccctgcaaaatacaaaataggagaaaatatttgcaaaccatatgtctgtataaagaattagtatccaaaatatataaagaacccttacagctccataccaaaaaatcctccaaaagcccgacaacaaataatctggttaaaaattggcaaaggatcacaatagatatttctccgaagaagacatgcaaatgcccaacacttatatcaaaagtgctcaacatcactaatcatcagggaaaaacaaatcaaaaccacagtgagatatttcctcatacatattaggaggagtattaataataaaaaaagttaagaagtattggccaggatgtggaaaaaaaaggagcacttgtatactgttggtgagaatgtaaactggtgcagctgctatggaaaacaataagaagattcctcaaaaaattataaataaccccaccatatgatccaataaacctacttcttggtatttatacaaaggaattaatgttaggatcttgaagagatatctgtattactaggttcacgacaatagccaagaaatggaaacaacctaaatgtctgttgatggatgtatagataaagaaaatgtggtatatacatacaatgaaatattattcagccttaaaaatgtaagaaatcctgccatttgcaacaccatggatgaacccagaagatattattctaagtgaaataaaccagacacagaaagacaaatactgcattatctcgattatatgatgaatctaaaatagtcaaattcatagaagcagagagtggaatgatggttggcaggggctggggggaggtattaatggggaagtattagtcagagtgtacaaagtatcaattatacaagatgaataaattctagagatctactgtacagtataatgcgtatagttaacaatactgtaatgtataaggtagactttttgttacatattcttatcatacacacatacaataataataagggcaggagaaaactttggaggtgatgtgtagatttatggcatagattatggtgatggtttcatgggtgtatgcctacttccaaacccatcatgttgtgtacatttaatatttatgacctttaatatatcaatcatacttcaataaagtggtttaacaaaaaaattacacacaaaaaaaatttagtaagcattgacatgaacttatttgttattctagaaacaatttcaatgtgcaaatatatataggcatcatcctccctaaaacacaaaaacagaaaacaaaaaaatatatatcctaacattatatcaatagatgcttgtggcttagaacaaaatttagaattgatagcatcatataccatttaaatgattctttaaaaaaaattttgacaaaactaaaaatgatatgctctgaaacccactggaagatgataaatgcagcatcaattttttgagtctttggatgaaggactttagcctgaagagtcaccttgtcctacaacagacttatagtaaacaagttacaaaattttgttttattaatctactaatatatgtttttcaaccaaagtataacctaccctatactgacaaatacaactgtctacagtatttccttgaattaacctagccatctgaacataaattcatacggtttttacctttgtaatgtcccttactttcttttaggaacaaaccagtatataaaataacacttatatgaataaatcagtctagacatgctctccagaaatattcttacctacaagtgtaaaatttaaaagactaccacttttgaaaaataaaaatatttctaagtatcatcaatcatatcatgtttatattaatttgcctttaaatattgttaccacagtgtttgaaaaatcaatttgtagatcttgttataaaatatctgcatttttacaagcaatataaaaaccaaaaaaattttattctaaaataagataggaatatgtatggtcacatgcacttggaattagaaatgataatttaccagatagaggtctttgtctacactgttaatgtaaaaaatcaaacctctagtttcataaaatgtatgttaaaaatatttcacagaaatatatgcttcaataactttaataacattttataacaagatgtattttgtttgtttgtttgaaatggagtctcgctgcgatgcccagactagggtgcggtgatgtgatcttggctcactgcaacctccgcttcccaggttcaagcaattcttgtgcctcagcctcccgagtagctgggactacaggtccccgccaccatgcccagctactttttgtatttttagtagagacggagtttcaccatattggccgggctggtcttgaactcctgacctcaagtgatccacctgccttggcttcccaaagtattgggattacaggcgtgagccactgggcccagcctataacaagatgtatttttgatagtaaactgtattttctatatccccactttttccattggaaataaggatttctcaaaggctggcttgagtcaccacccaaccatcttcagactatctgcagaaacaccacttctcacttcttagtgcataccatgtggtaatctgctacctcggaaaaccagggttttggcttagctatgtttggtggagaatgatggctttctctggaataagggtagcatagtgtaaagcccattattccaatttggaaatatcccattttaggtttcctatatccttctttatcaggtcttctagtcttatccaccaaggggcacagggaacacatgcaaatttttttaccacacttcaccagcatgtgctaccatatctttctgtatagtgatttcattttttttttgtttctttgattacagtcttgacttgaattttatccccaaccagaatatattcactgtgatatgaaggaattgtataattataagcattggtatgagaatattacaaattataaacaatgactctcctattatttactgctttactaagaggaaaaatgtgcattattacccacacttactctacaagacctatttaaattttaatattaaagttgtttttgagaagacactctttaatcaccttcatctagcttggaaatttcacaaaactcaattactgagttaatgtctatggcctggtttataataacacagcttaaatcagccacagatctagaagagaagcagcatggtgtggtagatcaaggctctccccatgaggtaaacatgtcctggattctctaccctcttatttgctgtgagacctgagcgtagcattgaactccataaaatgaaggcatgtgtctacttatcttttattggttagaatataggggatagggcaagataatcttttcagacctcttatagcactaaaaccattggctgttatattagggttaaattaaaagttaaaagttacagaaattacttgactctttgtaggagatctatttatctagaaatgatgtgcctgtctatccccaaaccattaactagatagaaaaagttacctatcctcttaaaaaaaaagtatcccaactactaaaggatattttaattttaatttttgttgttaaatagtagaactctgagaaatgaaataaagaaaagccactgaatgaatattctgtgaatcaggacagcctttataaggggtgacttcataatttttcccttgaaagtatatcagagggacagatgaagatgtattccaagttttccaggtccaggtttgctgtatctgtggactgaggggaaagtaattggattgggttgctgaataaagctcttttggtaggccaaggcatttttccatccactttaagtcttctcttaccaaagaaagtagaatgacagcccattcagacttggaaaagtgctgattgataccctgccattcaacatcctaccaccaacactctgtgggatcagttgggatgaagcaggaaaaaacaaaacaacaaaaacaccttcagccacttcattaaagatgtatctgtttaaaatctctttttgactggttgcttttcttgatgacttcttcagacatctgtttttgtttgtttgtttttttgagacagagtctcgctctgtcacccaggctggagtgcagtggtgcgatctcggttcactgcaaccccagcctcttgggttcaagtgattctcctgcatcagcctccacagtagctgggattacaggcttgcgccaccatgcccggctaaattctgtatttttaatagagacggggtttcgccatgttggcccggctggtcttgaactcttgatctcaggtgatccacctgccttggcctcccaaagtgctgggattacaggcgtgagccaccgcacccggcctaagacatctgcttttatttctcaagttttttcaaaggctaatgagatttttttttcacactctactggagaaataaagtatagatgtatagattatttatatccttgctttgatcatcatttccatgattgtccagtaggcttcatgaactattactgagatcaaaacataacacttcctgttaccacactgaacaaatatctgtctgagtaaatgtgcaggagtttattttcattcacctgcttagaaatgtatagcataggactcccataaccctattcattaaaaactctgattccttactgacaagggttccttggacacagcatatataatagctttgaaataggactcgcatcgcttctttttatgtagttagagatatgtgcctgttgtccttaatgaacttattttctttacttttgtattctccaggtctatccagctgaagtcaaaaatgcccctctcaggctgcccccagtgactccagtttcctagcagagcctaaccaggtcaggtagtaaaagcagttttcttagcaccacctatagacagtctagaagtattattcctgatttgtaattggtatggtcctgccaagctcctggagcatgtaaaccttctgttgcagggtttttgtttctcccctgttacccaccatattaattcagatcatgaatctgctacgctttccttgctgggcttgagatactcctcaagctgcaattcgcttggctgtgactccaactccctatgtggcttgtatcaagcctctctcctgtggatcctggctcctggcaagaagcttgctgtgacaagagttataatcaacatcagatggatttctgatgctttccctacctgactgatggggacccttagttactcagcattgggcttccatatcttttgatttttgggcattggaattcctggctagtcccccagaagctagctgttcaagattggcaggtcttatgttcttcaaagtctcagcttctgctcctttcttattgatacaaattgcgaaggtaccaggatgcctcatgtctcagtctgcctaatttgtaatactatagtgcttatccatatatacacatataaatgcatttgtttttattactgtaagacaaaatacactaaagaataaggcattgtatctccaattctttcattagaatcctcagatcatgatgtacaagaaatatctttaaagccctgaagccactgcttgtttgatccttgagagccataactactatctataacttgttcatgcacttctgcatctatgactcacctaaatgaaatttcataaacctacctgaggtctaatagaatgcactgctcttaattccttgcttaatttcattacttgatggtttctggactacccagaacttcagaaggcattcctttccctaacaatctaatttacatctaaagttgcattaaatttagtctttgactaagttgagccaaaaacatgatgctgatatctaaataacatgattttactttatagactctgatagttgagagatatcaaagttgtcactctggtacgaaagttttattctccacagcacaacctgaatagttctgaatttctttctatcaactaaacacatttttctatcaacacatgttttaattcccctttgcctcctggaaaccttttccttcctggcatatttccatgatcattttttaaatgctattcagaaaccttcattttctctaatacaagaaaccatggtgaagcgttcattgctcagactttctttaccttgggcttttgtaatggagagtagattcttctttggaatgtgaagtttatattaatagtaatctcaggcaaaagcataattatggcacatgcaaggctccagaacagtctcattgatgtccctgcttcctgggcttacagtgaactccagacagacttctgtggttccaccaatgaactgctgggcaacttttgtcttagtcactaagaattactgtcaataatgttttaaattctttctgacttttgtcttcctctcaagctactaacttccactaatctgacacgtgtgagtaaacttcactttgcaagtatctgttcctgtttaccttgtggacgttagacagcctattgaatacggttcacaagtgttgtcccagggatttttagtcagttaccatcatcgggggattccctttatcactcctttaaatttaatcctctgtttgcttgacactagtcttcctctttctttatttacttctttttgatgaagactttgcctttgtcaggcaactaatggagaagttcagtcagagttcaaccagagaaacagaactaataggcaatatacactaaggatttttttttttttttttgagtcagggtctcactctgtcacccaggctgcagttgtgggagctggttagacaagtccaaaatgtatcaagctgaagctgataggtagaatttcttcttccaggaaaccattctgctgtaaagcttttcaactgattgaattagggccactcagatgatataggattatctcttttacttaaagtcaactgactgtagatgtctattttatctattctttctttcttgaaatctgaaagattgtctcctgtctgtaagaaagcttgagatctggaatattgtcttagcaggctgtaagcttggtgaaccacccttatttattgatagaatttacctcaggtgacctagatatagtctctcttcttcttggatagtacaaatttttataaatctttagttttgataccaccttttctagcttcggtttgaattactgggcttctataaacacatcccatcctttctacagatggatttgattgattgttatattttttatttacatttgattatttgactggattttgatctcctcaggaaaaagaaaatgtctcctcaggaaaaagaaaatatctcttgaatatgaaacttctacagttggtgactttcaacttctgtattttaattctcagtggtttcattctcatattttggcctttttatgatctggcctaagcttctgagagtttataattgtagccatccagataacataagctacatgtaaatttgaacttctagtatggagattctaagaatctggacattctgttctttaatcactggaaagcaacttaaaagtttagcatccaatttcctgctactatgacaaattccacactaaacatcatgggaaaaatacattccagcttcatccacattagcaatgaatttcaattcataaccttacacagttgtctttagaagtactagcattcccttcccacgttcttatctatagctacagcctccaacccatttcctgagacatatggttctgtatttcttggaaggttcgcagcaattcattactacattcaaaatcccctgagtccagctacaatgcagggtaattactccaacgtggagaagagtcaaactgcatgtgaacgtgcttctccaataattataacccatatcttcaaaagagtgacaagcatttttgcttagcttttagaatcataaggtggaagctcagttaagtactttgcataatgctattttggacagtaatcattgggagtacataggctttattcagtattgaaccattggtaagcatttaaaaatatttgtacacacacacacacacacacacacacacacacacacacaaacaggacttgacaatatcactgcccctgctcagtagtagctttgtcaacaaacaagtagagtcactgaagtgaaatattcactgtcaattagcagctgggtcaatgttactaattgtcaaactattttttttgctataaaacacatttacacacaatcttgtgtagaaacccactatataaaacagacaagggccaggtgcagtgtctcttgcccataatcccagcactttgggaggctgaggcaggaggattgcttgaaactagatgtttgagactagcctgggcaacatagggagaccccacgtctaaaatcatacaaaaattagctgagtgtggtggcacatgcctgtagtcccagctactcaggaggctgaggcaggacgattacttgatcccaggaggtcgaggctgcagtgagctgtgatggagccactgcactccagtctagatgacagagtgagaccctgtctcaataaataaataaaaagaaaaaggattaggacagagttgctcagcttgaaggatatgggatgcgcagactgacatgagtttagctgcctcctcatatcacagtggtcagtgaagtacatctagagaatcccagagctctgcagagtatactaggaaaccacaaatttatgttatttacaagaacattttggttattcacttagcacaatggctattttcgccatataaaattgtcaaaagacaaaattacaacaaatttagttatagatagaattggtttttatctgtggctcatgaattggggcagcttctattcttcaagatagagtaaagctcccactgggcaatggcagaacagtgggttttgtaaaggggggacaaggaaaagagcaatgtaaaaataactgaggctgggcacggtggttcacacctgtaatcctaacactttgggaggctgaggtgggcggatcaggaggccaggagttcgagagcagcctggccaacatggtgaaatcccatctctactaataatacaaaaattagccaggtgtggtggtgtgcgcgtatagtcccagctactcaggaggctgaggcaagagaatcgcttgaacctgggaggcggaggttgcagtgagccaagatcacaccactgcactccagcctgggtgacagtgcaagactccatctgaaaaataaaaaaaaattagaataaaataaaataaaataaaataaataaaataaaaatctgagtggggctgggcccagtggctcatgcctataatttcagcactttgggaggatgaggcaagagaattgcttgatgtccagagtttgagagcagcctgggtaacaaagtgagacctcatctctacaaaaaacaaaataaaaaattggctgggcgtggtagtgtgtgcctgtagttagtcccagctactcaggagggtgaggggagaggatctcttgaacctagtatttctatgctgcaatgacccattattgcacctctgcaccccagcttgggtgacagagtgagaccccacataaaaaaaagaataaaaataactgattatttaatatcaggttacttttttgtgcaggttcaaagagagaggacttccttattactctgactcaggtagactggagtctcctattttcaggaaaagttggtccatttgggatctatttgatttcttaaagctttagtttgattatgtgccatttagcatgagtgaccctgttttggtttggtccaatttgttagggactagtgcaggaattccatcctaaaacaatggcctcctgtaatttttgtttcacaaaacatagccagtaagtaccagttagtggctagtttttgaggaatttattgtgcatagcattaaaataagcatcgaggggaagaaattgctatgaaaaaataaaatcttggagcctggagacaatctgaaatgaaaacaaaagaaggagtctattgtgaaaaaaaacctaaaacataaatgaatgtaatcacaggaagacgttaaactgcactaaatagagcacaactgatcttgtttgatctgggaaactaagtagagctgatcttgttatgttgacagcaaatgcctagggttaccatgagctatctagataccagatagtttcagggcaaagatgttctcgggtttagcaggaatctattcaatataatgcttcactcaccagcactttggcatagttgttttgcttttgtgagcatcaataaaacagacaaaccatgatcctaaaatacttgatgagtcaccaggagaagattatactacattcagcacaagtacccatatattattataatatgatttaatataatatgatgtaatagaatatcatgtattattattgttcgaaacctgttgaaaatgttatatggtatgtcaaaagcatatctttccagaagccagaatattgtagagctgggatattgcattccctgactgtatcatataagagaagtttctctgtataagtactaaagagtagctaaagtcattgaagagaccagaatcaaggacatgaaacaaaaaggttttgagaactttaaatgtagtaagaagatttggcagagaaacttagaagagggcatttctgttaaagaatctcctcatacttacgtagcttaaattcactttgcttgtttttcaattggtgtatttataaggcacttgtcttccaaaagtagatttgtatttcgatgataatggcaatagtgctttctttgtagaacctatctgtgtgatcttggccaaatcagactgggtgaaacatagagcacacatttgcttcttctgaatggtgcttcatctcagtggctgagccacgtggatggcattcagaaataacagttgtgcttccacacagcggtgagccaatccccagtgattctaaaggctgaatgttctggttctgcaaccaaatgaatacaattatagatacttagccgaccctgactaggtttcattctttcattaattaacacatgtattataggcacttatttgggcactgcagagctgctgtagattatctaaagtttaattcaatatggctttcccccttagaatcttgttatgattattcttatatcttcccttctgcccatctctgaaaatttctcacttcccctcttggaacaccatactatgattaaattcacttccagggactggccatggcttagaaaaatgattctcttacttgccaggatccctgtacagacgctgccgagtcaaatttagtgccaaagggaatgtgtgctttatttgatcagcgctgatttctgagctgggccctggaaaaagaaaacatggattttgtcagtatctgtggacccagaaaaaggtatccttattgcaatctgtcctgattacagctgtgctggtaccaagtgtggcactcagaatatccagtatgctctcatgtcaaccaaacttaatttctgtatgcagcaaatgctagggcctgttaaatggatgaaatgtacagcttgtaaaatatctgcttcttaagttggaagtgactttgtctttgataactttacctctccaaagaaaatcttctaccacccactcaaaatgtcaggttcctcctggtctccataatgatccataaatatctaccctgaactcatgatgatgattggattcaacattataattgcatatgcctgacttttccactctgtcaacagcctcttttctggagtatctcccagtgatcatgtcatatcctgttaggtaaattgtgaacctgtaggattgtatctcctagttttatgagtgaagatcacatttaattctctgtcattttcagaacataacacatcgttagtgctttaaaaggatgaaacatgcagggcatttgtaaactttaaaagtacttttttatctgttattttatgcaatccctacaattatcctttgagggctggcaaatcccggtttgacaaatgagaaaactgaggcataaaggctaagtgacttctctgaagtcacacagtgacagaaccagatttaggatccagttcccttgactcctagactcagacttttttttttgttaaatattgtctagtcatattactactctctgaaagctattcccaccagaagtctcattttaattagatatttcatacctttaaactctgtagtgtggctagcatttacaaaatcatgctgagtagaggcagtgaacaaggcttgggttgcccaaagcagaaaaaagatataaagatgaaaccaccagacagattttatttatgactattttagagagggtagtgcaacctctgattctccttaacaccaagttctgttgaaactcagtctttatcacaggaaccactgggtgcctttctcatggccacagcagcttggcttacaaccgtcttcaaacagccaggctgtgccccagaacttcactgggcttccttccataactatggatctgtgagcatcactttaatttcagagtgtggaagacaccttaataagaatcatgaatcacattttacaaatcaggatacacaggatgtaaggttaagtgacctgtcctatcagggccacaaagccagttaaacttctttattaactgagtcacttaaaaatcatttatttaaaaacctattttgttccaggaactattctgggtactggaaataaaacagtggagacagagagaggggaaataaaaaacaagacaaaaatgattgctttggtggagtttatatattccactggaagaaggtagataataaataaaagtgaaaaagtacattataaggtgggaggaaggcttgagcctaggaggttgaggttgcagtgggccgagattgtgccactgcactctagactgggcaacagggcaagacgttgtctcaaaaaaaaaaaaaaaaaaagaaaagtaaattatagagtatcttaaaaggtgacattacatgaaagaaaaacaaagcagaaaaaagggtaagtagttctgggcactaagtacattttaaacagggtagtcggggttattgactgagaaagtgatattttttggcaataacttaaaatggcaaagaagtaagcaatgagaatatctgaggaaagcctgtgcaaagcccctaaggcaggaacatgatgacatcattgggagaccagagctaggagtactggggcagcatgagccagatgcataatagtttgatatgaaatcttagaggtcatgaagagccagatttatgtagggtcttgtaggccatagtaaagattttggtttttaacctgagtgagtgagatgaggaaacactgaagaattttgagtaatggaatgatatctttgagcttagttttaaatggattattctgggttttgtggtaaagaatggattagagcgaggacagcatagaactagggaaaccagttagagatctatcacaatagatttagtcaagagaagatggtggctcagatcaagtggtagaggttgaaatggtgagaagaagtcagattctagatgtattttgaagaaggagccaagaagatgtgttgaaaaatcaaatttggggtgaaaaaagaaaaggagaaattaaagatgacttgaagtttatagcctgagcaattgaaaagatatatttgcagttaactaagatggcatagccttcaaaaggaccaggtttggaaagtgatgaaccattcagttttagaaatatttagtttgagatgtgtattggatatccaagcagtaatgtcaaataagcaattgggtatgaatttagagttcaggtaagagaattgaactagagaatttagctgttagcagagtatagatgatattgaaagccatgagaataccagaggattgaatgtagatagagaaaagaagagccatctaaggattaaaccctgagatacatttggtatgttagtctagaactcaatcataggttcttaacaaactgcgctctggagtattggtttaaggcttatagaattggattaaccctactttgtgctactaaagacaaaatttcataaaagcctctcaagaatccaaagtttattataaaccaagctttccttaaatgtcaagtatgttgaagtattgttcatattcatggagtaaaatgacagcaacatttcatagggttgcccccacccccaaccttttggatctggtgctagtttattcttcattgtttctgtgtactttctccatgaagactgcaaccccttgaacaattagcccccaacagactgagtaagtactagccaaacactggattcctatagctatgttaatgtattgctttggggactatggagctttcagataacgatgctctttttttcttgtagagtgagagcatttttctaggagttagttttaagatggtcgaatccatattagctttgtatccctatcctctaggcactagttcaaggatttaagtgtatgcaagaatcagaatatgcttatttaaaatgcagattctctggtctttttaaagtataatttttaaaaatttctttattattattattattaaactttaagttttagggtacatgtgcacactgtgcaggttagttacatatgtatacatgtgccatgctggtgtgctgcacccattaactcgtcttttagcattaggtatatctcctaatgctatccctcccccctccccccaccccacaacagtccccagagtgtgatgttccccttcctgtgttcatgtgttctcattgttcaattcccacctatgagtgagaacatgcggtgtttggttttttgttcttgcgatagtttactgagaatgatgatttccagtttcatccatgtccctacaaaggacatgaactcaccattttttatggctgcatagtattccatggtgtatatgtgccacattttcttaatccagtctatcattgttggacatttggattgattcccagtctttgctattgtgaatagtgccgcaataaacatacgtgtgcatgtgtctttatagcagcatgatttatagtcctttgggtatatacccagtaatgggatggctgggtcaaatggtatttctagttcaagatccctgaggaatcgccgcactgacttccacaagggttgaactagtttacagtcccactaacagtgtaaaagtgttcctatttctccacatcctctccagcacctgttgtttcctgacttaatgattgccattctaactggtgtgaggtggtatctcattgtggttttgatttgcatttctctgatggccagtgatgatgagcattttttcatgtgttttttggctgcatagatgtcttcttttgagaagtatctgttcatgtcctttgcccactttttgatggtgttgtttgtttttttcttgtaaatttgtttgagttcattgtagattctggatattagccctttgtcagatgagtaggttgctaaaattttctcccattttgtaggttgcctgttcactctgatagtagtttcttttgctgtgcagaagctctttagtttaattagatcccatttgtcaattttgtcttttgttgccattgcttttggtgttttagacatgaagtccttcctaagccaagagaacaaagctggcggcatcacgctacctgacttcaaactatactacaaggctacagtaaccaaaacagcatggtactggtaccaaaacagagatatagatcaatggaacagaacagagccctcagaaataacgccacgtatctacaactatctgatctttgacaaacctgagaaaaacaagcaacggggaaagggttccctatttaataaatagtggtgggaaaactggctagccatatgtagaaagctgaaactggatcccttccttacaccttatacaaaaattaattcaacatggattaaagacttaaacgttagacctaaaaccataaaaaccctagaagaaaacctaggcattaccattcaggacataggcatgggcaaggacttcatgtctaaaaatttctgtttctattttttttattgatatgtagtagttgtagattctctggtcttatctttagagattccgatactttaggtctgtagtggagcctatgaattggtacaacaagtgattctgatgctgattcagaatcagaagaggcaacttactgttgacagtggacaagtgattctgttaggccatttctttgatataggaagataaatttctagggttgctgggaagattatggacagattatgatcttgaaagaagtcctaaaggtggactgtattaaataaagtgtatattctaggaaagaggatgtaaatccatataggggagatttctttttctaataatcagctttatcaatggaaagatacttgtgaatgtgtttcatctttgaagaataaaagaaaatatcaatttgagatgtcatagagaaggttcctctgtgggaaataaggttttactagttgacttctaaagctgccgtaaattatttttcagaacaagacaaagaatgtataaagaagtagcctcttgggtttctaccagctcacagattctttgggtgtttttaaggcattcaaaagagaaaggactagctcatatttttatcacagtttttgcctacttccttcaacatgggggcatcctggtagagaaaaacaatttaaaactgtttccagatattttggtaaaagtttccactctactatgggtaagtagtgaattagaattagcatgactaggattgctactatctttggataagacttataaaccacatgaatgataagaaagaaactgttatatgaagagtttgccctggatgatttctaagaactctttacttctaggttctctaagttctaaaaccctataggttcacctgagttcttatccacccttatgaaaaactgctagagaactcacagaatttcatctctctacctcattccctgaacaaagtcagggaatgaggtagagagatgactccaataaccccagctccttattccatcttttaaatgattttttataaatttcagtaggtttttggggaacaggtggtgtttggttacatggataagttctttagtggtgatttctgagattttggtgcacccatcacccaagcagtatacaccgtatccaatgtatagtcttttatccctcactcccctcccacccttccccctgaatctgcaaagtccattgcatcatttttatgtctttgcatccttagagcttagctccgtctcatgagtgagaacatacaatgcatcgttttccattcctgggttacttcacttagaataatggtctccaaatccatccaggttccttcgaattacattatttcattcttttttatgactgagtagtatttcatagtatatgtatatatatatattgcattttctttatccactcgttgatcgatgagcatttgggctggttccatatttttgcaattgcgaattatgttgctataaacatgcatgtgcaagtgtcttttttatattatgacttttcctctgggtagatatccagtagcaggattcctggagcaaatggcaaatctacttttagttctttaaggaatctccatatttttttccataccagcagggtaaaagtgttcccttttcaccacagccatgccaacatctattatttttggattttttaattatgaccattcttgcagaagtaaggtggtattgcactgtggttttgatttgcatttccctgataattagtgatactgagcattttaaaaatatgtttgttggccatgtgtatatcttcttttgataattgtctatttatgtccttagccaactttttgatgtgattatttgtatttggttggatttttttttttttgtcttgtgatttgtttgattgccttgtagattctggatattattcctttgttgaatgcttcgtttgtgaagattttctcccactctgagggttctgtttactctgctgattatttcttttgcggtatagaagctttttagtttaattaagttccacctttttatttttgtttttgttgcatttgctttagggttcttggtcatgaagtctttgcctaagccaatgtttagaagggtttttctgatgttaccttctagaatgtttacagtttcaggtctcagatttaaatctttgatccatattgaattgatgtttgtataaggtgagagattaggatctagtttcattctcctacatgtgtcttgccaattatcccagcaccaattgttaaatagggtgtactttctccactttatgtttttgtttgctttgttgaagatcagctggctgtaagtatttggctttatttctgggttctctattctgttccattagtctacatgcttatttttataccagaaccatgcagttttggtgattatagccttgtagtatagtttgaagccaggtaatgtgatgcctccagatttgtttttttgctgcttagtctggctttggctatgcaggctttttttttgttttagttccatatgaattttagggttgttttttctagttgtgtgaagaattataatgatattttgatgggaattgcattaaatttttagattgcttttggcagcatggtcattttgacattattggttctgcccatccatgagtatgggatgtgtttttatttgtttgtgtcatctatgatttctttcagcagtgttttgtagtttttgttgtagaggtctttcaactccttggttaggtattgtgtaaggccatgggagcccacctcttccatcagcatgacctagatgtgagacatagaggcaaaggagaacatttcagagctttaagatttgattgccctgctggatttcagactcgcatggggcctggagccccttcattttggccaatttcgctcatttggaacagctatatttacccaatgcctttacccccattgtatctaggaagtaactaacttgcttttgatattataggctcataggtggaagagacttgccttgtctcagatgagactttggacttggacttttgggttagtgctggaatgaagcttctgaacagcaaaagaaaccgtcatcagagtgaataggcaaactacagaatggggggaaaattttgcaatctatccatctgacaaagggctaatatccagaatctacaagaaacttaaacaaatatacaagaaaaaaacaaacaaccccatgaaaaagtgggcaaaggatataaacagacacttctcaaaagaagacatttttgggaggacaaggtgggtggatcaccggaggtgaggagtttgagacaagcctggccaatatggagaaaccccgtctttactaaaaatacaaaaatttgctgggcgtgctggtgggcacttgtaatcccagctacttggaaggctgaggcaggagaattgcttgaaccccagaggcggaggttgcagtgggccaagattgtgccactgcactccagcttgggtgacaagagcaaaactctgtctcaaaaaaaaaaaaaaaaaaaccataatcccaggactttgggaggccgaggcgggcagatcatgaggtcaggagattgagaacatcctggctaacacggtgaaaccctgtctctactaaaaatacaaaaaattagccaggtgtggtggcaggtgcctgtggtcccagctacttgcgaggctgaggcaggagaatggcgtgaacccgggaggcagagcttgcagtgagctgagatcgtgccactgcaccccagcctgggcgacagagtgagaatccatctcaaaaaaaaaaaaaaaagaaacagaagacatttatgtgaccaacaaacatatgaaaaaaagctcatcatcactggtcattagatcaatgcaaatcaaaaccacaatgagataccatctcacgccagttagaatggcgaacattaaaaagtcgggaaataacagatgctggagaggatgtggagaaacaggaacgcttttacactgttgctgggacggtaaactagttcaaccattgtggaagacagtgtggcacttcctcaaggatctagaaccagtaataccgtttgacccagcaatgccattactgggtatatactcaaaggattataaatcattctgctataaagacgcatgcatacatatgtttactgcagcactgttcacaaaagcaaagacatggaaccaacccaaatgcccatcaatgatagactggattaagaaaatgtggcacatatacaccatagagtagtatgcagccatagaaaggatgagttaatgtcctttgcagggatatggatgaagctgaaaaccatcattctcagcaagcttacacaggaacagaaaaccaaacaccgcatgttctcactcgtaagtgggagttgaacaatgagaacacatggacacagggaggggaacatcacacaccggggcctgatgaggaatgggagttaggggagggatagcatcagaagaaatacctaatgtagatgacgggttgatgggtgcagcaaaccaccatggcatgtgtagacctatgtaacaaacgtgcacgttctgcacaggtatcccagaacttaaagtattaaaaaaaaaaaaagactttgggggactattgggaaggcatgatttgttttgaaatgtaaaagagacatgaggtttgggaggggcccggggcagaatgatatggttaggttttgtgcccccacccaaatctcatcttgaattgtaatccccataatccccacgtgtcaagggagagaccaggtggagataatttaatcatggggtcagttccccaatgctgacctcatgatagtgagttcttatgagatgtgatggttttatataggcctcttccctcttcactgggcacttctccttcctgccaccttgtgatgaaggtgctttgcttccccatcaccttctgccatgattgtaagtttcctgaggtctccccagtcatgccgaactgtgagtcaattaaatctttttcctgtataaattacccagtcttgggcagttctttacaacagtatgaaaatggac

SEQ ID NO: 4667 - DNA, 1131 bp, Homo sapiens
agcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactggtcttgttttgccacccaggctggagtgcagtaatataatcttggctcaccgcagcctcaacctcctgggctcaagcaatcctcccatctcagcctccctagtggctggaactacagaaagggtacattcgccagcagttttgccacgagagtacaccgaacaaagagacagggtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggcatgaggcgaattctcagccatgacaaggctgaaggccagcaggaacaggctctagcgaaatgggtgctgtgtccccttcctgcatgtggcagaaagttgcaaagtttcatggatttgaatgtgaacatctgttccctggacgcactgccaacaacgtggtccaactggtactcatcgttggaactaccaagtcaactaattttttttttttttttgagacagagtcccactctgtcgcccaggctggactgcagtggcgcgatcacagctcactgcagccttgacttccccagggtcaggcgattctgtcacctcaggctccctagtaggtgaagactacaggcagacaccaccacatctgagtaattactttttgtagagatggggtttcgccatattgcccag

SEQ ID NO: 4668 - DNA, 1216 bp, Homo sapiens
ttcgttagaatttttttattaagtacatcaaaatttcaccttacatttgaaattgcatagaaatttaaagtgctaaagcaatcattgttttttcaaaaaaatgaatttgaagccaaagagtggagagtgtggggatccactgggtaggacatttgagatgtatgcaatgtaggaatcttatttgaatcctgacttgaattggaaaaaaaaaaaaaaaggcacaacttgaacactgctgggtagttattaacactaacaaactgttaacagttaagtctaacaacagaattgtggttttatttaacagtccttatcttttagacatacatattgaaatatttacaaatgaaatgatttgctatctgggatttgcttcaaaataaataggggttcaaagatgaatggcatttagataaatcaagattggccatggattgatcatgttaacatgagttcattatgcaattgtccttttacatatacctgacatacgccattaattttttaaaaagcactcactccgatgtctcctatgtataagaacacaggcagctggcagcaactaaatggtatcaactaaatttttataaattccaagagtcgttaattctcagctatctcaaaagtaaaatctctgggaaacttaatattaagacagtaactatctgcacacagtaatctgtacaaagtttaattaccaccaccagtcagtcataggctagtcgagtagctgtatcaaccttggtacaaacaataacagagccaaagcaccagccatcagcaccactcttcgctgacacatttcttctcttggactgcacaactcttaagtttactaaaaacaattaattgtacatgtacaatgggtgaattttacagtgtgtaaattatacaaagcaattttttaagtaccattgtaacaaagtcttacaaatcactattttaaagctctggttcatagttcgttcatttgatatattcaacacaacgaagtctaatatactattaggattaagaacattagcatttgcttgaaaactaaacacgctgctttcaaaggattccaagtacacccatctctaaatcttactgattaaatattgctcttttagctataagtcatgtaattatgtgacaaaatcactgttaacgatttaattagcattgtcccttagccatttcattaattggtcttcccccaaccttatgccctata

SEQ ID NO: 4669 - DNA, 4230 bp, Homo sapiens
ggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagctt

SEQ ID NO: 4670 - DNA, 718 bp, Homo sapiens
tggaaaatgaaagcaagttcacgctgacaatgcccgtaaagagctttgtgaagccatgacagtgctcttcaattttaacatgaagaagagggcatgtgagttagcaagactggccagaggccagagcccggggccagcaaacctttccctgctgtgaggtgggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagatgctggacccctgaatatggagggccaactacactagaaacacacacgctagctgagaaagatggtggcttaagggtaagcatggaaagaggcaaggaggtgaggacagcaggactgatagataagctggggaggccagagctccacaaggacatccatttcacttatcagaatctaaaaataaacacgttgagatactagaatcaaagaatccaaattagtttctgaacacatttgaaaagatcaaactcttacagttaaaaaaaaaattaatcagccagacatggtggctcatgcctgtaatc

SEQ ID NO: 4671 - DNA, 1224 bp, Homo sapiens
cttttctctaactgatgctaaatataacttgtctttaatgcttcttggatcccttagaaggtacttcctttttaaccttaacccttttagtagttaaataattatttccataggttgctattgccaagaagacctcttccaaacagcacatgattattcgtcaaacagtttcgtattccagatactggaatgtggataagaaagtatacatttcaaggggtaggttttattattaagaaagccaaatgaggattttgaaatattctttcctgcatattatccattctagctacatgctggccagtgggccacctttcttttctgcaatttaatgctagtaatatattctatttaacccatgagtcccaaagtattagcatttcaacatgtaagcatgtcggtaagatagttgtgctttgcttagggttccctcctgtgttatggtctggaaagtgtctttaggcagaaagtctgagtgatcacagggttcactcattaatttctcttttctgagccatcatagtctgtgctgtctgctctccagttttctatttctagacagaagtagggcaagttaggtactagttattcttcatggccagaagtgcaagttctactttgcaagacaagattaagttagagaacaccctattccactttggtgaactcagagcaagaactttgagttcctttgggaggaagacagtggagaagtctttgtacttggtgatgtggtttttttcctcatggcttcacctagtggccccaagcatgacttctcccatgtcaatgagcacagccacattcccgagttgaggtgaccccacggtccagaatcatcctcattctggtgaacctggttctctttgtggtgggcatactgggtaggagaatcacccaaaggtcacccatgagctgcagaaaaaaaggctatttgcagaaggagctcacagatcacattgaaagcattgcatattcaaacatcttggtcttctttattggcatgcccacagggtcttctgacctctgattagatcagacactttttagatattgaatcatcagtttctgtacaactatctgaataaggtatataatcaatgaaatttagaatttttttctatgcttactcctgattggtaatttgtttgggtttagaattctatacaaggccatttgtaattttcctcagcactttaaaaatattaaaccatgttttcttaa

SEQ ID NO: 4672 - DNA, 354 bp, Homo sapiens
atgactgacactgccgaagctgttccaaattttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactac

SEQ ID NO: 4673 - DNA, 393 bp, Homo sapiens
gagatggccatataaggtagactttttttttttttttttttgagatggaggcttgctgtcctccaaattggtctctaatttgaggttgatcggggtttatcgattacagaacaggctcctctagagggatatgaagcaccgccaggtcctttgagttttaagctgtggctcgtagtgttctggcgagcagttttgttgatttaactgttgaggtttagggctaagcatagtggggtatctaatcccagtttgggtcttagctattgtgtgttcagatatgttaaagccactttcgtagtttattttgtatcaactggagttttttacaactcaggtctctgttgactgtgtgttaactgttggataaatcctttcctgattctcacatagagc

SEQ ID NO: 4674 - DNA, 432 bp, Homo sapiens
tccctttttagtaatggtgtctttttattgataacttcccaacagcatctgtaaacatcgggtacaaaaatattccattaaactctttcccgaggtggctccgtttgctccatggaggccttcagagaggcctgctggcccctcaggaattccacacccctcgggagagagccttgtccccctaggagccctgggtgacagaacggggcagcaaaggagccctggatgacagaacaaggcagggttacccgctgccaccttgtatgctgctgccctgagaccccctcaaggcaccgggcagcagggctattcgcccgtcatctcctcgtcatctgtctggctgcggccgttgatggctggggagccaggctggacatgggacaggtcctcgaagccggggctcagggagggcgagacggtgtcggggctggt

SEQ ID NO: 4675 - DNA, 2360 bp, Homo sapiens
attttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagtcacgctctgtcgccaggctgaagtcagtggcaccatctcggctcactacaacctctgcctcccaggttcaagcaattcttctgcctcagcctcccgagtagctgggactacaggcgcgtgccaccacaccagctaattttttgtatttttaatagagccaaggggcttcaccatgttagccatggtggtctcgatctcctgacctcatgatctgcctgcctcggcctcgtaaagtggtgggattacgggcatgagccacgtgcccagccttcatgtgtattttagacaatgaaaatgatgttagacaaaaaagcaaattcgagcagttttcgtttttgagttaaaaatgggttgtaaaacaacagagacaccatatcagcaatgcatatggttcaggaactgttaacttacagtgcagtggtgattcaagaagtttttttgttgttgttgtttgagatggaatcttgctctttcaggctagagtgcagtggcatgatcttggctcactgcaacctctgcctcctgggttcaagccattctgcctcagcctccccagtagctgggattacaggcacgcaccaccatgctcagctaatttttgtatttttagtagagatggagtttcaccatcttggcccaggctggtctcgaactcctgacctcgtgatccgcccgccttggcctcccaaagtgctgggattacaggcttgagccgctgtgcctggcagtttcaagaaattttgcaaagggaaggaaagtcttgaaaatcaggagcgtagtggctggtcgccagaagttgataactaccggttaagagcaatcagcaaagctgatcctcttaaggctacttgagatgttgccgaagaactcaatgtggaccattctacagtccttcagcatttgaagcaaattaaaaagtgaaaaagctcgataagtgggtgcctcatgaactgaccgaaaaaaaaagtcattgttttgaagtgtccttatcccttattttttgcaacaacaaaccatttcttggtcagattgtgatgtgcgagaaaaagtggattttatacaacaactggtgatggccagctcagtagatggactgagaagattctccaaagcacttaccaaagccaaacttgcaccaaaaaaaggtcatggtcactgttttgtggtctgctgctggtctgatccactatagcattctgaatcctggcgaaaccattacatctgagaagtatggtcagcaaatcgatgagatgcaccaaaaactgcaacgcttgcagtcagcattggtcaacagaaagaggcccaattcttcacaatgcccttccacatgttgcacaaccaatgcttcaaaagttgaacaaattgggctgtgacattttgcctcatccgccatattcacctgacctctctccattgactacgacttcttcaagcattgcgacacctttttgcagggaaaacacttccacaactagcaggatgcagaaaatgctttccaagagttcgtcgaatcctaaagcatggatttctacactacaggaataaacaacttaaaaatgtgttgattgtaatggtttctattttgattaataaagatgtgtttgagcctagttataatgatataaaattcatggtctgaaaccgcagttatttttgcatgaacgtaaatgatgaattttagatgctgaaatttctgggcatctaaatcttctttcacatccctgattatttttggaataaactcccagaagtggaaatataaggctgaaggcctggtgtggtggctgaagcctgtaatcccagcactttgggagaccgaggtgagcagatggcttgagcccaggagtttgggacaacatggtgaaacctcatctctacaaacagtgcaagaaatcagccagcgtggtggcgtgcacctgtgttccccgctaatcaagaggctgaggtgggatgatcacctgagtccaggagatcaaggctccagtgaaccatgattgtgccactgaactccagcctgggtgacagacttcatctcaaatatatagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaagt

SEQ ID NO: 4676 - DNA, 14420 bp, Homo sapiens
ggagcctgagaccatggcgaccaatccgcactggtgggagaccgtctcccgccccatcacggtctccccagctcgcccgcccgcaccccttccacttcacctgcttctcctcgccggtctcctccgcagggttctcttcttcttgtttctgggacatggcgggaccgggactgtggagtgtaaggggcccgggaaggcaaccggagaagggaagggggaggggaaacggggacaacctgcgctgctgcttcggctcctgtcactagggttgctcagtcaaaatggcggcccttgcccgtgacgttgcgaccgccccttcctatgagagccagtgggagtgaggtagatagggcaatgacgtaacgatctaccaatagtcgccgtctaaaggtgggctctatagaggcgaccggcaagctggaacaccaacctggaaagagagtgagccacaaggaccaattggaagcctgtgggggatatcgggggcggggctgctggctgtggtacttttgcagctttggtgggctccggcttccttcactccagcccaccgcgtccgagagacttagcagggcgtcaaactggagagcggaaggatggaaccttttattctcaggtggagaggattaagctttgcggtgttagcagaaaatgatcgagctccagaaaatgatttggaggtcagattcgattttaaagtagtactaacaggccgggcgcggtgcctcacgcctgtaatcctagcactttgggaggccgaggtgggcggatcacctgaggttaggagttcgagaccagcctgaccaacatggtgaaaccccgtctctactaaaaatacaaatattagccgggcgtggtggcgggcgtttgtaatcccaattacttgggaggctgaggcaggagaatcgcttgaaccctgcaggcggaggttgcagtgagccgaaatcgcgccactgcactccagcctgggtgacaggacgagactttgtcgcgaaaaataaaataaaacggtaccaatggtattacgatgtgtcacttggcctgtggaagagagagactgagtctcaacccgagctgtcttgcaaaacactaatggcttacgttccgtagtttcactcttatgtgtagtttttatattccatcagggtgatcccttggggactacgctccttgaaacaaggaggacagtgtaagtatgtggtaaacatttggtaaatacggttaatactagttaacctatccagaattacagtttaacatttcctgggcgtctgtctgtatgtggatggtactgtgttagttggggggggtacgtgtatagtaaggcagtctctgcccttagaaagcttacaggcctggctgggcgcggtgactcacgcctgtaatgccagcactctgggaggcgtaggcgggcgaatcacttgaggtcaggagttcgaaaccagcctggccaacatggtgaaaccctgtctctactagaaatacaaaacaaggctgggcacggtggcccacgcatgtaatcccagcaccttgggaggccgatgagggtggatcatgatgtcaggcgatagaaaccatcctggtcaacatggagaaaccccgtctctactaaaaatacaaaaattagccaggcgtggtggcgtgcacctgtagtcccagctactcaggagcctgaggcaggagaatcgcttttacctgggaggcggaggttgcagtgaaccgagatcgcatctcgccactgaactccagcctgggtgacagtgagagtccgtctcaaaaaaaaaaaaaaaaaaagagtggcagataagaagtgctctttatggagataatttggtggtaatgaataaaaagactcagaattccaagcagaaaactaccagagatgaacagtctagccgagtcctctgcaaacgttaggtgggagataattaggatttaacctagaaacgtagtagttaagaatagaaaatagtgaacctaaccaagagagtctgtgacaatggaatccactagactagcagctgactgaatagagaatgagaagactgtgtgcctcaaggtgattatttatagaaacaataaattcaagaagaggagtcaatttgggaatggagctgaaaagcagagagaaaataaggcattcagttttgaaaacatggacttttttttttttttttttttttttttgagacggagtctcgctctgtcacccaggctgtagtgcagtagcacaatctcagttccctacaacctctgcctcgcgggttaaagtgattctcctgcctcagcctcccgactacaggtgtgcgccaccatgcccggctgatttttgtatttttagtagagacagggtttcgccatgttggccaggctggtctcaaactcctgaactcaggtgacctgcctgcctcggcctcccaaatgctgggattacgggcgtgaaccaccgtgcccggcctgaaaacatggactttattaaaagcgaatgaaccatttggtggagacatccaggcaatgaagacttaggataaatgacctctaagatctccatatctgaaatttaagggttctaggaaatgtaagtgtgggagtttgggagaaaagtagacgctgaagatgtacaaattttggactttttcacataaatgtaagtaaagttgtggaagttgatgggatcacaaaggagaatgtaggaaaaaaagaggttccagtcaggtgcggtggcttacacctgtaatcccaacactttgaatggtcaaggtgagaggatcgcctgaagccaggagtttgaggttacagtgagctatgatcatgccattgcactccagcctaggcaacagagtgaacccgtctcttaaaaaaaaaaaaaaaaaaaaaactcccaagacagaaacgtggggaaaagttggcaaaagacatacaaatgatcagagtggtagggagagaattagaagagagaagagccatggaaagcaaatgaagaaagggagggcaggttgtcaatgttaaatgtgatacagaaattaaagatggaggtgatagaggtcaatcgcaagacgttaaggagcgaggaggtggtaccaatattgaacagtggtagcaatatttaacagtaaagcaaggaaagggcagagctgtagcagcagattttcttttggggaataggcaagactcaagcatgtttttagaaaaggcgaatgaggctggatgtggtggctcacgcctgtaaccccagcactttgggattcatctaaaagatgaataattcttttgggaaatactttctgatcaagctatttctaattccaagctctgcttaagaataatgtgtaaaaactatgattgctaaaggaacgattgatttaaattatacatttgtccttttttttgagactgagtttaattcttgttgcccaggctggagtgcaatgatgtgatatctcggctcactgcaacctccccctcccaggttcaagtgattctcctgcctcagctgtggggaaaagaaagagagatcagactgttactgtgtctgtgtagaaagaagtagatataagagactccattttgttcatcttgtgagtcgatggcgcacgattgcggtgtttctgtctccgtggaggtgcttttctttgcatctccgatgggttcattgtagaacttcaaatgtctagtgggtatccaaacaggaagctgattttctcctggtgaaacacaagcaaaacctctcccccatgttaccaccttccctatttcccatgtcttatttttattatctttctaccaaatcagttttccttcatgtgggctgttctttttaccagtaagatgttgttctgcagaagtagtagtctgatttctataaatgtttaaaaaatataaagtgctagattaagttgcatctgaggcgtggtacattccttactgtctcccccttctttttatttaactaattgagttttgagtgttctattagttctttcaactatggcctgtccttgggaattataaggaattcctgttgtatgtgaaattttccactgacttaagaatttttggaaagctttactacagtatcctgccccattgtcagttttaattttttctggaactctcattacagcaaaacaaggtaataaatgttttttaacatgggaagtactttctcctgtctggcaggttgcccatatgaaatgtgaataagtatcaactgttacatgaacatataataatcttccaaatgaaggtacatgcgtgacatccatttgccgtaatgcattaggacacagacccctgggattaactcctgcctcttgagtgggcaggtgtaggacttgacactgggtgcaatgtcgtacaatatcttttgcctgtttccatgtgacatcaaatttgttttttaatcctgctgcatttacatgagtcaaagcatgaaatttttgtgcttttatgaatgcagatgataccagtaagtcagctggttcatttgctttagtcaaaggccctggtaaattagtgtgtgctcgaatatgagtaatataaaatgggaaatttctttttcttacagtttgttgtaataaattgaatagctggtttaactgatcatccatgctatatttaattagagctgtctttacatcccttgtagcctgtactacatatgcagaatctgatacaatattgataggttgatcaaaatcttgtaacactgtaatgactgcaaccaactctgcccttcgagccaattgatattgagttttgattacttgctcttttggccctgtgtaagccgcttttccattgctggaaccatcagtaaacactgtcagagcattttctaaaggttcacgtctggtaattttaggtagaatccaagtagttaattttaaaaactggaagatttttgtttttgggtaatgatgatcaataattcccacaaaattagcaagaccaatctgccatgcaccagaattgataaaggcttgtctaacttgttccttggttcaagggacaactattttgtctgggtcatttacacacaattttattatttgtaatcttgcctgaccaattaatgtagctatttgatccaagtacaatgtaaaagtcttaattgtactgtgaggaaggaatgaccactccacaagatcagtattttgaacagtgatgcctgttggagaatgtgcagtagcaaaaaccaaaagttggagtggggctaagggatctattctatttatttgcactgactgaattttttgttccactaatttaatttcttttattgcctctggggttaatattctcttactatttaagtctgagtctcctcttaagatagagaaccaattttcgaagcatcaaaagcccatttaaatttggtaccagaaactgaggcaatcgcaggagtgactgatggcctcgcaaatcttaaccctgtcacttgggttaagaccatcggaagtactactattataaatttcgtattaatccttgtgtgcctgttttatctgttgttagtctgcaggtgtacccagcagctccgaagagacagcgaccatcgagaacaagccatgatgatgatggtggtttgtcgaaaaggaaatggggaaatgtggggaaaagagagatcagactgttactgtgtctgtgtagaaagaagtagacataagagactccattttgttctgtactaagaaaaattattctgccttgagatgctgttaatctgtaaccctacccccaaccctgtgctccctgaaacacgtgctgtgtcaactcagggttaaatggattaagggctgtgcaggatgtgctttgttaaacaaatgcttgaaggcagcatgcttgttaagagtcatcatcactccctaatctcaagtacccagagacaatacgctgcggaaggccgcagggacctctgcctaggaaagccaggtattgtccaaggtttctccccatgtgatagtctgaaatatgctggccgggaaagacctgaccgtcccccagcccaacacccgtaaagggtctgtgctgaggaggattagtaaaagaggaaggaaggcctctttgcagttgagataagaggaaggcatctgtctcctgctcgtccctgggcaatgggatgtctcggtgtaaaacccgattgtatgttccatctactgagatggggaaaaccgccttagggctggatgtgggacatgctggcagcaatactgctctttaaggcattgagatgtttatgtgtatgcacatcaaaagcacagcacttttttctttaccttgtttatgatgcggagacgtttgttcacatgttttcctgctgaccttctctccactattaccctattgtcctgccacatccccctctccgagaaacgcccaataatgatcaataaatactgagggaactcagagactggtgccggtgcgggtccactgtatgctgagcgccacttccctaagcccacttttctttctctatactttgtctctgtgtctccttcttttcttaagtctctcattccacctgacaagaaatgcccacaagtgtggaggggcaggccaccccttcactcagcctcctgagtagctgggattgcaggtgcgcgccaccatgtctggctaatttttgtgtttttagtagaggcggggtttcaccctgttggccaggttggtcttgaactcctgacctcaggtgatccacccatctgggcctcccaaagttctgagattacaggcatgagtcaccgtgcccagcccatttatccttgatatagctaaattactgagcattaggaagggtggaactttcagcctgtaaaatatgagtgaggtttcacaaaaactagcacaatgtctggggcccagattattctatttgtgactgggcgggaagaggtatatatatagtaatttttgtatttttagtagagacggggtttcaccatgttggccaggctggtcttgaactcctgacgttaagtgatccatctgcctcccaaagtgctgggattacaggtgtgagccaccactttgggccatagatcgggtgattgggggaagacctgaggtatctgagcagaaatctggttggggagtgagccaacagttatctggagggaaactggttcaggcagagggaagagcaaatccaaagctcctaaagcaaaagcatatttttggtgtatttgagaaacagcaagaaggtcaatgtagctaagagccggaataagagaagagatgcaggcagggatgagattgtttttggcttcttaggtcatggtaagaacttggattttattttttgtgtaatgggcacccatcagatggtgttgaggaggggactgacacaaaatcatttaggtattaaactgatccttccgctgctccatggggacccagagtggaagtagtagcaggaaaccaattaggcttttacaatagttcaggtaagagatgacagtgacttggactagggtgtagtagctatggagatggttgaaaatggctagatgtgggatctattttaaaggtaccaccaacagcatttgcagactcaaggatgatttcaaagttttgggtctgagcaactaggtgaatgataacattgtttactgagacggggaggccttaagtagaaggtttaggagggaaaatatagattttgctatggacacattatattctatacagacataatttaaaatagttaccaggtccatcaattgatggataaactatggtatatccatacattggaatattatttgttaataaaaataaatggtcaggcgcagtaccttaagcctgtaatcccagcacttcaggaggctgaggcgggtggagtgcagtggcacgatctcagctcactgcaacctctgcctcccaggttcaagccattctcctgcctcagcctccggagtagctgggattacaggcgcccgccaccacgtccggctactttttgtatttttagtagagatggggtatcaccatatgggccaggctggtcttgaactcctgaccttaggcgattcacccgcctcggcctcccaaagtgctgggattacaggcgtgagccactgcacctgaccactattcactttaaatgggtatactgtatggtatgtgaattataatcgcaatgaatctattctaaaaatatagttattgaaaatatataattataaaaagcattatgaagctattcccccccacaccagaagctattttaataaaagattttaacctactagaaataaaaggaaaattaagtagtcaagagttctaatccttctctgttaaccacaggaaacctggctgtttggactgggtgtctgtgtcaacagaccaccaccaacctggaacagtatttgctaataacaagcaaagtattcctgagtaataatagcttcttgattgttggactcccataaagcagtcattattaagctttttaactttttttttgttggggtgggggtggtgtgcgtaaagtattgcattatgtttactttagtatatattgccaccagtttttccaaatctgatctttgagaatctggtataaactatggttcttctgtcccccaaatgtgcttaagcacaaatacatacatgcaatattatacgtattttaggatgtacatagatcccctgaaaccaaccaatgcagctcagtttctataaaattaaagcaaggtcacaggaattaacagtggcttttatttatccagacttctgctcagcacaatcatatgctcataaatatatgacttgacagttccaaagacctgcagtatggctggttggggtataaattggtacaacatactttggaaagctggtggcaatatatactaaagctgtacataatccaaaacccatgaccttgcaatccctctcctaggtatatatacccgattgaaatgcattctttgcgatgcgggtaaagaggggatggttaatgggtacacaaaatatagaaagaaaagtaagatctagtatttgctatcacaacagggtgactatagtaaaaaataattgttcattaaaaaataactaaaagagaggccaggtgcggtggctcatgcctgtaatcccaacactttgggaggccgagatgggtggattgcctaaggtcaggagttcgagaccagcctgacaaacacggtgaaaccctgtctctattaaaaatacaaaaactagccaggcatggtggcaggtgcctgtaatcctagctactcgggatgctgagtgtggagaatcgcttgaacctgggaggcagaggttgcagtaagccaaggttgcgtcattgcactccagcctgagcaacaagagtgaaactccatctcaaacaaacaagcaaactaagagtataattggattgttggaaacataaaggatagatgtttgaggtgatgaatactgtatttactctgatgtaattattacacattgcatgcctatatcaaacatctcatgtaacccataaatatatacacccactatgtatccacaaaaattaaaaaagagcccgggcatggtggctcacatctgtaatcccagcactttgggaggccaaggcgggcggatcacctggggtcgggagttcgagaccagcccgaccaacacggagaaaccctgtctctactaaaaaatacaaaattagccgggcgtggtggcgcatgcctctaatcccagctacccgggaggctgaggcaggagaatcactggaacctgggaggcggaggttgtggtgagctgagatcgtgccatggcactccagcctgggcaataagagcaaaactccgtctcaaaaaaaaaaaaaaattaaaaaagaaatgcattcttatgttataccaaaacacatattcatagtagttctatttatagttgccccaaactaggtcaatcaaatcttcaaaaaaagtaaaatagttaattcatggtcacaaaacatacatatttcataatttcatttgtataaacctcaaaagcaaaaccaatctatggtatttcaagtcaagattgtggttacctttaagggagaaaatagcaactgggaaaaggtatgaggggggattctagggtgctggtaacgatctgtttcttgatttgggtgctggctatatatgttcactattcattttttaaaaatagacacagagtctcactatgttgcccaggctggtcttaaactcttggcctcaagcagtcctcccacctcggcctcccaaagtgcttggattacgggagtgagccaccattcccagctagccacctcatttaaaatagtattacttggccgggtgcagtggctgacgcctgtaattccagcactttgggaggccgaggcgggttgggatcaagccagcctggcgaacatggtgaaacctcaactctcctaaaattacaaaattagtaatcgagaccattctgggtaacatggtgaaatcccatctctactaaaaatacaaaaaattagctgggcatggtggcgggcgcctgtagtcccagctactcgggaggctgaggcaggagaatggcgtgaacccaggaggcggagcttgcagtgagctgagatggcgccactgcactccagcctgggtgacagagtgagactccgtctcaaaaacaaaaaacaaaaaacaaaacaaacaaacaaaaaacaaaaaaaattaggctgggcgcagtggctcatgcctgtaatcccagcactttgggaggctgatgtgggcggatcacctgaggtcaggagttcaagaccagccttaccaacatggagaaaccccgtctctactaaaaatacaaaaaaaattagccaggcatggtggcatatgcctgtaatcccagctgtcaggcctctgagcccaaaccaagccatcgcatcccctgtgacttgcacgtatacacccagatggcctgaagtaactgaagatccacaaaagaagtaaaaatagccttaactgatgacattccaccattgatttgttcctgtcccaccctaactgatcaatgtactttgtaatctcccccacccttaagaaagttctttgtaattctccccacccttgagaatgtactttgtgagatccacccctgcccgcaaaacattgctctcaacttcaccgcctatcccaaaacctataagaattaatgataatccatctcccttcgctgactctcttttcggcacccaggtgaaataaatacccatgttgctcacacaaagcctgtttggtggcctcttcacacggacgcacatgaaaccagctacttgggaggctgaggcaggagaattgcttgaacccgggaggcggaggttgcggtgacccgagatcacgccattgcactcctgcctgggcaacaagagcaaaattccgtctcagggaaaaaaaaaaaattagctgggtgtggtggggcaggcctgtaatcccagctactcaggaggctgaggcaggagaatcacttgaacctgggaggcggaggttgcagagtcgagatcatgccattgccctccagcctgggcgactgagtgagactccatcttaaaaaaaaaaaaaaaaaaagtcttttattactttttgagcatttaaagagtattttttggccagacggtgtggctcacgcctgtaatcccagtattttgggaggcccaggcgggtggatcacttgaagcctccagcctggccaacatggcaggagaatgactggaacccgggaggtggatgttgcagtgagccaagatggtgtcactgcactccagcctgggtgacagagagagactctgtctcaaagacaaaaagaaaatttgttcagtattttcttcaatcagctttctcagactgaatgttcacccttttaaatattcataatgttcctgagaatccatttggctattctgttttcttcacccttctccagccttcccctcctcaattcgacccatttcttccctacttcccaaaagaaaaaatatctactttggattaatataaatcagtttaatctaacttattcaagacttttttggcctctacttggaggttcaagaaaaggtgtgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttttcctggctcatcctgtctcaaaaagctcccctactgagcaccctgtgacccccactctgtccgccagagaacaacacccctttgactgtaattttcctttatctacccaaatcctataaaacagccgcacccttatcttccttcgctgactctctttttggactcagcccgcctgcacccagaaacatggattcagtcaagaagcccttctgaaggagtagaaggccctagattcccagaactggggctctggctatgttgcccaggctggtcataaactcctggcctcaagtgatcctcctgcctcggcctcccaaagtgctgggattacaggacaccagtctctcccagatgatttctactctatattgtggaagttctatttgctggtgaagctaagaggactgaggttccctaccctatttgtagagcagaagctctatcccaggcctggtaggctgacaatatttagacttcaattgctcccattccagcttgttcgtagattagagattctgcaacagaaaaggcaagtcaagaagaccaggggctaacacctctttcccccagcacctactcatacagcaggtgggtatcactgtaggagaagtgggcccttgtgcagaagttctgcccaggagggaaggaaggcctgaagaatgaagagctccaaagctctgcctgagaggactgactttatttggaacacagtgtggagaattctatgcctaagggtgttgaaaaccatagagatcttggtggagagcaattacaaggtgctgctagctctatggcactggtatgacaaacccaaatggcaaagcctccagaagtttaacaggcagaaccagagaaacagaaagccaagaaaagtccttctggaatcatgaccaacactgggggttgggaagactgtgtgcttgcaccaggctgcacccactcaggagcaatcagagcaggacgtggggcttgacttgagagtattccccagaccacacatagatctatcaaaaaagggtggatgcttcactggcaccaagggctaaagcacaaccactgaaccaacactggctgaacaataagctaccctaactcagaggcaactcctagaaagctaagcttaaaaataataataatagccgggtgtggtggtacacgcctgtagtcccagctacttggaggcttaggcaggaaaacccaggaggcggaggtttcagtcagctgagattgtaccactgcactccagcctgagtgacagagtgagacttcatctcaagaaatgaaaaataaaaaataaaaataaaattaaaaaaatcacatacatccctggtgtatgtccaaggatgtactctctccgagaagaaatcagagagggaacttccaagctgctagttcctcactgaatgtggggcaaaatgtaaactccctgatttgtgatggctatgtcaaaatcacacacacatatccaacagtaaaggataaaaaaatttaattggctaaaaggtcttaagcacaacctttgactaataagtggcttctactgacccactggcaacacacagggagttaggccaaaagataaaaacaagaaaatatgagcagtgacatcagaggctgcacactacaagagaaacagacttcagagagctgctgcaggcaagtcactaaggaaacaaattaccaagcaaacaacacaatcaacctctagtgggaaggagaaaccagtatagcaggtgtccccaacccctggaccatggactggtactggtctgcagcctgttaggaacccggctgcacagcaggaggtgagccatgggtgagtaaagttgagctctgcctcccatcagatcagcagtggcattaggttcccacaggagtgtgaaccctattgtgaactgcacatgggagggatctaggttgcatgttccttgtgagactctaataaatgcaatgcacttgaatcataccgaaaccatccccccgtctcccaccccagtggaaaaactgtcttccacgaaacctgtcctggtgccagaaaagttggggacagctgcagtgtagtatccagagttgcacaattatctaaaatgtccagtttttgacaaaaaagtatgaagtatacaaagaataaattgtgacccattgacccattcagaagaaaaaaagcaggcaatggaaactgcctttgagaacgc

SEQ ID NO: 4677 - DNA, 1050 bp, Homo sapiens
agagggagtcagccgtgaccctgagggcagtgactggctcgccgcgtccctgcatcaggcattcgcccggctttctcgtgattgtttccgggcacccctggcctctcccgacttctccccctcgcgggtccccaagccccgcaagtttgcgacgagctggttctccagggagacagcgagcgcccacccccgctctgcggctgggtgtgtgtggtgagaggaagagacgggaggaggaggcgaggccgactcgccaacgaggaaaacgggttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgc

SEQ ID NO: 4678 - DNA, 991 bp, Homo sapiens
atggggggtggtcgtgacctgcgcccccggccgggttcactcaccagcctcgctctggttgtagcggcggagcaggttcctcagggccactcggtcagtctgtgcgttggccttggcgtaccctgtggtccactcccaatactgcggcccctcttgctccacccacggctcccgcggctccatcctcggaatcgcggcgtcgctgtcgaaccgcaggaattgcgtgtcgtctacgtactccacggcgatgtagcggggctccccgcggccgggccgcgacacagcggtgctgaaatacctcaaggagtgggagcctgggggcgaggaggggctgagacccgccagaccctcctccggaggcggctccctgagtcctgcgcccccaccgggcgggcccctcactcctccccacagaggccgtttctctctggaccccgcactcacccgcccaagtatcggtcagggccagggcccctgagagcagcaggaggaggcttcggggcgccatgaccccaacctccgcgtctgggaaaaatatgagtcccgcggggtgcgtgggactttagaacctgggaactgcggcgacactgattggcttctctagaaacgcgacgcccaatgggagtgagaaatggggccgcgttatgagtatccaggaagaaggacctgacacgggttgggagagaaagagaaactctggggagatggggaattctcaatactgagcctcccaaccccagacaccgcctcggggcctgagcccttgagagccactcctggggccctgggactttgccctccccctccccctccccctcctgtgcagggtgtgtctcaatgtctccctgagtcttcgcccgggggctgagaaaccagggagaaaccttcggcatggacccagtccatctcccttcattattcattccgaaatcccagtcccttgattgaactttctgcctcccattccatacctggactccccggactcttt

SEQ ID NO: 4679 - DNA, 14174 bp, Homo sapiens
gcctacgggtggccgggcgggatgtaaccggctgctgagctggcagttctgtgtcgctaggcttctgcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctgggtacgtgcgccccacaacgcctcccccagccagggcccggggatccccgggagcgtccccggctacctggcgccgctcatcctgggtagggtcggccccctctgaggctgcctggcatgagggagctgcacccctgagcttgacctctgacggccctttgtaatagcattaagtctttgaaactttgtagcggggtagaaggggctaggaaatgaagaaaacatctttttaaaaatataagcagtcggctgggcgaggtggcccacgcctgtaatcccagcactttgggaggtcgaggcaggtggatcacgaggacaggagttcaaaaccagcctggccagcatggtttcactgaaaccccgtctctactaaaaacacaaaaattagtcgggcgtggtggctggtgcctgtaatcccagctacccgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgggaggttgagattacagtgagctgagattatataagcgatcgagcactggaggttgatgttacagtgagctgagattgcgccattgcactccagcctgtgtaacagagggagactctgtctctaaaaaattatatgcaagtgagagcttttcttccagcgctcatgctcagactgaagaaagtaattgggccaggcccggtggctcacgcccgtaatcccagcattttgggaggcggaggcggaagcgggtggatcacttgagctcaggaattccagactagtttgggcaacatggtggaagcctgtctctacaaaaatacaaaaaattagctgggcatggtggcacgcacttgtagtctccgctacttgccgggcttaggcgggagaatcgctcagctgcagcctcgacctccaggggcaatccatttcagcctcccaaagtgctgagattacaggaatgagccatcgtgcctggctttacactatattttaatactttttttgaaaatggaaacttttacaggcaattcacttccttcaaactaatgataaggaagtgatgctgttctgttctgttttgttttttgtttttgtgggttttttttcttttttgagatggggtcttgcccaggttggagtgagttggtgcaaacaaggctcactgcagccttgaccttcgggctcaaggaatccttccctgtcagcctccccggtagctaggactacaggtgcatgctaccacgcttggctaattctttttttgaaatggagtctcactctgtctcccaggctggagtgcagtggtgcaatctcggctcactgcaggctggtctcaacctctgacttcggctggtccacccacttctgcatcccaaagtgctgggattacaagtgtgacccaccgcgcctggcgattttgctcattttagatactagaactttttaatttaaattttttttttcctgagatggagtcttactttgtctccaggctggagtgtagtggcgtaatctcggctcactgcaacctccgcctcctgagttcaagcgattctcctgcctcagcctgccagagttgctgggactacaggtgcgcaccaccacacccaggagttcaaggctgcagtgagccatgatcgtaccactgcactccagcctgggcaacacagcgagaccctgactccacaaataaataaatcaacatcatatgatctgtaccagggtataggcaggtgctatgatccccacttttcatcctcaactctaagttgagtcatacatcaacctctagtaaaaagtggcatgctctcagtcaaaggggtaagcccaaaccacgcggagagaatcttatctcttttgagagctaatataaaaagaattcctcctaggcataaaaatattgtgacaccagttacttaggctaaacatgcctattatgctaagtgagttattaacaataaatactttaactctgtgccatgttaattatcataatctgatttataatttgttttaaccttaggttatatataccttgaagccatttatattttggtatacttgtaataattactatacaccggactatgtatattggactaaacacggagagtcaaaaaagagtatgtggtcagagtagaaatcatgccctagcttccttcgtgtctacctcctaccttgagtagaagtggtagaaaaagtaattacctaagattttttggattctggtttgtggagaagcacccttatatttaggctgatgggcggcaaaattagaaagtattttttgtgatttagaattttatacggagatgttcattgtgattaattattctttgtattagcagatttttgctttttatagctgcatgatttcttgtttattattcattcattattgtctattaataaagaaaaactttatttcactgaagcagtgatatataatccaacttggatttttaaataatgactgactttttttctttgggaatacattactgttaaaaatgtaattattagatacattacttttaatgaatataagtggtataattagaaggctgaaaagaatccttggaaatgtgagtttaatttgatagctaagaaactgaggacaagttacttattctttgtagcatattttctaatgtcatttcattgtctcaccaagaaatacttgcataaagcaagttcaattacagcatctgttgaatatttaaggttgagtaaagtgggtgagtttaacagatattttcccttatttcttttaggcgaatctggattgggaaagttgatattaatcaactcattattcctcacagatttgtattctccagagtatccaggtccttctcagagaattaaaaagcctgtacaggtctacatattggtatttttaattgatgataagctggaataatattaatacacacaaagcacgtgttgtaactttcattatgcttccctagaggtaagatgcaaatttgcccttagccagtgtaagatggtaaatatgacttcataaaatcaaaaaaacagaggaagtacagttaatcgaaagaattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatacatttcaagtgctcaacagccacatgtggcaagtggctgccattttgtgcagcacatatatgaagattttcatcattgtagaaaattgcattggacagtgtagagaaaacatgattcatagaaaaactattgttatttaaatagtgttctatattagtcagtgggataataccatatcatagttgaatggcaatagcaattctgtaaaactcccatgctatatgtgatctaatttactgcttctcagtctttgctacgcattccaatcctgggtatcctgttaaatttatttcttctagtagttctgagatgggctgcctttctacatttctaacaagatcccaggtgatgctgatgccgctggatggtagatcacactttataaagcaaggggctagactctagatatgcactttttattaaatagtacagcagcctgtagccacatgtggctattaatctttgaaatgtgggtagtctgaattgtgatgttctgcaaatataaaatatgccacagatttctaagactgagcatggaaaagaaaatctccgtaattttttatattgattgtatactgcagtgataatattttggatgtatcgggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatgtaggacacgagcagagaggaggcacgtgaacagttctggctgaagtaggcttcattgaggccgtgatgcttttagctggatttgaagaagtggtagtgagcatcccagtgcacaggataggaggacagtctatatattctgagcagtaactcatatatatcatactgcaagaccccaaaggagtaattttttgaagtaaatatcttatttctcctttttaatgtttctattttgggaatttttttttttttagtaaccttcatagggcttgagatttaaaattacctgcaaaattctactctaaaaacttgatcctacatgcttatttattttgtgataaatattggaaattttaaacctaagcaagaaaatgaactttgaactttcttaatttgggtatctattatgaataccttcacttaagtatttatgaatttagatatgaaaggtaaaactaaccactatccaaattaatatacagttcatttccagaaccctagtttcttccatgtgctcactcgcattcagtattacaacccccaaagataaacaccttactgactgccttctccataaatttgcctgttcttgaacgttatatacgtatacttttttgtatctgttttctttcagtgaagattatgtctgtattatttactcatgttgggtgtagttgtttttttcatcgtcgtataatactccattgtgtgaatgtataaagtatatcctttattatttattgtagataagcctttgggttttcagttttttactaacgggaacattcttgtgcatgtcttagtagacttaggcactcattgctgttgtgtgtgcataaagatataaaggtatttgagtttattttatttgatttctagtgaggttgaacatgtcttgtactcaataactgttcagatttcattaaagtcttttggtaatcttaatattttctgtcattttcttgctgatttataggagtttgaaaaatctaataatcccctacattttagatattgcagacattttctccccaggtgagcatctgttaaagatgtgacatgccctcaatttattttagaattcttacattggcttagcttcaaaataaattgcctaaacccattttaccttcctttaaagtaacacttcaaaaatatcctcttctgttgtgaatatcttcccggaaactctctttatcttgaaaacaaaggggtaatggaggtactagagaatatctctagtaggatttttaagacaggcctgtgcaccactgttaaatatcttttctgtaccaaaaagaagacctgtaacatttgagaaccagattgatccttagtagaatcctgtagaagtcctctttcctgattgaaccatagaggtgtattcctttatatactgaaaactagctgaagataatctaaactcttgtgcccagttaggaaagaacatgccatattatggacagggtcagagtcattcaagaagcctgaatatagttagaaaatgagaatgtaatctttttaatagttggctggctctttaccaagcccagtagtcttgaagatataggggaaatagtgtaaacggttgtcaagatgaatctaaaatggaaattaatcagttccctagaatagattgagaaattagctttaggaaaaagataaatttcacacacactgtaccatggaaggtacagtgctgattcagacagactgggaatggtctcatttttaagtggtgatgtgaggtacttcactgagcattgtgacaggcacgggcttgggaagagcctattaggaaatgggagaggcatgagactaaggagcacataagagtaatattagcagagaaattctttttgaggttgaaggtcatgaattttatggtataggaatagaaagaggggttaatccagaatgggatttgagttggaaagggaaagaaataaaggttttgggaaggaggttgctaatagaaaatgagaggggcaagggatttgaggtctcagtaaggagacagggatatgaggagtggagaggttcagaatagaaagccaaattagagttttgggatcaactttcttctcagtaaagtagtcctgggtcttcgtgagaaggaagtattcttcaggcataactgttctactattggttacttcctctttcattgtcttgtggaacacgatgaaacatttaagatgatattcatcttttgagccaataaataagggaaatagatagtttttgtgtttgagctaagtggagtatctcaggccattccaatgtcttcagagttttggctgtaatgctacctcttgagcaagtgtaggtagaggtaagctcttgacagaaaattttaaccctctcttcaaaatgttatatgcttaattaaataacttcttaatttaccttaataaatggcgtataaacattaagttagaaaaggttagtgtatatgaagctgtataatcaacattgtttgactttttttcctcagattgtaaaactgaaaactcagtatactaatactcttgtatactgtatacactcagtattagaaaatgagtacctttgatttctggaatctcggatgccaaaagaggtctcaatagatgaattatacatagatgattcatagacgatagttttagttttatttatttttcagggaaaaacatttgacaatgttcttgattcatttttttggtattaaattatgcagctaatcttagagaaccctgagtgatgccataaaagatgttgatgtggcctgcttaaggaaagtgcacgggaaagtggccatttggaatagatttgttaagaaaagtttgaaattcttggactcgaactaatttgttttccatggatcccatgaggatacttgtaaaagcagatgatagggtccagttggatcctgtgaatggcactagtttgcagttatgttttctggatctcttccatatgtcgctgacttctttgtatttgaccatgtatggacatacagaatttcataggccagagaagaaaagaagctttataaacattccttatgtgtgtaaaatacaaatcttcatttgtcttagcaagtcaataagtaattaagttgttgaactgattttttttttaaacagggaaatatcttaaaatttaagctgttaggttaaaatgtgtgtttggtatacagcatattactgaaggtagaatgggcttcatttggtaataaaggaaccagaaatatttttaagtaaaattgggagatgattcatgtagattaactatatttttgtatcactttctagaatacagtactatgttgtttaaaagagtaagtaggtaaaggagtggtataattactttggatatttctgcgtcagccacagttaccatgaataaatgatctgtctttataaaggagatggaagtgaattcaagatattgagatgttagatttgactgggttgtcctttgactagaagatcaccagataaagaaaatgtaaacttcctaaaccagataagatgatattgttaaaaaatttttttggcccagcactttgggaggctgaaatgggaagattgcttgaacccaggagtttgaagctgcagtaagctatgatctaccatgcactccagcctgggcaacagagtgagaccctgactaaaaaaaaaaattttttttcctttggttctcatgatttcacactgatgaatctgattgttttctctgagtcattttgcctctctcatgttattagggtaacctgataatagacatgttatctgagttatgtggtatgtaacagtgatcttctaaatgatgtgcatccatcactgatactgaggatgatcagaaactattacaactcttatttattgatctttacttttaatctacagataaatgataatacatattaatacttaatattcagattgccaatagtatatatttggtgggtaaatatcttttggatctgcaaaattttcactgatagtttgtatcaggatcaaagcagtttgaagaacattaatctaaaagataagactttggcatctcatttctctaaaagataagtcatgcatgtacacactcaggcaatttttttcagttttataagttttattcttgataataaaattcttttaacagaaaactcttgattgctatagacctctgctgtgtattcagtagtcactagccacatgtggctatttaagttaattcaaattaaataaaattaaatatcagttccttatttgcactagtcagattttaaggagtaagtagccacatgggcaagtggctaccatattggacagtgtggatacacaacaattccatcatctcagaaagtgttattggatagtgtggctacagacttttcttgctcagcaatcttagtctccgcatgttagtctcttcatgcattaggtagcatctataaaacatgccaaaaggaaataggctatctctaaaagtgtcccaaactttttgtcttgtaaattagcttatcagcatacttggagcctcttgccttaaaaaggacttgatataaatgtgtatcaggagaaagcctatcttatgaaggaattattccctttttatttgaatccatgtttgctttatcttcggctcctgaaaactgatactttgcatttaacagcagcatatgcccaggatgaatgataatacatctcctgatacagagcttgaggttacagaatatcttaaattgttccaggaactgttgttatcatttaagtccaataatcagtaagatttcaccctaccagaatacacttttttttattaactgtctggacctttgctgattacattgtccggaatgtggagtatcgcatttgagaagaggattggatcctagccataacataaatataagggtaattacatccatgctgagaaagatttaggaatgatagtaagttcatttgagtgagtggtttgggccaaacttgatagagaatagtccaggaagacatttactataaacagtagattaaatgttcttgcctggttaattacatttgaactctgttaatgactgaatcactcaaactgcttaattgtattattagatgcacatttaagttatgtattacatgtctttagtggtgatcagaattttatcagttcctctgtctttctttataccaagtatgactcataaacccagtattaatttgccaagagattggcatactatttgtatatatgcttttctttcaaataatctggattcccaatgcccacaatcattgatcctaaagaaaatgtgagagtaggtagataaactcaaacatccctaccatcacccctggtaggaaatcactggtgtaatgtatgatattaacatctgcaccaattactcttataggtggaacaatccaaagttttaatcagagaaggtggtgttcagttgctgcttacaatagttgataccccagtatttggagatgcagtggataacagtaattggtaaaaaggatttgtcctcacaactttccagtgtatttggggtactggggtggttaaactttctcttcttaacattttaaaactcttcttagcaaaggtcaccaaacttcaagtaacatgacaggtttgtataccaactttgccacttatttgacaaagtttaacttcaaagttaaacaaagaagtttaacttctttgaacccatttactttttgataaaatggagataatacctatcataaaattgttttgaagacatattccaaaataacgtagctagatagaagaattctcattattggaagaaatttaaaatgctttgctttaattttatccatttgtataaattctatcacaatcctaatttaaacctgatatttagaccttcagtttttccataagtcctaagtgaagaaaacaactatgaaattttagtctgaagtaattatcttagtattttataaataactttaattttgtttgaattcacattgtttttgaggtatttttctgtcaactcttaaaactcctaagttcatcatgaagtttttatattatttaagtaatctctcatttgaaatttgaaactgaatataatcgttttcatattatgaagtgtgttattaatacacttactagtgccaatagtatgctaataatttagctgtgtttcaacaataaatattttctttcatttggaaagttttgaaataatgaataaagatttattcaacacaatttatatttttgaatctttatatagaataacttgacatatcttccattggttaattcattttgcctatttgaaaatattgattattgtcctttaacagtcatcagttaattcatatgtagaattgcaacttaattgttttgtttatttgcattctatagctggcagcctgctatcaattacattgatagtaaatttgaggactacctaaatgcagaatcgcaagtgaacagatgtcagatgcctggtaacagggtgcagtgttgtttatacttcattgctccttcaggacatgggtcagtaacctgatacttctgattcctttttgttgttgttgcttactgttacctttatgtgcatatttgagtaatctttaagtttgtgaagtacatacaactatacccattattaagtaccaaatttcatgtagaaatgtcttagttgaaaagcctttttaagtcctgtgcaagctaacagtgattttactccttagttcttattcataaggattttccctgcttcatggaaataaacagtgttgccaccatggtttgaggtctcaatgtggcaaatttagctttcatgttgaactaccaaataaagagaagcagccaaaccagttagacatattcaaaataaatccagagatgctatttattataagtctcataagagatggttatcaaaagcacttgcatgccaatgttttcttgtgccatttcttaatgcaaaaaatctgtttggcttctgtttcaccttagctgtcatagacatgtttaagtatcatgttgtcagtactaaccttttgtttattaggacataagacctaagaatctagacattaatctgatgcgattgttctgtttgttatagttagcctgtactccctttttttgttctttgtacttcccctttcattttgagtacatatatgtgtcatttgtaactgcagatttttccaattattcttcctcagtcttttcctttgggtaagtaactcagcatacataattcagccacctggtgactgtaactccaccatctctccaccaaaagaactgtagtagcatcaagctacatagcattaagttatctaacactcacattacagtagagtaaaccaattccttcaggtatatctttctcttccatttttggcttctcgctctcttttttttgtttgtttttatagatgggtcaatgcccattatcactctagatggataagggagccttaattatatacttatatttttgcactgtcagattggagtggggtaaaaatgtttcttcttttatgtgtaatactcttgttttttttttggtttttttttttgctgtgccctagaccattacataactgaagactcccaccttcaggcaggtttgggtagtacacgtttgtaactacctggcattgccttttgttgaagtaatttcagtttttattagtagtagtagtagtatactttaagttctacagtatatgttcacaatgtgcaggtttgttacatatgtatacatgtgccatgtttgtttgctgcacccattaactggtcatttacattaggtatttctcctaatactatccctcccccatcctccatgccacgacaggccctagtgtatgatatttcccgccctgtgtccaagtgttctcattgttcaattcctacctatgagtgagaaatacctatgcggtgtttgggtttctgtccttgtgatagtttgctcagaatgatggttaacagcttcatccatgtccctgcaaaggacatgaactcatccttttttatggctgcatagtattccacagtgtatatgtgccacattttcttaatccagtctatcattttatggtgttctcagtttatatatttaaatcactaaactgactctttgacttaaaaggctcaaaaaaagtcatctcaaaaatacaacacactttataaccttttataagtatttgtgtagcttcttgaatttatatttttaaatcattctcatttaacttgtcagggccttttcctgaaagccaggagagtgaaatcttaacctgcagttaagtcaataaaatttgtcagcttataaccaattttattattttagattttctggactctctccaactacagtaattctcatgaaatcacattcctgccatccccttggggaaaattttatttcttaaaattgcatgggaaatgagagcttttttaaaagaaaaaaagttttatattcaaatgatatgtagtggctttgtgccatttcttattcatcacaaggggtaagatgtttaaaattgctatatcttatatataaaaatgtacctttgaataatttctcagtttaactatttttagaaatggagcaaagttttgcccattggtacatgatattgtggattaagtgaaagaatatgaggctgggtgcggtggctcacgcctgtaatcccagcactttgagaggctgaggcaggtggatcacctgaggtcgagagttcgagaccagcctgaccaacatggagcaaccccgtgtctactaaaaatacaaaattagctggccgtggtggcgcatgcctgtaatcccagcgactagggaggctgagtcaggacagttgcttgaacctgggagatggagtttgcggtgaaccgagatcacaccattgcactccagcctgggcaatgagagtgaaactccatctcaaaaaaaaaaaaaaagaatatgacacagaattttatgtatagagttccaggtaccctgctcactacagactgaaattctgtgcagtctaataaatgaatcagagcctttccatcttgtctgggtagtccctaggttccctttttagagggttttgtttttagagtgattataaattcatccaacagtgcactttcagtgcctcctacctccctctaccaagtatgaactgcatgcatggctgatatatgattttggctattatcgcttcatgtgcattgttcactattttgtaactgttattaaagtaaaatactgacttggaacatgaattttaaaatggtgttttatccttctagtattgattcccacttttagaaaaattggtgtcattcagtgagttttatatagaaggattttttcccttagaaatacatacatacatacatacaaaaaaaatttgttattttccctgtagttgtttattatgctgtagaatttgaggctaaatagtcttttctctctgctgtgggtttatcttctagaaatgataaaggattttctattgcttaaaaacaagatttaaaaactaaatttgttgacgaaaagactagccaatataaatctaaatggacagagggaaaaaattcaaccagaatgtaatacacatgtgaactaaatgttttctgttgctgacgttttgtaggcttctgaaatttaatgagacttttacaaggtttaccttttttcctagagtttaatttttaaactgacttaaatgttttttgacactttggttatatttaagaagttgacttctctaatttccttgtcatgtttatttttaaatatctttctctttaaaagttggg

SEQ ID NO: 4680 - DNA, 2502 bp, Homo sapiens
tttttcccaccctcgcaccgctgccccaggccatcggcactttctctgcggcccgatgtcctcccctgccgcggcccgcgcttccaccagcgtgcccgccgccgccggccctacgcccgaggtcaccgtggcggcccgcgtctccttctccagttcgtcctggtccagcagcggcggccccgcttaagtcccgggcgccaatagggtccgaaggcgccaccgctgagacgcacgcggcccctgccgtggccatagcactgtcgccagcgcctgaaccaacaccgctccgcaccggctctggcgccagccccagtcctgcctcggtgaaggatccgcccggggcgcctgcagcgcgctgagcccaggggcgccgctcggtacacgccgcaccgctcccgaggccgattgcaacgagggaagtcacccagctgaggtgtcccgatctgtgcattcgagtggtgtgggggtgaagccgctgagaagcggtccgcaggatccagttcaggccggcctttggccagcgcaaccgggaaactagctctctctccgagaacctcctaaccatgtgcggaccaggaactacacttcccaggatgcagcccgaggagtcccggcatcccccggccatgacagccaaggacgtggtcagaccggggtcggtgggagcaggacaggcggctccgcgacgaccaccacgctctccccttcaggcccagtccgggatccctgccggccgttaagtctgagccctcccaggctcacaccaagccagcaaagtgctgctcagctgctgcagctaaaatcgggggactacatttggggtgcgcggcctggctactctggctgcaggccgagggttgaacgtttattcatcacaattaacagcctatacaagcatctctagaacagaggctgtgggtccaaacgggtccctgcagctccaaccctctggcctctccgggcactgccctcacagccgatggagcatggctgggcaggcagacaggacacaggctcagtcacagggtgtcagggggaagctcttctagctggaatgattggaagttggcccagcggctggggctggtctgtcccttcccctcctgggaagttccacctccactgtagttaaggccaccaggatgaaagcagggttaggtccagggacccagtagagccttgggatgcatgaggtgggggtaaatgggcttggcagagaaatggagattgggaaggggcctgattagaatagaaactgatgatgttggttcagcacctgcaagatgaggaaggtgactgcagcaaccttagagcttcccaaaggaagcaagtgatgcccccatctgccaagagggtacctccttcagcccttggcacaagagccagaccaaggtgtccagggaactccacaggacagaagccctgccgaggttagggggatggtgggtgaaggaaagtcttcctggggcctgcagcccagtctcaaacaaggaacaaggacatggctcactggtcctcatttgtgagccagtaggcagggagcgagccttctctagggtagatcacagcctggggaattttccttagggttaggatgcatccacggagacagacaggttagggccagtttccgggaagctcagtcaagtgctctgggctcctcaggcctctcaggcagaccttttctgtagggcagtgccccctaggctgcagctctgacctttaggaaaagatggaacgaagcttggctgatcccatgcccactagcatgcaccagggtccccaaaccaactagatgggcaggggctgggcccatggggtccggaatggagggtggggccactagacctggggtggggaggagatgggggcacagcccccagggtccatggtgttccagagtcccctgagtttcaggttcagctgatgtagatacgatggaagtcgtgggcaccaaaggccgcgttgcacttggggcacttcctctggcgggcctcatagcggccccgcacgcactcgaagcagaaaacgtggaagcacttggtaaggactgcatccttcttgcgggtgttacagcaggggcaggtcaaccgcgcctgggccaggcaaaggcatcagcttgggaacaactctgacagtgcccagaccccaagctgacagcaggaggagtccaggccaagcccaccacactggagactgcacctcatcctcccataaccctggaggtaaggacgagcactctatgaatgagcaaactgaggtgcagaggccaaggtctcaacactagaaatcagcagagtccggattcatcactgggcagtgatggctatcatgtgtcccctcaaaaggacaaggacccacaggcccagcctggactctgccttggggcttcatctcctgccccactggccgcctctggtgaaatcccaatcttgtctacctcttcacctgcacttgctaagtcacagctggaatggcaatgcaactagaaatctgttctct

SEQ ID NO: 4681 - DNA, 619 bp, Homo sapiens
aagaagcagtcttggacctttcatcttcagagaatgtcacaaggaacagagataagccacccctgctgagccctgcccaatctgcagattcgcactggggaaactctttttctccttactcctggagattctgatttcactgtgcgacctgatggggagttgccaggagaaggactgcgtcggcctttggaagctggtgaagccgcacttgcctggacctctcctggagactcagctgctaagtgattcatttcagatccatctcctttaactgggattggttttaccacctgaatcaaagtattccaatattttgattacttaaaaatataaaaggaataccctttgccatctcaatatggcttcaatgaagaatttcctaccaccattctacggcagttagctgctctcccgctgcatgaaggtaacaatgttgactagcaacatctagaatatgaagactgctgtacaaggctgcttctgctggtattgagggagagaagaagctctagccagaagacaaaggaggcttcaactgtttaatattagttcctttaaaaaatacacatccaactgcactgcagcaagtacaataaaatattaacatttattaaataca

SEQ ID NO: 4682 - DNA, 9201 bp, Homo sapiens
gcagtccctaggactgggtctagtaggaggcggtggagcggccgtgctggggtcgacggggtactttggactacagagccgctccactggctcttccggcgttcccggacgccgctgacgcacctgattctcgcgacctgcaggagaagcctcggccggggcgagggccgaggtcgtgacgggcatgaccgtctctctgcttggttaggacatggtctgactgtcacccaggctggcgcgatctcaggctcaagtggtcctcccacctcagtctcctggaaagctaagactacaggcacgcaccaccacgtccagttagcgtgtatgtatgtatgtacgtacgtgtgtgtgtgtgtgtatgtgtatatatgtaactcctcctcccctcccccctccccttctcttcttttctttctagatggggtttcgccacgttgcccaggacggttttgaactcctggggccaagcgatctgccttcctcggcctcccaaagtgctgggattgcaggtgcgagccactgctcctggcccataagtctttcagtgtagaagagggaagcagaagaggtcaaagtggtgccatgtgagagctcaacccacccttgctggaggaagggagccagagccaagctggaaaaggcaaggaaacaacctttgtgattacattaggcccatccagatgatccaggataatttattttacagtcatctgattagcaacttaattctcttctgtcatgttaggtaacatattcatatgtttcagagtggtaggccattattctacctaccataccacccaacacaaatctacattaagactatatctgagtgttgcacaggaatctatgtcaacaagcttccaggatgatcctgtgcatcctatctgatgcagcccagcatctgagtaccagagactagcatctggctgttaggttaggagagatcagctcatgcaccaacaggtagtcatgctgggaccaaatgatgaagataggtacaactagtcccagtgagagctggggaattgggctgggataatagaggatgttaagaatggagtgtcccctcaaccccagaacttttttttctttttttgtggtaaggagggagaaggctgtttggtaaggatgttgtaaactctgagaaagcaagaatttcaaaagtcaagggtagtattggggggaaaatcactagaatttgtgtgtgtgtaccctaactactgttttggttttgtttttgttttttagaaggagtctcactctgtcgcccaggctggagtgcagtggcatgatctcagctcactgcaagctccacctcccgagttcacgccattctcttgcctcagcctcccgagtagctgggactacaggcacctgccaccacgcccggctaattttttgtatttttagtagagacagggtttcaccgttgttagccaggatggtctcgatctcctgaccttgtgatccgcccgcctcggcctcccaaagtgctgggattacaggcgtgagccaccgcgcccaggccctaactgctgttttttaaaaaactttttaggtcacaacctatctgtaaatatgacacaccagtatggaaatccttattcttctcacagccaccagctattggcccatccactgactatcccaattccacctgccttatcagtggaaaggtgaaatgtatgcccactttttcctcacaccattcccctttctatcaaaaactaccaagagaaacccaggacctaccaaaatagttaagatgtgctccactgtgtctactgccagccaaacctgttgaaggctggctcaaccctaatctgtgccttcctgtcttctcacaaacgtagtctgatttgctggctagatttctagtaacagccacagagcagaaatgtgtcccttcccaatatgtcacataatccccaagagcctcaggccagaagtccacaacatgtaactagttcaaaggataaaatttttctctgcattaattctaacatgaggaatactgaaaactcttttaaacatctgaagaatttcagcaattcacaattcaccttactggagtgttacactgtcatccagatttagaaacaggaggatataaaactattaaatggaaaagcctagagaactaaattgcatttttttttttttttctgagacagagtctccctctgccccccaggctggagtgcagtggctcgatttctgctcactgcaacctcctcccgggttcaagcgattctcctgccttagcttcctgaatagctgggattacaggcacacactaccatgcctggctaatttttatacttttagtagagaggggttttcaccatgttggccagcctggtctcaaactgctgacctcaggcgatccccctgccttggcctcccaaagtgctgggattataggcgtgagccaccccacctggccctaaattgcatttttttttttgtttttttttttcagatgggatcactgttgcccagactggagtgcagtggcacgatcatggctcaccgcagccttgacctcccgggctcaagtgatctttccacctcagcctctcaagtagctgggactataggcatgtgccaccagctaaattttttgtattttttgcagagacaagatttcgccatgttgcccaggctggtctcgaactcctgggctatagggatccacccaccttggcttcccaaagtgctaggattacaggcgtgagccaccgtgcccagcccacatgtatttttaagagtaaaaatagccaggcacagtggagtatacctgtagtaccagctacttgggagggtaaggtaggaggatcacttgaacctgggagctcaaggttgctttgagctgtgatggcaccactgcactccagccttggggacagagcaagaccccatcacctgtgcccggccagctcacacctgtaatcccagcactttgggaggcgagacgggtcacctgcggtcaggaattcaagaccagcctggtcaacatggtgaaaccctgtctctactaaaaatacaaaaattagctgggcatggtggcgggcgcctataatcccagctactcgggagtctgaggcaggagaatctcttgaactcaggaggtggaggttgcagtgagccaagattgcaccactgcactccagcctgggcgacagagtgagactccatctcaaaaataaataaatgaataagataaaataaaaatacaaaaattagccgggtgtagtggtgggtgtctgtaatcccagctactcagaagttgaggcagaactgcttgaacccgggaggcagaggttgcagtgagccaagatcatgccactgcactccagcctgggcgacagagcaagactgtctcaaaaaataaaataaataaaaattttaaaaatacataaatatatatataaataggtacatatatggtataggacataagaaataacaaaaggagaagaatttagttctgtaggtcagataatttaataaatatttcaaataaatatataataaaaactgaaataaaatgtcaagaatggggaactaatggtattaagttttatatagaagggcatgagggaagtgtattaaaatttgttcaaatttatgactgagagggctaagaaggtacttaatttcctcagatgatactttgcgaacatgtggtctatttggttgacctttgcaaatagttgaacaaccacaccgtgtattcccataccccctagactgcctgtccaggccaagccttagtaccacgagtccacagtgaagtccactccaggttatctgcataggtagcccaggcacctttcctcttttcctttaggtgcctcccctctacccacaacctcttatttcatctcaaacacagctattacaacatgttttatttcactggaaaattctgtaaagaactaaatctggttcccttgaagaaaacatttagcacagcttaaataaaagttgagaaggagggtaagagtgcattgccccattctagctctgttgctaccttacctctgactctaaggccctgtgggatgaaaagcaggtatccaaaagaactctgcttggccctctgatacggccttgaggtcagccctggtgcctgctttctggcccacagaccgctgaaatcctaggagctgccatgggagttaccaaaaatatgtgaataaactgaatgcagaggctgaggcaggtggatcaactgaggtcaggagtctaagaccagcctggccaacatggtaaaaccccatctctactaaaaatacaaaaattagctgagcgtggtggcgggcacctgtaatcccagctactcaggagactgaggcaggagaatcatttgaacccgggaggcagatgttgccagtgagctgagatcacgccattgcactccagcctgggcgacaagagcaaaactcaaaaaaaaaaaaaaaaaaaaaaaaggaaaaacaaaacccagaatgcagaaactgcattggtattttgagctagttacaggcagtaacacttctactaggaaggaaaatatataatttatccaaaaatagttctaagatttagaaaaacatctcaatcctctagggccaagacctgccccttatttacattcacaaagccattaagtgaacccagaactgaccagcagacagtgaggcagggcctgctctgtggcacatgccagtcacctactgcgtaagtggacaaagagaaagcagaaggtaatggagagagttttcatttgcttatttagtgaaaaacagaggaaaatcactcgaggcaaaagaagcaggactgagtcctgggttagttctgattcctcacaagccctaagacaagattttgaaagattggactaatgtcatgtgtccttaagaaccagggtcagcaagtggctgatctgaatggtttgtggccatggaaccaatgtgacttattctttttcatttttttccctaaaaatccaggtggataaaggactgtgtggggaaagtaccaaataaatgaggtaaaaaggaagggtcatacaaagagggcactacaccagcttcttggcctcaaagaagctcttgaggtgacgcatctgccagatgccagtgaggatgaggatgacagtctgagcaatggaccaccataggaccctctggttggtgctctcgctcgtcagtcggaagcgctcttcacgatactgtgtggggcaacacagggttaagtgagcaggagaaacagtctggctgttgtgaggtccctccctgcgtgtaattactcaactccaggaccaaactccttttggaatactatctgtgactccattaggagtgctatggtctccccactgaggctgccccaagaaagggacaggctgtccctccacaagcatctctgttaggactgaaatcatgatcctaccatttccaacaagagtccaagaaaaacaggtaggcaatggctattactagattgtgaactgtcctttcttcattttattttatagagcttaaaaatgactactgaaagcgaaatgtggcacatgcatacaatggaatattagccttaagaaattctgacacatgctataacatggatgaactgtgagaacattatactcagtgaaataagccagtcacaaaaggacaaatactgaatgattccacttatatgagatagggtagtcaggatcatagagacagaaagtagaatggtgggtgtcaggacaaaaggaaacgggaagttattgtttataataagtacagatttgctgggtgcagtggctcacgcctgtaatcccaacactttgggaggctgcggcagtggattgcctgaggccaggagttcaagaccagcctggccaacatggtgaaacccagtctctactaaaaacacaaaaatgagccacgcatggtggcacttgcctgtaatcccagctacttgggaggctgaggcaggagaatcgcttgaacctgggaggcggagggtgcagtgagccgagatggcgccactgcgctccagcctgggcaacagagcgagactccatctcaaaaacaaaacaaaataagtacagatttttagtttgagaagatgaaaaagttctggagctggatgatggtgttggtagcacaacattatgaaggcacttaataccactgaactatatagacagttaaaatgacacatttggtgttatattttaccacaataaaatgttttgataaaaaagcaaaacaggcagggcgcggtagctcacacctgtaatcccagcactttgggaggctgaggcgggcggatcacttgatgtcgggagttcgagaccagcctgaccaacgtggagaaacccccgtctctactaaaagtacaaaattagccaggcatggtggcgcatgcctgtaatcccagctactcaggaggctgaggcaggagaatcgcttgaacctggggaggcggaggttgcagtgagccaagatcatggcattgcactccagcatgggcaacaagagtgaaactccgtctcaaaaacaacaaacaaacaacctatctaaaccaatacttctcattccattctctgcagagctgatctcccaagcagaaacttgagtaggtatagtgggtataaaggtcaactgccctctcaaattacaaggagatatgcacttgccctttggtaatcctgctccttctgaatctgttccacctgatcaagcaactggcgggcgcggagctgtagctccgtcagcttatcttttgcagcaatctcagggtagttgttggcatgctccccaacctggatgtcgagatgcacccgctacaaggaaacatggaatgtatgagtggtggggcctccagttgtctgttccagggtatggaacccactattgtccctggctgtggagcagaaggcaacatctgtctccccaattctgactgtgctacaaagtttcacaatcttgataaatcaaaatttggaaacaagtgagagattctaagctgaagccaaagagaaaatcctcttaccagtttgccaccagcgaagagagccatcctggtagaattggagtgcagacagatttgatggtcaccgggcgtgtgggaggtgaacgtgaagcggccctccgagccgtactgccgggacagcaccacctgcaacatcttgccgtcggggtccttcacttccacgtgcatgcccaggccaggggtcgagggcaggaagacctccttctgcttatcccacatctgggtacgatagttgcctgcggggcagacacatagtcacgaccggccctagtgggccgcctctccgcccggccccctccgacgtgcggcccggagctctaggcagggggcctggcgtcctcggggcaccctcaggctaggtactgggggagccagcgacccggctgggctcgggaggagggagcgccgccgagggctgagctgggtacaaagggcctccccaccctcagcccgcctgaccgatgaccatggtctcgtcggggatttcctcgatgaaacagcgcttctcggtctcgccgatgtggaagtagagcccctgggcgcctgtggcgcacagcgcgagaagcagcagggcctgccgccccatcgcccgcagaggcccagccccgacacctgccatcgcgcctcagcccctaagcgcctgcgcacatttgcgcatcgctctgcgcctgcgcgccaccctagcgaccctgagagttaggggaagaggacgcctgcgcagtgatatgtactcgccgtctcctgcaactccatccgtaccgaacactgccgcgccccgccccctcacacagcccggcgcccgcctacccccgcaacgagagtagagggcgcatgcgcaatgacgttcgcccttaatttctcgccccttaccccgcagcttacctccggcatctcgcaggggaggcacgcctgcgcagtcacgcccgccctcggccccagtcagcgatttgggtctcggagcaccaaggagacggtggacggaatctgaccaggcttggtggctacgatggcctgaagcgtgccttttgggttctcagctcgggctcacaagtgttttctgtgctaaatacaaaaagccctgtgatgttttgctttgcgtgtccacctatctgactcgtaagaaccgaggctgaatccagacccacactctgtcacgtcgggagagcctgccgcggcgagcctctgcgagcgggcatttcttgggtggggaccaaaagcccagtgctgccatagtttcggatcattcttttaagaagctggggccgggcgcggtggctggcacctgtaatcccagcactctgggaggctgaggcgggcggatcccttgagcccaggagttcgggaccagcctgggcaacatggtgaaacccccgtctctacaaaaaattaaccggtgtggtggtgtgcgcatgtagtcccagctacttgggaggctgaggcaggagaatcgcttgaacccaggaggtcgaggatgcattaagcagtgatcgcgctccagcctgggcgaccgagggtgataccttgtcttaaaaaaaaggtgggagagtggaacgaaaacttggaataagtagggtcatggagcttgtttacatcccctagttacagcacatccttttgaaagtgaaaaacaaactggaatgttacttagtgggcatggaatcgaagcaacggaaggttaaaactgtttttatcaaggccaggcgggcgcggtggctcacgcctgtaatgctaacactttgggcggccaaggctggtggatcatctgaggttagaaattcgagaccagttgggccaacaaggtgaaacccccgtctctactaaaaatacattttatcaacagaatttcgaaacttttatataatagaataattacaatgaactttcataaagaacttgagcatacctggattttggtatccgtaggggtccaggaattatcccccttggataataacggagggctgtactcatcatccaacttcaacaacagtttgctgcctttctcatttcatgtatccctttctgcatttttttttgaagtgctgtatattaaagcaaatcctggacatcatgtcatttcacctataaatacgtcagtgtgtgtctctaacagataaggactttatactattatcacacccaccaaaattttaaaaatta

SEQ ID NO: 4683 - DNA, 694 bp, Homo sapiens
tcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaata

SEQ ID NO: 4684 - DNA, 1561 bp, Homo sapiens
gctgttttcttttttgcctctgtccccaacaatttgaccacaagtcctaccccacctcctctgtttttcaccatcccccaggatataaagtgtcatggttaggatcggccagggtgaagagaatgataacataagtagcctcctttcacctaaagtattaccactggttcttatcctatttcctcaaaataaatgagaagagaaagtaaggaataagaggaagaaactttttttttttttttaaagaaacagggtctcactatgtttcctttttcttttttcttttcttttctttcttttttttttttttttttttgagacagagtcttgctctgtcacccaggctggaatgcagtggcgcgatctcggctcactgcaagctccgcctcccgggttcacgccattctcctgcctcagcctcctgagtagctgggactacaggtgcccgctagcacgcccagctaattttttttgtttttttttagtagagacagggtttcaccgtgttagccaggatggtctcgatctcctgacctcgtgatactgcactccagtctgggcaacagagcaaaatcctatctcaaaaaaaatatatatattatccagccccaaatgtttggattaggtaatgaaattacaagaagaactggaggagcaaaaaaggcaaggcaggcacgattgcccagatatgagtgcgccaccatgcctggctaattttttttaggagagataggctctcactatgttgcccaggctggtctcaaacccctgggctcaagtgatcctcccatcttggcctcccaaattgttgggattataggcatgacccactgcacccagacagggccttttcactgcataagaaatcaccttggccaggcatagtggcttacacctataatcccagcactttggagggccaaggcaggtggattgcttgagcccaggagttcgagaccagcctgggcaacatggcgaaatcccatctctacaaaaaatacaaaaagtagtcggcattgtggcatgtgcctgtagtgccagctacttgggaggctgagatgggagaatcgcttgagcccaggagtttgaggctgcagtgagctgagatcatgccactgcactccatcctgggtgacagagcaagaccctgtctcaaaaaaaaacaaaaaacaaacaaaaaaccctcaaaatttagcagcttaaaacaacaatcattatctcttacaattctgataattgaatgagctcagctgagcagttcttcatatgctatattatttaattaatctgagggattaattaaaaggtccaagatggctaacttgtatgaccattagctggtactatcaggtgggatctcagctggggtggccagttgcagcgccctgattctcctccatgtggcttgagctttctttagcttagtgggattctaagaatgaacatctcaagagtgttaccagggggaaggaagtagaaactgctagtcctcctaagtgctgggctcagaagtcccaaaacagctcctccatcacattctattggtcagagcaattgcagg

SEQ ID NO: 4685 - DNA, 6061 bp, Homo sapiens
ggagagtgctaagaatcgcgcggctggcaggtgcggccaccgggacgcgctcgcaggctagccagggacgtgcgcaccttcggggcgctccacagccctgggacgacgccaccaggtttcttctcttcattcactcacccacccacccacccatccatccaaccgcagcaagcgctgttctatgaggccacaacctgacccaaaggaccccgcccccatcggccgcctaaactccagagcacgagcaagaaagtggagggccacgggctgcagcgtagccgagtttgaatactggttccatagctggctagctgtacgacctcgggcaagttatcacaaaacagggagaatcccggcacctaactcggaacggtcacaggctgagatgatattactgtgtgaagtgcgcagagcggtgttgggcacatggtcatcggaactatgttcgttatttttataagtatctttaagtggggggaatctgctccactaggcttccaggtacctaccgtccaagaaaggaagccaggaagtgcaaaccaacataattactatgaaaaacgtagtttctaagacctgtgtaactcttctagtgttctattacaagtagcccccagttatctcttgaaggaaactgtaaaacaatcttgccaatgagaaggacggacctggatcattttttagcatagtaaaagagagaaaccagagagaatgaattctaacactcaagttttggggggaaagaaaagactttattctttgcagggggtttagagctttacctgaattatctcatttaaccctcacaattctcaaatcgtttcattatcatattttacagataagaactgaagcgtggcaagattaaggaagttgctcaacttcacatagtcagaacatgactctagggagtagaggctagcgaagtggggtgcaagaggtcatccaaatttcttgaaataccagatctttttacctcatcatatatgttagattgtcagttttatcgttttcttcccagctttattatttgacaaaaaattatatatattcaaggtgtacaatgtgatgactggatataattatacattgtgtaatgattaccaaaatcaaattaagtaaaacatccttcactaatttatgtagtagttcggtgggggggcacttaagcaaatttgtcttagcaaacttcaagtaaacaatacagaattattagctatagtcaacatgttgtacattagattcccagaacttgtcttaaaactgaaaacttgtaccatttgagagagaagttttagtgttactgaaatcacagacttctgacagaatttgcaggatgctatacacaactacacaaaagtgcaaacaatagtttcttggaccaagagtcaaaaaggtcacttttttaatatattagtcaagcagacagggctatactttataaataaatacacattatctggggataagtgtttaaaaaattctttactcatataatacaaaacaggcttggggatcagtcttgaagcatgaatttttacccagtgggccatgttgagggggttgcagcacaggcccagaaaggaaagcaggctggggctctgagggcttgtgagacgaggacgctgggctgagaagatagggcttcactaggcggagggccccagggtaccccatacacaagcctgccttggcttctcgtccaatttggtgcatctcacactacacagccctgccccaccctggtgtcagcaggcattcagaaagcctcacacttctgctccagtgaacactgccaggatagccctctgaacttccacccacccatcttctgcccatttgttttctttgtcttcaattccactgctacccatcctaccccagtcccttagcctgacaaggcccaagtgtctccaccctgtgctgcagggcagttaagcaggatcagatgccgtgccaatggcctgctctgagctttggcctctctctgcagttgtatctaatagaacaaatacagtaattgtggagctgagcttaaaatattcagacctcaggtttcagagtctgactggcatgggtttgacacctgcctcttagaagctctacttctggccaggcacggtggctcacgcctgtaatccctgcactttgggaggccaaggcaggtggatcacgaggtcaggggtttgagaccagcctgaccaacatggtgaaaccccatctctactaaaaatacaaaaattagctgggtgcagtggtgggcgtctgtaatcccagctactcaggaggctgaggcaggagaattgcttgaacccaggaggcaaggctgcagtgagccaagatcgcaccactgcactccatcctgggtgacagagcaagactgtctccaaaaaaaaaaaaaaaaaaaaaattagccaggcatggtggcgtgcacctgtagtcccagctactcagaaggctgaggcaagagaatcgcttgaacctgggaggcagaggttgtggtgagccaagatcacgccactgcactccagtctgggcaacagagtgagactccgtctcaaaaaaaaaaaaaaaaaaaaaaaaaaaaaaaaaaagctctgcttccttctggaagtaacctctctgaggctgttttgtcacctgtaaaatggggataattttgtttatcctaattatccccattttacagactaggaaaacaagcattggaagtgccaatactaaactgaggtgaacgcacaaaataagcagctttttctctccacagttggaaacactgccatttgccttaaaaagaagtgtgtaaaaaacattttttaataggaataaagccaagtagtcttagccaccactgccctaaatgtaagcagagacaccattttctgcagtgtgcatcaggcacataccacaggtgtacaaagaaggaaatatactgatgttagaatgaaagtgttgccatcattaaagttttcagttggccaagtcaactgcccttcatacttgctcccaacactcacctcccctcctccactcatcatgacacagatgtacattcagtacctacctgtatgttcgtccacacgtctaatgaccgaacatggctgcatttcacatacttgacccatgaaagtaggaggcgtgccctcatgcatgaaccactttccttttttaacacaatcacaaaccttttccacttaaatgttactcatggctgtgaaactgaatccacatgttcctggcactttgactcacctaccctggccttaaagcgagaccctttccctatctttttacctatagatgttatccctagtgtcctaatagggtttaatctatgatggaggattttaacagattttattaaccatgtgtcatatgctgggtgctgtggagcaagactcagttaactatatgtaagctcccatcctgacacactttatgaaatgagaaaggagctgaaagataattcaagagaagggtatgaaactgaagaatgccttgtcatcaaagggcaggaagtaccttagctgggttatcccagtctggcacctggtcctcagtcttcaagttcagaaactcaggtcatcatttcctaggaactgggtggattctgggagattgcctcacaccaaccaaactcacaagagattcagtaataagccagagtgccattttttttccttcacaatggaaaatgaacctgatactgcagtttatcttaacagagcacacctacactatggggaagtctacttaagagaccaaatgatagatcagagggttgtctggtaaacttagattcccaagtcagctggaaacatacctagagataatctcttagggtagaatagttgcctgtgagaagtttgcccaaagtactgaagctttatagtttgaatgagtcatttgctaacctgagtctccaaacaccttactctcgccctcacttacagaaattagagatacaggtatggaagttagtcccacatgatagtaagatgccaaagaatctgatatggagagatgtctgaaagcagaactctcagaaacaaatttagtaagaggggaggaggcaaagtgtccaaataagaaatattcaaagtgaagggaaaaccaagggtacagtatctcgagagccaaaagaagggttaagaagagatggtccactatcaaatgtgacagaaatagataacactttccaagtggaaaatcacttgtgacctttgagagtagtttaacagagcaacgagagtagatgtctgattgctaaatcatctctaactcattcttcagagttaagtttgcaacacagccggacgcggtagctcacgcctgtaatcctagcactttgggaggccaaggctggcggattgcctgagctcaggagttcgagaccagcctgggcaacacggtgaaaccccgtctctactaaaatacaaaagaaattagctgggtgtggcggcgtgcgcctgtagtccccgctactcgggaggctgaggcagaattgcttaaacccgggaggcaaaggttgcaataagccaagatcacaccactgcactccagcctgggcaacagcgcgagactctgtctctaccaaaaaaaaaaaaaaaaaaagtttgcaacacaaagcaataaggtttgtgataacatcttaatcaatgaactggtctttattgaacaaataccctgcagtctgcaccacaggagtcaccttttgtttatgagaggcaggagactacagtgcaaagaacactggctgggaagtccagggcccaagcagcagagtgttcactggtccttaactttcagaagaactgcagagagcctcctttctctctggatgaatgtgtttcaacatttctaactgagagtagggctaactgatcaggtacccccactggctctaacctcacagctctagcatttgcagttccctctgccaggaaatctcttcccccagatacccacacagctcactccctgacctcctcctcagctttgcccaaatgtcaaattatcaccttcttgttcagaagatcttccctactccccatttccttgcacaacccagccccattccctgctttacattcctccatgacactaatcaccatctgatgtactgttttcctgatctgtttattgtcatttttccccactagacttcaagttccatgaaagagatttattttgtcctctgttctgtggtgtgcttggcataaagtagataagcaagcatctgctgaaggaatgaattaaatgccagctgcaatccccaaattacagtagatacacgggaaaattttctttaggaggctgaattctaacagcatgatatcaaacaaggatagggtcaatacagaggccagtgctgtttgaaagtcatcatttcaatggtaactccttcacttgtgctggactcggtctcccctcaggagactcctttcctgttcaaagtcagtattttatatactcaaaaccaacaacaaactccaggtgtaactttattccaccttctccaacttcagagttccaaccttagaggatagagcattatgtggaaggagggtgaggacttgatatgaaaaaagtgatgacatacccctggttcatttctgggtttcctcctaggccaattcaaaacttccaaaataaggtcaagtaacacaataggctcacacttgcatcacaagctgtttagaaagtgtgcacagatctctgactcagaccagatgtcctccccaccatgggcaagggctggtgggaaagacactcccagccttcgccttcatccaatactaataaataacctacagaaagagcagcgctggaggctggcccttgagccacccactgctaccgttgcggagccaggcctgcctcatagccctctgtcttcatgtcattgagccctagctcctcattttggtcaaaggtgcgcttgtaacgctccaccttcatctcaggatcatcttcaggcgcatacacattctgcaagtaactgtttcctgctggatcatccataataaagtgggccttcatgttaccttcgatgatctaa

SEQ ID NO: 4686 - DNA, 465 bp, Homo sapiens
gggccaggttgggaaaggcgccctccgcttgcgccggagggggctgcaggcgatcggcgacttcggatgacgctccctcctcttcttccttttcttccagacgggctttcttgctcgggaccagtccagcgtccccgccgtcgctcaggctgctgctgcgtcgtttgcggctgactttggcggggcgcggggcacagcaggcggagaggtagagctcccgggcgctgcgcatgaccagcgacagctgcagactccggtgcagccgcaggccaccgcgctgcatgcgggagtgatacatcttccacaccgacagggtcatgatgcgctgtgcctctttctgcacttccatggcgactcgacggcgacagcggcgggggctcccgggagggacagaacaggcagcaggtgcactccggacaacgggctcgctcacgcctctctacacaaaccaacccacgcagtgac

SEQ ID NO: 4687 - DNA, 3440 bp, Homo sapiens
aatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatctccctttcctggtataaagttacttgaaacattacttttagcgcatagtacattgtcacatgcaagtgacataaaggtattctctgtccagcagaataaagtcagtgttgtagaatgtaagttcactaggagaagttcaataattgtttgcaaagggcagtttggaaaaatggctaaaagataattagaagtttgttaaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacattttaaaagtatctatgtgtatgtagagtgtagtatatcttaatagtgatcacaggcaatgccattttatgatcatttccccactttttgacagcttgagaatagtagcagagaaaacagacagtggagtttagccagaattgagtcgacacagtacgcaagtaggtgaggaagtgaaggatgctagctagcaaggcatttttgcaatgacttagttgggtttgggtttgagtaaagaatcaagggattgatggatttagggagagagaaacgatcaaggggctggtagtattcaggaaggctaagagcagtttcagcaggaatcaagtgagagaagtagaatgcaaaaacttatgatcagaaagaggaacttcagaagttcaggatcctgaacaaattatcagttcagtattggaatagagaagatgagatggatattggaattgaggccagagtcctagaaaagtcattgcaagtgtttagttcatgcaagcagggaatgaagtagaaagtgaaaccatgcgccagttactgtcaggaaaagtacaggcatatcttggatattttcagaggtgattatgagtaatttaatgccatttgagaaaaaaataatttttttcgttactgatcactttgatttttttttttttttttttggagacagagtcttgctctgttgtccaggctggagtgcagtggcattatcttggcttactgcatccctctcctcccgagttcaagcaattgattctccttactcagcctaccaaacagctgggattacaggaacgccccaccacacgtggctaatatttgcgtttttagtagaggcggagtttcgccatgttgaccaggcgaatcaagtgatccgcctgcctcagcttcccaaagtggtgggatcacaagtgtgagccactgcacccagcctgattatttgattactttgaatttcttctttaccttatattcttatttcaaaggtaaactgtagtcataggtattttcatggtaattaatactgtgatattctactgtaatatgtctctatagttagaatcctgcaacgggatgttcttttttttggcgatggagtcttgctctggcacccactggagtgcagcagcgcagtcttggctcactgcaacctctgcctcccaggttcaagtgattctcctgcctcagcctccctagtagctgggattacagacgcgtgccaccacgtccgactaatttttgtatttttaatatagatggggttttaacatgttgatcaggctagtcttcaactcctgacctcgtgatccgcccgcctcagcttccctaagtcctgggattacaagcgtgagccaccgcgcccagcctaacaggattttcttaaaaaaaaaaaaaaaaaaaagtcattgaaagtagcttaaaattgccatagtatattttcatttttgtgtctttgtaaaaaaaaaaaaaaa

SEQ ID NO: 4688 - DNA, 1887 bp, Homo sapiens
tcattcgggccccctctctgctggcaaaaagctcagatgtactggactgtgcatttgatttggaactgagttacatgggagagaagcagggattcagtttggctgggaatcaaactcttttgataatttcctaataaactgatagtcattagatgacttgtagtctcgataagttgaaactttttcctaacatgctgtttatgatactgagttctttgtcaccggttgaactaacagcaattgtattcacaaattttccagcctttaaaatactgtctgagggttttatgtatccgttatcttttattatacaaaagtcatttattggaatgacatatataattagattgaccctaaccattcaggctggatgaggcaacacagtgtgaagattaagtgcatgggctctgttgtgcttcctgtgtttgaatcttggctctctttgtctccatttcctcctgtaaaagaggataatgatgataattttaattcttcaatgggttaatatataaacatatattacaaatgtataaacattgccaggagggtccattgttaatgcctgtagtgggatgatgtttgagattttaagtctcattccctaaaatggaggtgaaattcaacagggatgggaagaaagaacatctgcacctcagccaccctttagctccaaacctcccttatgctctcatctgccccacagcctccatcctgtaacaagaggaccagctgtgccagtggaggccacagcatctagcttatgcctccaatgtaacctgttactgcccacctgttctccctgatattctctgactcttagtactaaggtcccacagaggctgcagtgcccacaggcaagaagaaccaaagggtagtactgactggtagtggctagccacagctgtgtggggccagattgacactgcgcaatcgctaagtggatcagtgttcaggctgccctgtcttgggagacatatagggacagggacctataaccaacacctgccataggctggcttcagttagcccttcacgttgggattcactgagtggtttttctggaagtggccacctagagttccctgtggccagccaaggtatgggggctggctttttgggatgtctagggaaagccaaaagcaaaacccagaagataattctttttgtggaggagttaacagatatagcactgaccaatcagaatagccactggctatacatttccccattataacaggattcactgcattccataaattttgtttttttaaatttccaaatatatgaaggcttttaaaagttattttttgttattgatttctgagttaaattccttatgttcagaaaatgtgcttcatatagtactgattccatgacatatgttgaagcttactggccttagccaggtgcggtggctcaagcctgtaatcccagcactttgagaggccgagatgggtggatcacttgagatcaggagttcaagaccagcctgaccaacatggtgaacccatctctactaaaaataaaaaataaataaatgaaaaatattagccaggtgtggtggcacacgcacctgtaatcccagctacttaggaggctgaggcaggagaatcacttgcacccaggaggcggaggttgcagtgagctgagatagtgccatcatactccagcctgggtgacagagcaagtctccatctcaaaaaaaaataaataaataaataaaagaaacttatcagcctcatataaagtcagttttcataatatcccatgtgagtttgagaagaatgtacaactaataattattgattgcagttctatatatatatatctgttaaattgagcttgttaattgcattcatatgcttaataaaagtaaataagaaaaag

SEQ ID NO: 4689 - DNA, 904 bp, Homo sapiens
gccgtcttctcttccaccccgctctcttcatgtcccgtagctcccagctccgcagctgttcgagactccgcactggatccgccgggtgtcggattcagcaacagtgattggtgcggaggatccgagggagacgggccgacacagggtctaccttgacatggctcgacccctctacagaagcagaggggcgctcgaagagtcgccagggaaaatggagccttaaggattagtttgggtagtgaggaaagaggaaagagctgtcggagcctgtttcatttttcccgctttgcgacaaggtctagagagagttacaattttatttgaaacagtaaatagacacattaatgtgacctgatagcgtgcaccatcagtatatgataaaattaggagaaattaggaagcatggtaaaacatgtgtcaggatggccgagcggtctaaggcgctgcgttcaggtcgcagtctcccctggaggcgtgggttcgaatcccactcctgacaatatgtgttttccgtccttacttttcctcctgatttgaaccaaccagcaattatgtttgaattcttagagaaagacttttcgatcggtcaacactgccttttatcctaggtatctacatttacgaaaattatttgtgcttctctgcacatatagaactatatctatttttcctgtattgtaggctggagtctggtctatgaaatcagggagcagttgagactaagattaactttggactccaacttcccagtgtcaatttatccattcttttattcaacaacaatgtgttgagccctttctgtgcgtcaagcacactaaggcaggcagataccatctcctttgactaaacaagagaacgccctcaactcaggatcctttaatttgctctacagtcttagctgggt

SEQ ID NO: 4690 - DNA, 2012 bp, Homo sapiens
gcctggtttgcatagtctgcacgtttaatcactttaaaacctctaacattatctcatgtccattaaatagaaccagcaatgctgggcctgtttaaattacaagaaaaaaatcactgtgcaccaacccagcatcttacaaaaccagccgggctggccacgagggcagggggatgggagaggagggggcacccctgggcagatggctgggtaccaggaatggctagggtagaaaagaaaaggggactcccagatgggaggggactgattgtcctaatgggaggggtgcaaaaggcacgtcagaagaggaggtttgaggggggcatgacaggtcagtgctttctccaccagggcacagacttggggctcaactattcctcactcctcagcaacatgctgcagcccccacacctcagggccagggcagccagggaggagcagggcggacggtgggtgtgagaacgtgggtagtccagctgctacccccattaaaaatacaaaaacaaatcatcagcatctaaagtgaaataatcacaaagtgaaaatatatcctcaaacagcccctgagatccccacaggggaaagcagcatcgggtgggaggccagagaggccggctgggccagcgcccctccccaccacccacccaggggctccaggtctgtgagtgccaacagcccaggcagcccgggctcagaaaacagggacttgggccctgacgggagaggcgggtgcaagagaggggagggtggtcaggacaccagcacagggttcagccagagcttcggccttggctgcgccagcctggtggccagtggtggtggaggcacggagcacaggggtgggtcatgggacacaggccacaggccacatgccacgtgcacacctggaggcacctgccttgccttggtcccttcctatgatggctgctgccgccaagactcaccagagctgggggacagggtggagggtgcagaagcccttggagaggtggcctcctccctcagatatctcctaggccagcccccgactgcctggatgggaccattattgctttagagggacagggaagggcaagagctgcggcctgggtcaggaatcccaacaagcaagggctgcccctcttcactccgcaggaactctggctggggccggggccggggcaagctgccctaaaggtttcactcctttctccacatggaaggggtgctgagggtggggtacggccctccccacgccccagctggtcctgggcccacctcaggtggccaggtgggcccgagggtaggatgggaagcagtctccacccctcttgcctcccagctggggtccaaacccagtcccaagataaaaaaatactttggtgaattaaaaagtgcccaaggaggggattggcttgagggggtgggcagtgggctcatcagagggcgctctggtctttgataaaggcggtcctctcgccccggccctcgtcctcttctgagtcagacgggcactcctcctgccaggcttcagggggcagccccttgtaggagatgaggccacggtccatggtgtacaccttcaccccccgaaaactaaagccagagcgcagctgcaggaccaggaagacagtgacgaagaccagcacgatgaaggcgcagctgaggccggccaccacctcaggcaggtgtgagggcagcagccctgcccgcagccgttgccccgcctccacctccgggggcagccgaggtggctgctgctgtggcggggactctcggctgctctggctttgccgggagcaagtctgctccacagggtccaaggaggcgtggctggggcagctgaggcagtctgtcagggccggcccctggcatgtggcacatgaggcgtggcagggggcgcagacgctggcccggatggtctccacgtcattctcggtgctatagtgcgtatcgaggacttggggggcgaaccctggagggcagtgctggacacagctcttctggtgcagggagaagccttcctcgcacactgc

SEQ ID NO: 4691 - DNA, 1387 bp, Homo sapiens
aaatgccgccacagactttcactatgttctcttcactgtcaaatggagagtttgatatactaagcttactctcaatggacataataggaatataacaaactagaaaaaagggaaacattaagatgttttagtgattaccagacaggtattcagtagttaacaaagccctgccaggtaggtagccatgtttaaaggcagaacaaattctataatgaagtccttggtactgtacttattctagtaacatcaattttaatatatacaaagctttttttttaaaaaaaagtcactcctttggaacaaaccactccttcaacctttttttaaaattgtacagacttgttccattttcatgaatatctagacttggtgagtgaagcaacctgattggcttccatccagctggtagcatcttgcaagtgataaaactccacgaaggcgaaaccacggcttacacctagagacagcattcagatatagacgggatacttgtgttagtcagttcctttataacaggtgaatctctctcccactgcttcaacactgcgtgacaaagccaattgggaagcagctttacaaatgtgacttgacttggggatcttcttgatactttgccatggcaaggaacaagccgcctgaactaaatgccactccatttgattccacgcttaaagtaaccatgcaaccgactatagtcaaaaaaaaaaaggagtttataaatcattacttacctaaggaaaaaaaagtccctaaaacaaagtttaaaaaagttcctcagatgctaacatggttttcaaagagtcacattccttagccatggcaaacctttcattctgaattcatgtgcttgaagactgggggaatcaggatgttctttagggactgaggtgggaatggggaagagaacaataatatcaggaactaagcaagctctcacctgttttcctcttcatcagcctcacatccgcaggctgagggccttcgaaggactccatcatttctcgaatctgcacagggttttacattatttacagttaaagcttttgccacacactattccccatggaataggaattacatcaactgtttaattagccaagttttttttttttttaagatgggagtctctgtctctcactcacttgattgcccaggctggagtgcagtggcatgatctcagctcactgcaaccaccacctcctgggttcaagcaattctcctgcctcagcctcccgagtagctgggattataggtgtgcaccaccatgcgtgactgatttttttttttttttgagacggagtctcgctctgtcacccaggctggagtacagtgacgtgatctcggctcacttcaacctccacctcctggattcaagcgattcttctgc

SEQ ID NO: 4692 - DNA, 320 bp, Homo sapiens
ggcttgaacccaggagttggaggttgcagtgagctgagatcacgccactgcactccagcctagcgacagagcaagactccatttaaaaaaaaaaaaaaaaaaaaaaagaagcaccttcaggctggagaagcagcgtagctaacacaagtccagtccttgtgatgtggctggtagttggggatggccaggctgaagcagagagtcctagagaaatctcgatacaagcttcaaagcaacacctagacactgctctagcggttgatcctggagataaaccaacaagagagagatggaagagaaatactaaatgaggtcaaaga

SEQ ID NO: 4693 - DNA, 699 bp, Homo sapiens
gtgggtgcttcacacctttttcactgggattgtgctggaggtgataggcagcattctaccatttcctcagcaacagaggtgaaggctcctcaactcagaagcacaaattgtaggggacagggtgggcagggaaagggagaaggaaatcccaaggcaattcaatagaagagggtaaaacgactccaaacatcactaagggcaggtgggggcctgcttgctcagtgcctgctaagtgtcctgccctccttgctctctctacccacctccactcaaaagatcctactgaatctccaggtaggcagcagggaatatcctatcattaggggacaataacaggaaaagccacagaggagaggaagaggattgagtgagagttcaggagagcaaatatcacaggcccggtgaggtctcaaggtggctgccagcaggggcagcagcattcacccagggcccccacacccacagagttgcccgagaggtccacagctcagctccactctgctgtttggccctcaggggttccagggtggggaggatctcgatcccataacgcatctcactcagctcctccaggttcaggctcccgacaccgccggtcagacttgcgggtaacaggagtcccagaagcagcagtcctaacaaactggacagcagcgtttccgccgccatctttcgttccccttcttatgcagagaatct

SEQ ID NO: 4694 - DNA, 4158 bp, Homo sapiens
tttgtatttttggtagagatggggtttcaccatgttggccaggctggtctcgaacacctgacctcaggtgatctgcccgcctcggcctcccaaagtgctgggatgacaggcacgagccactgcgccccgccaggctagcgggcctgtgtgtgtgctgtcaggcgtcgatgctgggatggtgatgtgtcccgactgcagggagaggacccgggaagctccgaggttggtgacctctcctgcccctcctgtgtgtctctccccatggctgatgtgcagccctcagtggattctgtgagtctttctagtgaatggtcaaacctgagggtggtcttcggagcagttgcacgctaacccgacgctgcttgtcgtgagctaggcctgaactgtaagtgcttcatgtgcactgagccctcgtcccaactcatgaagcaggcgctgtgctcccatttgataggggaggagactgaggcacagggcgctcatgcctcttgcccacagtcacctgactggtgggtgctggagctggtctgctgcagagccctggctctcacgtcccatgccaccctgttcccagctcctgagtgctaccgtcagctgggccagatggtgggtggctgctcaggctgtctgggcacagcggaaggctccaggggggccgggggaggggccatgacgcagtgggctcaccggtggcagggactgcacgatgtcactgtggtagatgtagccggtgtggggcagcactgaggtagacgagaagcccgacagcgtcttgcgctgggccccgagcagcatgatgttgcaggcgggcatcttggagaggttggtcaggccgccggccacacctgcggtgggagggagggaggaagggggggcggtcagaagaaagcagagaggtgggggtgagtaaatctgcctgggggctcgacgtgtgctgggcacctttacatgaagttctggttggattcctcgatggccctgccaggcgggcgacctggcccattccgcaaggggcagatgcaaaggaggctcagagagggagggcagctggcctgggggtgcagggaggaggcccccaacaggaagctgaccaccacgtttgtgctaagccacactaacgccgttccagggatggctgtgttttggaaccattttcaccaaaccaggagctccctgacaacagggcctgggtgtggtcatctctgggtttccggcacaggggagggagaaggagctgtgggtgagtgtttttcccacagatgaggctttgctgtgtgccaggctggctgacctctgtgatgtccagggagacggggtgctgaggtccaggtgccaaagcccccattctacagaaaaggatgtagctttcccaaggtcacagtgtcagcagacccccgctccatgggacccagcccggggactcacccatgatcttggcggccgtggatgccccgataatgatggacaggttgggtgcgatgaaggacatccgggactccacatactcgtagatgcggtgcttggaggcgttcagctccagcgccatgtcgcaggcctcctccagccgctccagctcctcctccgacagctgctgcctgcaggggcgggtgggcccagcctcctgggtctcccgcctgcctggtgtgcccagccccagccctctcggttctgtgtgtgtgtgtgcatgtgtgtatgtgtgtgtgcgtgtgtacacctgcgtgtgtagctccagcctaatccccaatcccattagggcccggcgcctccctcgaagcggacatacccctgggtggtggaggcggtgacgctgacgaccatgatggtggcattggtgaggatctgctgcaggttctcattgttcttgcacttgtccaggctgttgcccagctcctgggggcgagcagagaagataggggaggctcgggaactcaggaaggctcgagaacctctcttgctcagcacctcctcaggtctcttcttagggacactgggacagtcagggtctctgcactgggggcctctcctgcctccaccgcctgaagcatccacaccattcctgcctccaccacgtcaagcatccacaccatctgccctgctttcgctgacctggaaacggagcccgggcagagtggcgtctggaaagactgtggcctcacaagcctctggcctgcgtcaagtcggagtgcaaatccgcggcctcgcttccctgcaggggcttccccaccgccatcctaatcctttcctggacatgcgtggggacctcctcctctccccgccctcacgcacacctgcccctcttttccgaaacccttccttggctttctcctaagacccaaaggctggacgtgatccgacctcttccccgtcccctccttccccgcctcacttcctccccacttgttccctctccagctctctgcacttagacgtctctctcccccaaatctccgtgtgcctgccctgtgtcaaccttcggatgtcaactccaatgccaccggctccaaccacagcgggagcagcgtgggtcaggccagcggggaagccctctcgggagactggggttggaggggagccctgagaaagtcctgtccaggctccgtccctcccacgctgggcagagcagaccactgagccctcgtccactcctctccatcgtctccagaccctcaggcctctgggagggggtccgagagtgagccccgcctgccccttcacgccagcagaagcaccccaccttctctgcgctcaccttgaccgtgcggatgtaatccagtgcattggggaccaaggactccagttcagggaatctctttgagtacttatcccggatgaacttatggatgatgtctaggtaactgaagccctggcttgtggcctggcacacgggcaccagcatacagcctttctcagccgtccttaccgctaggtgtgaccaggggaattagttctggtctgtaaaacgtgagctgcagtgacatgttcttaaagaaaagaagcgccttgctggtgggaatgcggaggtgatggctggaggtggggcagtcacctcgcaccgtgaggcaggtggccgaccaacaggatggaaagagccggggccctacaggcagccaagcggccacaccatccccgagtgctcctcagactcatacgcgagagaacgcacttccttcttatttcagccactctgtgacagcaggttgttggcatccacgatgacgcggtattcaggcgcggcctccactggtcccatcactgtgaggacacggaggcatgggtcacttgtgcacctccagtaaacagggactgccacagcttgtgagatgtttcacctctgcctcctcaaccagacaccgggtgtgacggggtctgactccatccctgagcctggcctgacatcaggaaatgtcactttctgtgtcccataaccctctggagggagaaattccttggcctggcatctggaactctgcaggattctctctccggatatctgaggccccgggcctgccgctgtctttccctgggcccccttctccctttctttgcctggcacatgcattcatgctctacagtccaattcagctatcgattcttcctgacacctggggcagggtcagccagtccctcctgtggctccggtgtccccagcttggtaccaccactgatagctgtctggaacctggcctgcctcttccactagaccttgagtactttgagagcaaagacctgggcgattcaactgggtgcccaggtaaacgttaaagaaagcaagcagtgagtctcccgaaactctgccctctcactacacttctttccccagaaacctcctatggcttcctgtcatcaacaaattccattcaagaagaatgggaaggctgggcgtagtggctcatgcctgtaatcccagcactttgggaggccgaggtgggcggattacttgaggtcaggagttcgagactagcctggtcaacatggtgaaaccccatctctactaaaaaatacaaaatagccaggcatggtgttgcatacctgtaatcccagctatacataaggctgagggaggagaatcgcttgaacccgggaggtggaggttgcaatgagccaagaacacatcactgcactccagcctgggcgacagagggagactctatctcaagg

SEQ ID NO: 4695 - DNA, 1596 bp, Homo sapiens
aagagatggaagggggtgggtcttactttgtcgcccaggctggtctcgaactcctgggctcaggcatgagccaccatgcctggtccaatttttgaattttttcaaaggttctcactgtattgcccagaatggtctcgatctccagatgtgaagtgatctttcccacttggccgcctaaagtgctgggattacaccgcacctggcccatgcttttctttaaggaagatagattaccttatttctctcagtttttatgatagccgtatacctgcaaagttccatcttccatttcagattattttgtttttatttttaattctttcagtgtatgctgtgtctgttaacttgaagtaaggataataatttcataccttgcttatgctctccctttgtggtgaaatcattatactacttttctttcttttgttttttcttcaacttttattttaaattcccgggtacgtgtgcaggtttgttacataggtaaatgtgtgccatggtggtttgctgcacagatcaacccatcacctaggtattaagcccagcatccattagctattcttcctgatactctctctccctctgcccctttgtactacttttcaccattatgatttttaccatatccacctgccagttttacagttgataaatgcaaggctggggaacaaagtgagaccccccatctctacaaaataaaaatttctaaattagccatgtgtggtgttaaacacctgtagtcccggctgcttggggctgaggcaggaggattgcttgagcccagaggtcgaggctacagtgagctgtgactgagccactactccagcctggctgatgaagcaagaccctgtctcagaaaaaaaaaaaatgtagctcgggcacagtggcccacatctgtaatcctagcactttgggaagccaaggtgggggaggattgctcaaggccagaagttcgatacctgcctgggcaacatagcaagaccctgtctccacaaaaagtttagaaaattagctgggcatgtggcacatacttgtagtcttagctactcaggaggctgaagccagagaattgcttgagcccaggagtttgaggctggagtgcagtgccacgatcatagctcactgcagcctcaaactcttaggctcaagtaatcctcctaccttagcctcccaagtagctgggactgtagacacatgccaccaggcccagctgatttatttttaaattttttcaggggaggtgggatcttactgtgttgcccagactagtcttgaatttcctgcctcaagcaatgctcctacctcaccctcctgagtagccaggattatagctgtgagctaccacacctggcccattttagtttttaaatgccactatgtaatgaggcatttaaatttttttccgaaaagtcaggaaagaaggacttggagcacatacctgttacgggtttaaagcatactttagtcttggccgggtgcggtggctcacgcctgtagtcccagcactttgggaggccgagatgggcagatcacgaggtcaagagatcgagaccatcctggctaacatggtgaaaccccatctctactaaaaatacc

SEQ ID NO: 4696 - DNA, 22336 bp, Homo sapiens
acccgacctcctccaccaaggggctgccatgagcgtccaaaggagctttgtgggcccgggcgcgcacagcacctggacgtgccactgcccggtgcgcatccgtgtcaggaattgtcacaaggacgcacaagccaggagccgctgcaaggctgtggatgaagctttctggtcacaaagccccttctcctggggctgctgtgggagtagctcttggcacacacttccacccagagacttcacatcccagctgacgagggcacggtcctgagagctggcagcaaagatggggtggggtggatgctgctcagtcattggagcagacggagtgtcccaggagtgggcggaaaatgtctctttaggagcctgaggttggcccctggtgcccggagcctgaggccccacaacctccccatgtcctcctccgttccccacgactgctggtgagaagtcctgcctggagttttgcagggacccctccctggacccagaagggtccgcgcttcaacactttcagagatcatttagtccatcctctttgacaaacggggaccagggaggtaaggaactgcccagggtcacacaggaaccagaccacacaatatcaccacctccctctgcccagcacacttaaagccgcgtgcaccgcgctcaccaggagcatgtcagcacctccttgagcgtcctgcggagctcctggctgtggaaggcgtagatgagggggtcgatgatggcattgcagatgatgagggcgagaaagaggttgaagttcttgaagatgcagccgcacgtggggtgctcggggcagaggacgatgagtgtgagatgcaggaagaaggggccccagcagaggaagaaaatgcccagcaggatggtgagggtgacagcgcctttaaggccaaagccctggtggaccgggcgctgcctcttgtggagccgggcgatgccctgggcgtgctggcaggcccgggccagcatgtggacgtacagcacggccatgagcaccagcatagccaggaagaagaccacgaggcacagcaggacggccacgtggtcgtagtaggcgatgaagagcgtgctgaagacgacactggccacccagatggccgcaacggctcgccgcgcccgcggcagggtcacgatgctgtggtagcgcagtgcgtagaagatggagatgtagcggtccacggcgatggcgcccaggaagcagaggctggacagcatggagctgcaggtgatcacgtcaatgacattgtccagctgctgcagcaccgcagcccgggccaccagtgcaccggcctccagcaggaggatgacggccgtctccagcacgttgctcccgctcaccagcaggtccgacaaggccaggcagcagatgaagcagtacatgggtgagtgcaggttccggttcttggcgatggtggccaccaccagcgcgttctccaccaagctcaccagccccaggctgaggaagagcccgtcagagatggacacctccaggcaccgggctcctgtctggttggcagccagccccagctgggggatggctgtgggggtggagttgagggagcccagaagtcttctctgggatccctgcacagccatagtcctgtccaggaagcaggaaggagtcgttggaggcctccaggtccccacagttcttcccctccaggtgtcctgcttagttcatggtgctgccagggggccttgggtgtcccccatgcctgcctccttccatctgggcacccccagatctgccctcacaccctctccctggctggacaggtcagcccaggcatggcccagccagtccagacacctcctggcatctaccgcctgggctcagggattctcacaaccaagcctggtcctcagctccctccctgcctcttccctggtggctgctgctcaggtccccaggacatttcgacacctctggaccgtcctggcctctgtctcctgccttcctgggccagggctgcgctgaggtcctgggaagaatggagcttttctctgcgttttaaaaagtcgttctcagagcccctcccactgagggcggccacatgccgggggcgtgagcacccaccatggcccggcctgccaccaggcggcgtgcaggacccagggggtccctcacaccgcggatctcctttacgttaaaaaacaccacagtctgtcctggtcaccagggcccccacctggccgcccctctaggagtccggagcttccccgggacctgccctctccagaggccccacccttcacccctcccctcgtcagcagctcagggaggacaggggtcccctctgctctcagccaaagcacgcatggagcagcaactcagctgtcaacgttcacggcagatttgggggctggaccagggagaactttccaataattaaagttctggaaactgagtgagccctgcaggagtttgcacatcgcgcggggtgagggggcttccggccagggcagagcgtgaaagcgtccaatgctagtgagccctggagaggttggtgttttcaggcatcttgtagagcctgaggccactctggcgcctgcccccaagggcccagcctcgcccagccagagtggcgaccccctcagctgcagccctggggctgtgggggtgtcgcttcctgggagcggaccggctgggggcaccctagtgaggtcttcagggaccctccagtcatctcgtcgctcatcctcacaggggcacccgggacgctgctcccgccctccccgggcggcgcgccatttccgctgcggaaggcaccacaggccctgcaccaacagccacatcaaaggcagacctctcgcctccagccgtcgcacgtggtgctccgcaggccgttcacagcagtcgggcgtggccccgaagcccagcagggacggtggagaggggccctggcacccactgcaggcatcttcctgggttcactccagggcgttcccagcacttccttgctgaagactgcgtctgtgctgaagggtggaagcgggagggggatggaattactcgtcccatttacagctgcaggaaaggaggcaacggtgcaggcaccgcatcagggttttcagttttgtgtctgcgatgttcgagttaaaatccatcctgtctctcgcccaactgccaaactctgaccatgaaatgctcacaccactcacaagccacctccatgtgtgtgaggacattaatatttttcatatttactggtacagtaaatacttgttacaaccgcattttacaatttataaatctttagttttgctttaaaattttttattattgtcagccatggtggctcagggctgtaatcccagcactttgggagcccaaggcgggtggatcacctgaggtcaggagttcgagaccagcctggccgacatggagaaaccccgtctctactaaaaataccaaaatcagccaggtgtggtggtgggtgcctgtaatcccagctgagtcaggataatagcttgaacatgagaggcggaggttgccgtgagccgagattgcaccattgcactccagcctgggcaacaagagcaaaactctgtctcaaaaaaaaaaaaaattattattgccgggcacagtggctcacccctataatctcagcactttgggaggctgaggcaggcggatcatgaggtcaggagttcaagaccagcttgggtaatatggtgaaactccatctctactaaaaatacaaaaatcagccaggcgtggtggcgcacgcctataatcccagctacttgggaggctgaggcagaattgcttgaacccaggaggcggaggttgcagtgagccgagatcacaccactgcactccagcctgggaaacagagatacagtctcaaaaaaaaaaaaatatatatatatatatatatacatataatttttatgtatttatttattttgagacagtttcactctgtcgcgcaggctggagtgtagtggtgcattcttggctcactgcaacctccaccttctggattcaagcaatacttatgcctcagcctcccaactagctgggactacggcacccactaccacacctggctattttttgtattttttgtagagatgaggtttcaccatgttgaccaggctggtcttgaactcctgacctcaggtgatcggtccgcctcagcctcccaaaatgctgagattacagggatgagcccccacaccccatctgctttaatttttttttttttttttttgagacgaagtctcactgtcacccaggctggagtgcagtggcatgatcttggctcacggtagcctctgcctactgggttcaagtaattctcatacctcagcctcctgagtagctggaactacaggcgcgtgccgccacacccggcaaatttttgtattttttttagtagagatggggtttcaccatgttggccaggacggtcttgatctcctgacctcatgatcctcccgcctccgcctcccacagtgctgggattacaggcgtgagccaccgcgcccggccctaaaatgttttaattgaggtacaacatacatgaaaatgcaccagtgataaatatgcaggttgacggatgacagacctgaaccagccacataagcagcaccagaccaacagacacagcgttcccacccggacggctccagcgagccgctgccagcccatctggcccatcacgtgaatggtgtcccagttcactctctctggctgagattcgcctatgccggtggctgtaaccgtctgcctcagaccgtggtgtccacggcgtgaacagaccacgtctgggtggcttcagactccctatcaacgataccgtctgatggacacaggtgcgtctgtggattgccacccgggggacatgggcagggacctctcttcagctttgggagacttggtcaaaccatcttcaaatcggcaggcctgtttctgttcacacacgcagccccaggctgctcagaggagagagcgcgccctgcccacaccaccacaggacctggtatccggccacagccacagagcctcggcctcagcccagccttttgcctcccatgacctttgccccctcacgctgtgcttccagcatgagcacaggggagagaagggtcccaaggtgtgagaaggccaagcctctgcctcgggaaggaagacggctccactggtgtgagggccgtggctgtgtccctgccccaggagcacccccgacgtccacagcacctcacagacccagacccagagcccgctcacctctggccatgaaccagtgagcagcccctgccccagagcactgtcccctcacatttcaaggacgttcgtgtttgcagctccacaatgaggcctttgagacggacggcggttaaccccagcctccactgctaccccccagcccgggacttgaaagggcatgagaactgggcagcctttttcgtgccaagatgcagctggagggcatcggaagtggggtgaccctgccacaggactcccactgtggttcctcactggatgtgcctgtcggggcttcgtgggaagatgaggcacagccgagctgcaaaaagtcaactttttgatgtgttatggtcatgggggagataaattagcctcgggatgatctgtgattagatgacatcctacagctaatcatatctcgattttggtctcttagtgcccctggaaacactgcatgctgagtggccggaagacacgtggggctggcccatccgctcaccagggtccccgccacaggcagaggcaccgttcctgcagagcactttccatccaggtgtttctggaccagcgacccacgaggagaatgaagacagacgtcttcctgcgtttattcagtgtctggcatccagggcctgcaacacacacacaggcacacacacacacacaaatgtgcacccacacacacaggcacacacacacacaaatgtgcacccacacacacaggcacacacacacaggcacacacacacaaatgtgcacccacacacaggcacacacacaaatgtgcacccacacacacaggcacacacacacacaaatgtgcacccacacacacaggcacacacacacaaatgtgcacccacacacacaggcacacacacacacaaatgtgcacccacacacacaggcacacacacacacaaatgtgcacccccacacacaggcacacacacacacaaatgtgcacccccacacacaggcacacacacacaggcacacacacaaatgtgcacccacacacaggcacacacacacacacaaatgtgccccacacacacacaggcacccacacacacaggcgcacacacacacaaatgtgcacccacacacacaggcgcacacacaaatgtgcacccccacacacaggcgcacacacaaatgtgccccacacacacaggcacccacacacacaggcacacacacaggcacacacacacaaatgtgcacccacacacacaggcacacatgcatacaagtgtgcacacatacatacgtgcacacacacacaggcacacatgcatacaaatgtacacacatacaaatgtacacacatacatacgtgcgcacacacgtttacccacacacgcgtgcacatacaaatgtttacccacacacgtatgcgcacacacaatgtttacccacacacgtgcacacacgtgcacccacaccacatgcgcacacacacaggcacacacaaatgcgcacccacccacacacgcacacacacacacatctgctcaatgtgtgcccgagggctgcgagaggtaaaacatctctgtggcccagggagtggcctgtccagctgcggccacagacatggaggtgggggtcaccgccggaccaacagtcccaccgtggtgggctccagtacagctccccaggacagctggacccacagctgatctcagcccttggttcagggaccatttcctttgaacttgggggtgggggtgtgggaggtggcaagcagggtttctcgtgggctcaccgtggtgcctgcattgaaggctttggggggttctggctcagtggaaaagggcccggctggtgagccacgctgcctgtgggcacccggggagccacgtgcgcctcagcctctcgctgggctgagcagggccaagggaggaaacaggacagcattccccacaatcatggcagaggctacgccctcaaaacagtctttcagatctcacggtcattggaagtaggctcagctgcaggtcatgacataaaccccagcaccactgccaaagtgtcagtgatccagccacctctcaggacagcaggcctgggctcagcctctgctgcattgtccctggaacaccggctcttctctgactcccaaccgtagggcggctgctgcagctccaaacatcacatcccctatttgggtggactcaaggcatctggaatggaagaggcaggggacccaggtctccttgctagcctgtcattttcagagaaaagaccctgaagactctagcagactcccgcatctcgatggctgaagctcaccacggaccaccctggctgtggagggtggggacctagagcagactggggttatctcccaaccatcttccctggagatgagtgcagatcccccatggaaaaaggggtgggtgggacaccaggaggaccagcctgtgctccccacaggctcctgctgaccacaaacatcgttcactcactgcagagaggaacgaggccgcagcaccaactccccgcccccatgatctcttcctgcagagcgtggggctatcacagctgggacctcagggcaccgctcctagaaatggccagcacagggccagggctgcaccctcaggcccacgtctgagatgggcacacgtggctcagccctcgggccaactcttgtcatggacactgggccctcgtcgtcctggggagggtcctgcaccctaagctcccgcccaggaaatgctgagcagagtaaggagacaccaggaactgccaaaaggatgaactcacaggcctcggcgagccccaggttagacgattacacagtgatgggctttctgggaggtgggtccacggaccagtacctagctggggctggaacatgtttcctgcctcactggccgccctagagcctcgggcagcccctcgtgtctgctgcctcctaagggtaaaagattagggcggtgaggggtgccaggggacaggacccctgctgcagccctaacaccttggtgttctcgatccttccagaaccacgctggcttctgatgctgtctggctgcagcctccgcccctcctgcagctgcagcaccgtggggccgtgggatgcacgggttctgtgcaccatcagtcaactgtgccaggacctgctccagctaagccctcccccaagactggggtcttggtccgagtggcccattcaccctcagaccgactatcccctgatctttgctacatgggccctcagagcttccctgggcacttctctgcaaaacatgcttctggggcttcgccttcaattctgggcactgccctcaagttctctaataaaattattttggcagagccaggcgcggtggctcacagctgtaaccccagcactgtggggggccaaggcgggcggatcatgaggtcaagagattgagagcatcctggccaacatggtggaaccccgtctctactaaaaatacaaacattagccaggcgtggtggcgggtgcctgtagccccagctactcgggaggctgaggcaggagaatggcgtgaacccgggaggcggagcttgcagtgagccgagactgcgccactgcactccagcctgcgcgacacagtgagactcttgtctcaaaaaaaaaaaagaaaattattttgtcagattcaacagatagtggcatccagccaaaggaccccaacatctccaccccacttgcttggaggaacaagactgaaggccggctgccacataggggcctctctgctccagccctgccctgagaccctctaccaacaaggcacgcagctctgttgacgaactccacagcaagttcaaggaggacgtgcacccagggccttggcattcagcagggacctgcactgaagaccccgtggggccccttctccacccgtgcccagatcctgggagcacaggaagcatggggtctgggccccacctcacccacaagccactgggaggagaatggactgagtgtgattcgaatccgagggcatgggacggcgctcagtgcctgcgaaaggagaaggtgcggacggcagagcgtgacccatttacatttataggagaaacagtggaccagggagcgacacactcagcttccctacttcaggcaactggccgactccgaccaacagagaaatcgggaacatcatcatacggcttttcggtcacctctgcggacgctcagtcccactccccctccccctcagcgtcgtcctcgtgcggcgcctccaggtcgttgaggtggaagttggccatcatgtcgcgcacagccagcatcagcctgttcaggccctggttgcggttcagacccccagccactccttcctcgggcctctccccctgcagcaaggggacatgtctgagaagggggctgtctgtgctgggactaggggcccggggcccaagcaggaggcactgtggagcccgaggtggcccttgccccagcaccggaccctgaaccctccccaggtccctgtgaggaggaagctctcaaaaccaaatgccgtgtctagaccaagccaggcacagagtgggatcaagccggctgactcacggccctgcatctgctaccatctgggcaggccccagtttccccggcagaatgggcaccccactggcacaatgcagccttggtccttccctgctccctgtgccggctggcacagtcctggttcaaggaggctccaggcattcgcactggaatggatatgcccgcacccactggggaggcaggggctgggacgagctcaacctacctccatggtatagtttggcaacagtgaccggaagaagagagcaatggtgtttccatggctgataggacttagcctgaaagaaagtcaagaaaagtcagaaacgacactgaactgagactcgtgggacccaacccggctcacggggctgcctgccagctgcctccctcgcagggacacggaggggccgccagggggcagagcagcagcagctgagcacaggccctggattccccgggtggcccgtgaggcttcctcatcagcttagggtggggctgtggacagcgggaacaggatgagggagaccaactcagctgaggcaggcgtggcgtccggagcgaggctcccacagccatcctcggccactgcacaggtgccttgcttttcagaaaagctgcagtttcaacgtctccttcagcacccactccttacgcaaaggcagaagcttccagggcctgcgttaagcggagaccctcacggtgcgaagggctaccggcccggctctacaggacgctgagcggccaggcctcaggagctctagggagggcgaaagcctgggctccacagcggagggaggcagcaaagaaccgcgattcctcaatgctgcaacaccctgccggcagggataatcacgacgaccgctgtgcgggtgacggggcctgggtaaggcaagtactttccagcccagaaggaaaaggtaaaaagcctttcaatgacccggattctgaaagccagacacaccggccgcctggcagttggccctcttgcgccgcagccctgctctcccggtctggccatggggcttttgttctctcaatgtgccgtgtgctctgctcctggcacagggcctcggcacatcgtgactctgctggggaacacaaggaccctctcccctgagcctggtgagggcacattcatcctctccgtctcagcacagccaccatccttcctccaaacaccttactggaggattttttttttttttttttttgagatggagtcactctgtcacccaggctggagtgcagtggcgtgatctcagctcacggcaaccccctccttccgggttcaagggattctcctgcctcagcctcctgagtagctgggactacaggcacaacccaccacgcccaatttttttttttttttttttttttgagacggagtcttcctctgtcgccaggatggagtgcagtggcacgatctccactcactgcaacctgtgcctcccgggttcaaacaattttcctgcctcagcctcccaagtagctgggactacaggtgtgcggcaccacgcccagctaatttttttgtattttagtagagacgggttttcagcacgttggccaggctggtctcaatctcttgaccttgtgatttgcccaccttggcctctcaaactgctggaattacaggcgtgagtcactgcacccagctggctaagttttgtatttttagttgagacggggtttgccatgttggccaggctggtgcagttttgattttatgtttatttctacattctaaaattaatatgttttccccacttcactgcacacctgcttccactgtgtcactcgcacctgccacagaggccgacacgcaagcgcttgtacattcggtggagatgggaaagaacgtggcctgcaaacgcagagctgtgacccccaaataacactgttcctctcctcctctcccttcctgtgaggggaaagacccacttagccctgagccccatctctcagcatctgggtctgaaagaggcagccagtccctgtgagccccaaagccctgacctcagagctgcaggagagagctgggagctgcgaggtgggagctgggagctgggagctgcgaggtgggagctgggaggtggaaactgggaggagggaggcgggagctgggagctggcaggtgggaggcaggagctgggagctgggaggcgggagccgggaggtgggagctgggaggcgggaggtgggagctgggaggagggaggtgggagctgggaggtgggagctgggaggtgggaggtgggagctgggaggtgggagctgggaggagggaggcgggagctgggaggtgggaactgcgaggaaagaggtgggaactggaaggtgggaggagggagctgggaggtgggagctggaaggtgggaggtgggaactgcgaggaaagaggtgggagctggcaggtgggaactgggaggtgggaactgcgaggaaggaggtgggaactggaaggtgggaggtgggagctgggaggtggaaactggaaggagggaggtgggagctgggagctggaagatgggagctgggaggtgggaactgtgaggaaagaagtgggaactagaaggtgggaggaggaagctgggaggtgggaactgggaggagggaagagggagctgggaggtgggagctgggaggtgggaactgagaggagggaggcggggttggaaggtgggaacttggaggagggaggcgggagctggaaggtgggagctgggaggagggaggcaggaggtggcaggggaggtgagaggagggaggcgggagctgggagctgggaactgggaggagggaggagacaggggctgtaaggtgggaggcgggagctgggaggtaggaggtgggagctgggaactgggaggagggaggcggtagctgggaggtgggaggcgggagctgggaggtgggagctaggcggcgggaggagggaggtgggagctgggaactgggaggagggaggcaggagctgggaggtgggaggcgggagctgggaggtgggaactgggagctgggaggtgggaattggaaggagggaggagggaggtgaggtgggaggtgggaggagggagttgggaggtgggagctgggaggtgggaggtgggaactgggaggagggaggcgggagctggaaggtgggaggcgggagctggaaggtgggaggcgggaggtggcaggtgggaggtgaaaggagggaggtgggaggtgggaggagggagctgggagctgggaggtgggaactaggatgagggaggcgggagctgggaggtgggagctgggaggtgggaactgggaggagggaggcagaagctgggaggtggcagctgggagctgggagatgggaggtaggaactgggaggagggaggtgggaggtgggaggagggaggtgggagctgggaggtgggaggtgggaggagggaggtgggagccaggagccgggagctgctaggtgggagctgggagctggaaggttggagctgggaggtgggagctgggagctgggaactgggaggagggaggtgggagctgggaggtgggaactggaaggagggaggtacctctctggcctgacgtaggagtagattgtgtccgaaggaggcagaggatcaaaccccatcacagactgcgtggtcacgtccttcagaaagggacataaaacgaagatgctacagatgctgccagggggcctctacctctcccagcagagtccttctgtcgactccagcatggactggatgcatctgctgagagatagccacagagtctgacagaaacggctgtgctttttgtaccaacgagctttgggtgagggtgggacagtccttctgccaccaggacactcacgggagtcgagatgaacctgcacggcgtctgccctgcacaccagagtgtgtggtggggaaggaagggggtcacgtgccgctcaagcctgccaacatcttcaccacgtgtcagaagctcccacttcagcaaatgcaggctacagggaccctgagctgccctcgggttgcacagtgccacgtgctgccactctactgaggagagtcagaagctcacagccccagacaaagccagccatgccggtcataagggcccgcagagcagctgaagttaaaccaggaggcactaagctgtccccagtggacggtccacggtcctgcgaccctctgacttgctggttttctcactcgttctatcttatcccttaacaacagtacaaactccttaggttttgagacagaaacggcacctccagcacaggaggcgtcagagcaggactacaccccacgactacagagaatcccccagcagccgcaccacgcgctcacaagaccacggatggagcagctcaccacggtgacgactcagcttgtgctctgagccccaaaggatttctctctcaaaacaacaagcatccgaacccgggctgccaggaaaggaggagccctctgcactagaccctgcccctgccgtggcggggctgggctgctgagggagcccgcaccacgcacgcctgcatgtggaccgcccggagcagaagggacgtgcatgtgaccggcttacacagagctcccatttcagcctttctcccttaccgggggcagggcagcgacggcttccttgatctcagagaggatcacatggcggtggatattcctgggtgcacgctggtagagcaccttccgcctagggccggggagaaacaaggcacagcagataaagcacagcaaatgaaatggtaaccgccatggagcctcggcccccacccccacccagcacgaggcatctcgctgcatctctggtggctgcaaaaactgtacactttactctcgagcagaggcaccatggctggtccctggcctgcggctggggagcctctggggaccaatcccagccacatggccagtgactcagcctcttcatccaaagaacaagaacgatgagagccgtagccagtggcttcttgtgggaagtcactgagttcatctccatgaagggacacctgggtgtgtcaccatcgtcactgctacggctacaggcacaggcactggtccctgctggaaatcgctcttggagagcagtacagggaacaaaatgctcctgtccatgagaatgtccagtccagtggggacagcagacacgcggacgggcccatgactgccagcggctgggggcaccagcgcctcttgggcacccccgggcacacctcatgtccgcggcacacagacttcactgtggagatgcaaatgggcaccactcccaggcggtcctgagcctggccacaccactgcacagagccacggtgctgatgcacagaactagcacagggccaagggcgcagacaaacgagacaagaacagcaaggggatgcctgtcagttgcagcatattagggcatgagcctccgaagtgttcacacacaggacaggagactctttctcgtctctgccagatttctttactcccaagatgctgctgtgagagactcgtcatcatctcacagctcatgtggaaacactgcaagacccgaaggcaccactccagcccgaggcacccgggaacagcagctcggtaccctgcgctgatcaccacagctgcctcccaggaagcctctgggacacgccaggggctgtgcgctgtcttgtaggctccacacaggccccacagcaagggaggccaagctgctcacagcccttctcgcctcccgaatgcgaggcccccgtgtctgggatgagggtccctgaggagggggcgtggcagggcttgtgtcaacccctagctcaccggttctcacaggcttccacggctgggtccccggcgtccactgcttgcagaacctcgtggacgttctcctccagccagctcatggtggcgggctctttccagagaaagtgtgacctcccaaggtacaggttcaccagctggctcagggcagggggctggctgggggagagcaagggctctgagcagaacccctcttcagaccacagcctgcctcgaggctggcagagccccatggatgggcagacggggggtccagggagtgccctgtggcctggagtgaaaggaggcccctgggctgctggcctgagggcgtggggctggggcacacaggtatgtgccgtgagcctgttgggcaggttatgttctttaggaagcaggactgacgtcacagaaatgtgaaaatgcacccagggcgggtccatctgcgtgcacacagggcgagccctggagggccaggggatgaccccaaggcgtgcactttctcctgtgtttgctccctctttgtttattttgttttttgagacggggtctcaccatcacccaggctggagtgcagcagcacaaacacagctcactgtacctttgacctcccaggcacaagccggcctcccaaaaagctgagattacaggcatgtgccgccacgcctggcaccctctttatatgagcctcgtttttaagctggaggctgctcagctgtcccacctggacttttccacacagatgagggctccagagccgtcccatgtcaaatgacagtccccgaggccgccaccacagcccctcctgctgctggaagcaggtccctcagggcctctcaggatgagtgaaaatggctcccaggctccgaacccacaggcacccacagatgggcaccaccagccactctttaccttatttcagcattgggtccaaagaagcggtgactggaaacgctggcgtcgggccgcacactgcaagactcgagcaggggcaggaggactgcaggggaagcggaggctctgtgggggccctcagcacacaccccagccactcctagcccccaaggcagtaagggacacagcgaggtccttgtcacagacacagctgttctaaggtggagagtctgcagggccagcggcttgcttccgggtggtattctgagttgctgctgctggcgtgcccagggtctgaggctgggggtctccttcacaccagccccaaggaggctgccagggcccccatttgcatccaagggaagactcacccaccaccctccacacacatggggttgggtttttttttgtttttctgagacagggtctcactctgttgctcaggctggagtgcgttggcgaaatctcggctcactgcaacctccacctcccaggctcaagcgattctcctgcctcagcctcccgagtagctgggatcacaggcgcacactaccacgccccggttaatttttgtatgtttagtagagacagggtttcaccatgctggccaggctggtcttgaactcttgacctcaggtgatccacctgcctcagcctccgaaagtgctgggattacaggcgtccgccaccacacccggctaatttttatatttttggtagagaaagggtttcaccgtgttgaccaggctggtctcgaactcctatgctcaagcgatcctcctgcctcggcctcccaaagtgctgggattacaggcgtgagccaccgtgcccggccggttggatgttttaatcacaaagactggaccccatggcaggctggtgggagcggaggccacctgtgcccagtggaagagccagcactgcaggttgagggcagaggccgccatgtaggggaacgggccccgagggcagagcctgcagtgatctccagtgttctggggtaagtggcagcggcttcttggcagcccacctgccttcaagggaggtgctgacgctacagcctgtgacacagcagcacagctctgccacaaaggacagggcctcccagccgcgtttccagacacggctgcactggtggagcatatggccagctgcatgcagccccagaggaggacaaaggtgcttcttagacacaggggacgaaacttttggggtcagcgagcagactgaggcctggccaggcccctctggggggcacgtttctgcctgtgctagaagctgcccaaccccacgccgtgggcctcctcggggcccagacagagccctggaaacccacagaaccgagaaagggatgctgcttccaggacatcctaataggcgatgagtggtcacgtaatgtgtgtatactagctgcacgcaaataaccctcacccctcaccgcccctcggaggaggcccgtcttaaggagggatttcaccctcacccctcacagcccctcggaggaggcccgtctttttttttttttctttttttttgagacggagtctcgctatgttgcccaggctggagtgcagtggcgcgatctcggctcactgcaagctctgcctcctgggttcatgccattctcctgcctcagcctcccaagtagctgggactacaggtgccggccaacacgcccggctaattttttgtatttttagtagagacgtggtttcaccgtgttagtcaggatggtctcgatctcctgacctcgtgatccgcccacctcggcctcccaaagtgctaggattacaggcgtgagccaccgcgcccggccggaggcccgtcttaaggagggatttcaccctcacccctcacagcccctcggaggaggcccatcttaaggagggatttcaccctcacccctcacagcccctcggaggaggcccgtcttaaggagggatttcaccctcacccctcacagcccctcggaggaggcccgtcttttttttttttttctttttttttgagacggagtctcactatgttgcccaggctggagtgcagtggcgcgatctcggctcactgcaagctctgcctcctgggttcatgccattctcctgcctcagcctcccaagtagctgggactacaggtgcccgccaacacgcccggctaattttttgtatttttagtagagacgtggtttcaccgtgttagtcaggatggtctcgatctcctgacctcgtgatccgcccacctcggcctcccaaagtgctaggattacaggcgtgagccaccgcgcccggccggaggcccgtcttaaggagggatttcaccctcacccctcacagcccctcggaggaggcccatcttaaggagggatttcaccctcacccctcacagcccctcggaggaggcccgtcttaaggagggatttcaccctcacccctcacagcccctcggaggaggcccgtcttttttttttttttctttttttttgagacggagtctcactatgttgcccaggctggagtgcagtggcgcgatctcggctcactgcaagctctgcctcctgggttcatgccattctcctgcctcagcctcccaagtagctgggactacaggtgcccgccaacacgcccggctaattttttgtatttttagtagagacgtggtttcaccgtgttagtcaggatggtctcgatctcctgacctcgtgatccgcccacctcggcctcccaaagtgctaggattacaggcgtgagccaccgcgcccggccggaggcccgtcttaaggagggatttcaccctcacccctcacagcccctcagaggaggctcgtcttaaggagggatttcaccctcacccctcacagctcctcggaggaggcccatcttaaagagggatttcacacatgctgtcaggcagggtcagccccgaggtctgaccaggtggcagcctcactgtgcccgccacatgtgcgtggatcgaagctacccagatgcagtcaggggtcacggctgtgcaggctgagtccatctgggcggcacaggcctccattctgcatcccagcatggtgcagagcacaaccctctcggccacacctcggcgctgccgagaccttcccctgctttgctctcctccccagcactggtacaatccaatgccccgcacctcccagccagttctgtctctgcactctagaacacaggccccacgggggtcgggatgcctgccacctcctcgtgcctggcttggcacgcagcgggttccgagatgagccgaccctctttcaggtttggtagggcaggtttgcaggccctaccagagaatgcatgtttctacaagtgtggggaaggactgggacctggcctccaccaccaggaagagcagcccccacggctgacaggacacacccctaccccaggcgagacacagcgctcactcacctccagggaacatggtgagcgcctgctgtatcaggagagaggccttctgcctggcagagctctgctcacactcagggaggtctgtctgctggctcagcaggaaatacgccagtggaacagagaaggcaaaattagggagctgggacaggttccgatgagcctacgagggacgaagaaacagagcgtggagccttaagtcataaagacaaaatatgtgagtttgcagacgctctgacatcaccagtgagccctaccccgagcaggtatattctgcaggcaacgcaagggcctcttcctaactcagcataaagataacttaaaacgtccacctggggggctttccgcatgcagaagatacagaggacgtgggagggcctgagaagtagactgagccggagcgaggacaccgtggggagtgagggtcccacctgccgcccaggctcctctctgaagctgagcagttggtgctctcaatgtggaaaatttacagacgagagcagcccacccccgcgcgagtctgtgagagcagcccactgccgcgcgagtttccgagagcagcccgccacgcgagtttccgagcagtctaccaccgtgccagtttctcttgcctttctcagcctatgtcacatattgtagacatgtgactcactgcatttttttctatcaaaatgggatcacagactcacagttttgtgaccttaaacaccatcatcaacattcttctgcagccccattttgggggactccctgaggtttccctgcacctacatttttgtgagctccaggaatttctataaaccacattcctgggggtgagacttcctggccaactatgccaaatgcttaaaaattcaaaataatttacccactttcattatccatgaacatgtgctatgaaaaaaattcaacacagaagcagagaaagtcaagagctgtcgccttctccccagccccaggccctgctggaggttagcgttacaaagcccgtgtccttccagataagtgctgccccataggaacataatgggagcccaggtgtcaatttaaattttctttttttttttttgagacggagtttcactctggttgcccagactggagtgcaatggcgcgatctcggctcaccgcaacctccacctcccaggttcaagcgattctcctgcctcagcctcccgagtagctgggattacaggcatgcaccaccacgcccagctaattttgtatttttagtagagacagggtttctccatgttgaggctggtatcaaactcctgacctcaggtgatccgcccgcctcggcctcccaaagtgctgggattacaggcgtgagccaccatgcccggcccaatttaaattttctgggagctgcattaaagacaaaacaggtgagattaatacgttatatctaacccaatacaccgaaattatcattccaacacgtgtctgtgttagagttactggggacagagctcaagtctctcctgctgtactcacactcttcccatggaacaggacagacgtgctgggggtccctgtgtcagccccacgcaaccaaccctccttctacctcccggctgcatcttcctgaactgcccatgaggagctcgggagttgtcggtttttcatcattaccagcatcacagtccttgcaggcacacgtgtgcatgtgtacacacgtttgagcatgtgtacacacgtatgaggattctgacataaggctgctgtactgtccctaggaaaaccacattccactccgtagaggcggcaagggagacaaacaaggcaggaggacgtggttctgccctcagacgattatcgtttcatccccaaacgtcccctgagcgcacagatactgaaccaagaaaacagaaggagaagcaggtgtccgtccctccacggggcctcaccaggctcgcacccacctcccactcctggaagaggcggatcaggtactcgtagttccgggcccgcaaggccaggtggtcgatgagcagcagcatgcagagggggtcctcatccggctcgagacttccggaggcagcacagagagcagagcaaaggggaacaggggcatcgtcaggctgagagtgggcctgcagccaggacagggagcgtggacgggcttggccctgagcagacactcacctcaggatgagcttgcagtactccagcgccgtgcgcgggcagcctcgcttctccaggaagctcatctgcttgtagagggccaggtagaagctcctagatccaaaatagttccacatgaattacaacgacacaaaggagaatgctctctgctcagcgccccggccagcacccactccaccccgccctctgctcagcgtcctggccagtaccacccattccaccccacacactgctcagcgccccagtcaacacccgctccaccccacacactgctcagcgccccagtcaacacccgctccaccccacacactgctcagcgccccagtcagcacccgctccaccccaca

SEQ ID NO: 4697 - DNA, 5136 bp, Homo sapiens
gacactttcgcagagtgggtccccgtcgcgcggcgccgcggaaaggctggaacggcgcggcaccttgggaggccaaggcacgcagatcacctgaggtcaggagttcgagaccagcctggccaacatggagaaatcccatctctactaaaaatacaaaaattagccgggcatggtggcggatgcctgtaatcccatctacttgggaggctgaggcacgagaatcacttggacccagaaggcaaaggttgaggtggaggttacagtgagccaaagtcgtgccactgcactccagcctgggcaacagagcaggactccgtttcaaaaaaaaaaggaagagagacctgagcttgcacacagcctgctagccatgtgatgccctgtgctacctcaagactctgcagagtccccaccagcaagaaggcccttgattttggatatctcagcctccagaactgtaagaaataaatttctcttctttaaaaattgcccagtctcaggtgttcttttatagcgatgcaaaatggactaagacccaagtctattcataagagtggaattcttttgggggataacatttcacttaattggggctcccagttgtatttcctgtcgtcaattgatggtacatgttcacctttgaaaaaccttcctggctcacaaaaacaggcggccagttggatgtggtttatagatacggtcatgcacaactcagatctcagctctgctctcaggggactcagtctatggcggggaagagtcccaaaatcagtaaacaaatatatcatctcaaaggtgttattaagaagaggatgctgagactatgatacaagggagggtgaggcccaggctgatagggttgtcaggaaaggctctcgaggtgaggtctgcactatgatctgaacaaggggccagctctaaacaccctaaacaggcagagagaacagtgtgggatcatactgtttatttaaaaaatattttttattttttattttttttgagatggagtttcactcttgttgcccaggctggagtgcaatggcgtgatcgcggctcaccacagcctccgcctcccgggttcaagcaattctcctgcttcagcctctcgagtagctgggattacaggcatgcgacaccacacccggctagttttttatttttagtagagatggggtttctgcctgttggtcagactggcctcaaactcccaacctcaggtgatccacccgcctcagcttcccaaagtgctgggattacaggcatgagccaccgtgcctggccctaaattttttatatatttttttgagacggagtcctgtctgttgcccagcctagagtgctgtggttcaatctcggctcactgcaccttccgcctcccacactcaagtgattctcctgcctcagcctcctaagtagatgggattacaggcgcctgccatcacacccagctaatctttgtatttttagtaaaaacggggtttcaccatgttggccaggctggtcttgaactcctgacctcaactgatttgcctgccctggcttcctaaagtgcagggattacaggcatgagccaccgtgcccagcccatactatttgaagaacagtcagtaatccagagtgtgggcacttttcatgccaggtaaaatctacatgaagaagttttttttgttttttttgttttttttttttttgagacagagtcttgctctgtcacccaggctggagtgcagtggtgtgatctctgctcactgcaacttctgcctctggggttcaagcaattctgcctcagcctcccgagtagctgggactacaggtgcacaccacacccagctaatttttttttttttctgaggagtctcactctgttgcccagaccggagtccagtggtgcagtctctgctcactgcaagctccacctcccgggttcacaccattctcctgcctcagcctcccgagtagctgggactacaggcacccgccaccgcgcccggctaattttttgtatttttagtagagacggggtttcaccgtgttagccaggatggtctcaatctcctgacctcgtgatccgcccacctcggcctcccaaagtgctgggattacaggcgtgagccactgcgcccggcctacccccagctaatttttgtatttttagtagagatggtttcaccatgttggccaggctggtctaaaactcctgacctcaggtgatccacctgcctcggcctcccaaagtgctgggattacaggtgtgagccaccgtgcccggctacatcaaggagttttaacttgggatctccaatggatagatttcagagaaccatgaacaaaattggtagcaaaataaatgcctttttgagggttgaagatacacagcgtttacaggattcttaataggctcctcaatcagaacaggttaatgaatctgtattgtcatttttttttttttttagacagagtctcactctgttgcctaggctggagtgcagtagcatgatctcggctcactgcaacctccgcctcccaagttcaagagattctcctgcctcagcctcctgagtagctgggattataggcatgtgccatgacacccagctaatttttgtatttttagtagagacagggtttcaccatgctggccaggctggtcttgaactcctgacctcgtgatccacccgcctcggcctcctaaagtgttggcatgacagacgtgagctgctgcgcccgggcgatgttgtgatttttgaggctgcataggatgccatggtgtggactcaccacaatttactgaagtgagactctagtctcctggcttggttccatttttaggccactgttaaaagtgtcttaagtgtatatagggttgggcgtggaggttcacgcctgtaatcccaggacttttggaggccaaggcgggcagatcacttgaggccaggagttcgagaccagcctggccaacatggagaaatcccgtttctactaaaaaataaataattagccgggcgtggtggcacgtgcctgtaatcccagctactcgggaggctgaggcaggagactcacttgagtctggaggtggaggttgtagtaagccgagactgcaccactgtactctagcctgggcaacagagtgactctgtctcaaaaaaaaagtgtcttagtagatacaaaccttgtgtagagtcaaagggtgtgcaaattcaatactgagattgctcagctaccttctagaaagttagtacacccacggtcactactttcatacatttgtttcagattgtttaaaatgctgctgggtatggtggctcatgcctgtaatcccagcactttgggaggctgaggcaggcggctcacttaagtcaggatttcgagaccagcctggccaacatggtgaaaccccatctctactaaaaatacaaaaattagccgggcgtgggggcaggcacctttaattccagctaatcaggaggctgaggcaggataatcacttgaacctgggaggggaaggttgcagcaaaccgagattgcgccactgccctctagcctgggtgacagagcgagactctgtctcaaaacaaaaacagaaacaaaaaagccatgtatctgagattgaaaatataagcctcagagggacctctaccaagctcatttcaaagggtcaaatcagaatctactggtcagaagaaagcagtagaaagagctggtagactggctgctgcagatactctccagcaagtaaagtggacacctcgagtgagatgagccttgtgaagggactcacctaagcagcaacatggagggccaggtgcactgagggggttctgtggcccatatgtctgctagttgtgatttcttgagtctggaccccttaatcggaatggtctcattgtggtcagggtcagatggtaactaaagttttgtggggttttattgaagacagggtctcgctctgtcacccaggctggagtgtagcagtgcgatctcggctcactgcaacctctgcctcccacgttcaagcgattctcctgcctcagcctcccaagtagctgggattacaggagcgtgccaccacgcctggctagttttttgtatttttagtcgagatgggctttcactatgttggccaggctggttttgcactcctgacctcaggtgatctgcccaccttggcttcccaaaatattaggattacaggcgtaagccctgccacctccccctagtcccccatcccccgggtcttagcatttctaagtagctcccatgtgctacttagttacatacctgtcatttaggctgagtgctttgaaggtaggaggcttacatatctgtttcctgctgcttgacacagccagtgcttagtaaatcactaaacaaaaagattatgaatgaaaaggacatgggcaacagtttcagcagaaactcaaaccctttctgtctgaaagaaatcctttgctggggatggcttaagtaatggggaaaaatgggttctggagccagatttaagcagttatgtaatcccagatgagtgacttgaccccgttgggcctcattttcacctgaaaaacaaggctaataaaactcacaaaggtatcgtgtgtgaaaagctcaccactgagctgggcatgtagcaggtacacagtcttggctgtcaatactcaaaaatggcttcaggctgggcacggtggctcacacctgtaatcccaacactatgggagccaaggcaggtggatcacttgagcccaggagttccggaccagcctgggtaacacagagccccatctctaaaaatattttaaaaattagctgggtgtggtagtgtacacctggaccagctacttgggaggctgaggcaggggactggaatgtagggtttggtgctgcaggaagctgtggtcgtgccaccgcagtccagcttgggtaataaggtgagaccctgtctcttaaaccaaaaacataacaggccagatagcttgagccccagagtttgagactagcctgggcaacaaggtgaaactccatctttacaaaaaatacaaaaattagccaggtttggtggcacatgcctgtatcccagctacttgggaggctgaggcggaaggatcccttgagtctgggaggttgtggctgctgagagccgggatt

SEQ ID NO: 4698 - DNA, 370 bp, Homo sapiens
actccgactgctctgaggtccagggaaggggcctgtgctgccgcttggagggtgccatgcccagagcctctgcccctagcctcagcctcgcctactcactgggggctccagcacccccggccaccccaggactcccgaagaggctgctaggtcggcctgcccaaagagcggtgaggagcgtatgtgaagagccccagtcttgaggagcagcctgtatctggagagaggggagccccggaccagaggtgggggacaggaagccatcgccccaccctgcctcctcccccaccacaggtaccaggcccggaaaccacggaaaggggaacttggtcttttcttgttttgctctcaaccccttcctgtctccaag

SEQ ID NO: 4699 - DNA, 1125 bp, Homo sapiens
gctaattttttcatatttttagtaaagacagggtttcactgaattggtcaggatggtctcgaactcccggcctcaggtgatccgcccacctcggcctcccaaagcgctgggattacaggtgcgagccactgtgcccacaccaatttttttaaatttatgcctcatgccaccagcttgggtagatgaacctggcctccttccctccagccctgatggccacaggcagaatcttgtcggtgccctgcagttcactcctcggggctgaggcaccacctcgtcatcttcatctgcccgggggagccatggtaattctcctctagcgacaaccacagctcaagcaccataggcagattctgcaccctgagtcaagggcatggtgattctagagctctactcgtgcccctatgcattagccaaaggcaacaagtgactcgacctcatccacatccagatgtctgggtcaatgcagtggaaggaaggggtcagtgaagaggctgttggcaaaaacagccaaagaagtgcagtcatcacaaaaggagacaaaatttgtgtgtgggctctgaagaacagtgctgtggaaggaaccattagagatggccagtgtgactgctgggatttaggcctagagagcgggagaaacaggccagggtcatgagtcctggctccacacagtctctccaccctgacccagctccagcatcaaacttcagctgctacagagaaggccaggtgtatggagcaaacaaagcctgcagcctgggagattaggaaccactcctaacaatggacttaataacatcacattcatcacctgattggattcttccaacatgaagctcacagaagttctctccctagtaccgtcctgattactctgagacctcctggggacagggtccaagcccaagtcttcttcaagaacacaggaaatggcccacagggggttctctggcaatgtacagctaactctgcttctcatgttgtgtacttctcatgttgaaactgttacacactttccaggtactaattcacttggtcctcgccacccaccctgcaatctaggtattactgtaactctcattttacacaatacaaaactgagctcataaagacttaacaagctac

SEQ ID NO: 4700 - DNA, 741 bp, Homo sapiens
ccgatcccctgagtcttggcgcccgtttagtcacccttcagctgcttgggaggcaggaagagacttcccctcttcacgaggtaagggagacaaaagcagccatttggatgccagggccacaggggcaagccatgccctatttctttggagggacagaatcacttcttcccaaggccagacactgtagcccatggtactcagccttctagaggagggtagcctagcagaggagaagccctgagtggaagcagcattttgaaggcatcgtcattcttagaccagctaagagctgagggcattctctatctttgccagcagacagtgagactccaggattaaaattaaaagcccgtggtgcatcctttccttgacattaactttccacaaaaccttggaggagtcaaatcccacactgcacatactccggtgtctccagctgtgaagtgggaccagtatcaatacatgggaaagtgctgagaaggaagaaaatatttcaggtataatactaatccatcaaacacgttttattcaagaagcttggcaccaactttgtgccacatcctcaactcttcaatgaaaagagcggtgaccaactcgctcccgttggtccctatggcaggtgttggaatgaggtgaggctggcctcctctgtttgctcacagctttattcctctagcttcagataaaaataattataataggcaataaagtctcttcacagtgtatttactgtaactacaa

SEQ ID NO: 4701 - DNA, 2991 bp, Homo sapiens
ggcctgtggcctcctccagcccaccccagtatggagtgatagggagggaagggcaaggggagcccacctactcaaggaagcgccctctccttcgaggggtgtccaggccgaggggtgtccaggccgggcttctgctcccgaggtgggtggaggcagggcaggaacggcacattctcccagcaacgccgacgtcatccaagaattaacccaagccagaggacgggcatcgccacccagcaacgccagtgtcaccgaagaattaacccaagccagaggacgggcatcgccatgccttcatcttcggacactctcaaaaaagataagcttctgcccagaaacaccacaggttcaagctcatcactcagggagcctgctgccaatcagctgaaacctgcctggggaacagggacttgaccatggggcaaaacagaagaagcagaaacctgcccaaaggtcgctcaaaggcttcctctaggccagacgctggtaagagccaggcgccgtgctcccaggtgagtgtcggtgggacctgcgtactgcccacgcggcaccgaagcccctgcctgctctctgtgaagggttcagaagtatctgtggctgccaaagcctgaagagggcctcaggcctcccatttgcaggtccccaaaccaagccagaaaacaagactcccttgtcatgggctgggggcgctgccctgtccgcagaccacgtatgtctagaattcccgtgctgggacatggttcagacacaaggacaactgtgtcccctgccatgacggcagtgcccctggtggtggaggggctgggcacatgctctggtcacatgctctggtccccctccaggcaatggcaagagtgaccccacaggaaggaagaaccctccttggatgggagtgtggacggaagggctgttgccactactccccaggctggccggccacacggacacgtgtgggatgtgtctgggacatgcctgggatgtgtgcacaggcctcctgggatggtcacagctcattgtggaggggctggcactggggagagagcttctcctccaggacgccgtcgggggcgcacacccaggggtcgtgggtctcccactgccacttggccagctggtcccgaagcatctccagaagctgagcaaagcgcgggtcggtggccaggttctgggtctcgtgggggtcccggctccggtcgtagagctcccagcgcgcccggtagtagtaatgacggaggtccttgtaccagcccgtgggctgaccagctgtggtgcggttcaggaggtcctggaaggtgggtgagacgtagaagtcctggtcgatgggaaagggcatcttgaagttgaggttgtgcacgaggcggaagtgccggtgctgcacggagcgcatggggtaggacatggtgacctcgtggtggctctggctgccaaagacggtggcccagaggggctcggcctccagcgccggcaggagggaccggccagtgaggtggatggtcttcgagccaaagatggcgtagctggggtacgggatcgagaaccaatccaagatggtgggcgtgaggtctggaagggacgcggcatctcagagcagcagagccctcagcacacaggagctgccctcggaagggccgaacctacgccactctgggcggctcccttctccaatccaatcagcagcgggaggtgccttgtcgagccgacacctctcaccgccacgtcatctctctgggcctcagtgccttgaatggtataacaagaggccctgattcggtgacatttaggatccttctaaaatcccatggactggaaaagaagtctcctttttggtagctcgtgtactccagcccctgtggtgggtgtggccacagtgctcctggctcatcatttggggccagagagagatgtgggccccaagagagatgtgggccgcgagctcggagggaaagggaacctgagtttcctgctgtcccgggcccaccccacctggaggctctgccaggcagtgggcaggacacacgagcctctgccctgtgccgaaggggtcaccccgagcccctcacaaagtcttcctgcacccgtgtctttgtctgcacatccataacatgggactagatgtcctaggtctttttaggaatgagcagggtcatgaggtgctttgggtcccccaggaaggcaggatggggtgcacggatgctcagagaggggtccccaggcccacagtatcggcatcacctgggaacttgtcagacatgcaaattcttgagcccgccaagatctactgaatcggacaccctgggatttgcaatttggatattaacaagcatcccaggtgattctgaagctcatcggaggtaggcggggaaaaggcaatggttttgaaagcagcaggatccaggcgagaatcctagcttagtgcttaccagctgtgcaatcctgagcagcttacttcacctctctgagcctcattcttttcctctgtagagtgggagtgacagtcccttcctcacccagatgatatgagagccacattaggtaatgggtgtggagcagcatctgacaggtcatggccccgtcccagatccactcccacacctttcctgacggagacagacaaaggcatacctaggaggctcacgtaggcctcgctgacttggccccagcgttttgggtgctccggggatgacaccagtaagggttcagcagtgcccggccagtacaggttggtcctgccgctggggaaggggatcccgttgtcggacgtgaagatcaccagtgtgtcgttcaggacaccggcgtcacgcagctcctggagcaccagtccaactcctgtggtgaggggccgagaagcagagctcagccgcagacacggagggaggcagcgggtggtgtgtgtagacccacctgctgctgcatccggccgctgggctccagcgctttccggattcgaaagcaccctgtagttcttcccaatggccctggctcttgcccagc

SEQ ID NO: 4702 - DNA, 14254 bp, Homo sapiens
gctgcatggcctacccatagcggcggtgggagcctccgccggggagagcccgctcgggggcaggaagtggcccggccctcctcgtggagggcgtttccggagcgcctactgtgctccttgccggggtgggggtcgttaccgagtgggaacttctgcaaatcctgacttttgtcacttcgcgccccgcacaagatgtcctgccggcggtgcgattggtcccgttgcttcgaggggaaactgaggccacttagtccgggcacttacccgcagctagttaaggactaggctctgatggagacgcttgttacgacctcaatggcctgtagaatctgggaggccgcctccgacctaagcccaaaaagcacatgatcgggctcacagggggcggccagaggtgaaaacagccaacgctttacaacgacgctgtgcggggcacttcgtgtgtgtcatcccgtctcatcctcgggtgataggaactgttcattcgggaaaattgcaaacaactaaatacccctcaccaggagctggcccattatagcaactctgagacctctctaccgcaggctcttaaaatgggacaccgccgcccgcccctcgggcaccggacacaggcgcggctgaggactgacggccccctggaagccactcgggagtcctagattttgctgaaggaagaaggggctggagaaaataaaagggcaggagtctggagtgtgataactgtggcttcgtctcatttccacccgccaagactaaaacttccctcatctgctcagcgagcctggtctgggcctccgggacataaatctcgatgctgtctgcgctctcggtggctgagttctgccgcacagaagctgcccgcttggccgccaggagtctcttgcgggcctcctggcgctgcttgtcgctggcgtctgaggccttgtcgcggctcactgccggcttggatttggctggcttctttgggaccggagggggtggtttcttctcttcctttagtgagacagtgaggagagaacaaaaataaaataaaggtgccacgttttgtgtggcactacccccaccatatgccggcagctggagtctccaccccagcctccccgcatcgggcacaagcaacacacacttggaatcaggaagccacgagaagcgatgactgacagtgggaagagctcaaggcactggagcagaaagcaagcctagactccgagagcgctcgagcagcggggacgggcagatcccattgtccaccctcatgttgaatcaccgggagcccgagactcgggcaggaactagcccgagtcacagtcagagacaaatttagggcttcaggtcccattttacaggctattctaggggattagacagggccacggttcaacaggggtcactggttctggtttgcagaaggaagcctcagggaagaggctggctaccacaaggtcacagagctggctccagaccccaggactcctggcagcagggccccaggagaagggaccatttttgctgcctcctctgttataacgtgattgaggctgtgggcgtgcctctcccaggatccccttttctggacatgcagggcaggacacatgcttcaggggcagcctcaactacacggagcaagcggcatgccagacaagtgccaagcatggaccccacgcagtgatggatgtgagaccccagctcaaagacgacacacggagaagggagccaagcagcactgaccgatgtgggcagcgttattgccgaccaggaatttgtccctggacttcccctccgcactgctccatgctcaccttcctcttctcgggggtctccaccagctgccagctgttggccttgaggtggtagagttcatcgaacttcatgctgatatcctcgatggacagctgtagcaggtcccagaaccctgccaggtcctgggctgtggggcgtgggttggcatcagggttctgtgggccagatggggatcagtggggccagctcagcagaggcttgtcctgctccccccaaccccccaacaagcagggttcctctgggccctgccagcacccgcgggggctcttgaggcctagtgtctgggtaagtatctgtatgaatgaatctaagccagttctggtcagcaccagccctagtggtggggatctttgggggatagtctaagggctgtggcaaggaaggcactcctgtccctaatgtatgtgtatgctagcagacaggtattctcgttttgcagggaagaaacagaagttcttggccatggtgtgacagtgacaccgagagaagcccgattcactcccaggtgggaaaggtcacagaatctgtgttgtttccctcgtgtcactctgttccatgacaacgcaacccccaagtctctgtaggtcttggagacaaacactcactccactgcctcccgctgggagtacacacattcccacaggcagaacagcccaggactttgcttttgaccctggcagggccagccctcctaacaggtaagagggagggagaaagccaagccaccaatcccagcagtgggatttctttgttttttttttttttttttttttttttttttttttttttgagacggagtctcgctctgtcacccaggctggatgcagtgacgcgatctcggctcactgcaagttccacctcccgggttcacaccattctcctgcctcagcctcccgagtagctgggactacaggcacccgccactacgcctggctaattttttgtctttttagtacagaaggggtttcaccgtgttagccaggagggtctccatctcctgacctcatgatctgcctgcctcggcctcccaaagtgctgggattacaggcgtgagccactgcgcctggccaaaaaatatatatgtatataatttttgagacagagtttcgctgtcattgcccaggctggagtgctggagtgcagtggcacgatctcggctcaccacaacctctgtctcccgggttcaggcgattctcctgcctcagcctcccgagtagctgggattacaggtgtgcaccaccacgcccagctaattttgtatttttagtagagacagggtttctccatgttggtcaggctggtctcgaactccggacctcaggtgatccacccgcctcagcctcccaagtgttggaattacaggcatgagccactgtgcccggccgatacagaatatattttatataaataaaccagtgctaattgactttaccatccatgtggctgtttcaacatggaaagatattagagatctgatagggccacttttgccccctttcttgtgctagacactgacacacattgccactgtccttccagcaccatgaggaagccgcgctgtgtgtgttacagaggagggcacagaggcttcgaggggctggcagagtatagtgggcagccaaaggctggaagccctgctgtggaggaaggagaatcacactcaccaagttttgctcacagaggccccggaactgctggaatttctgggacatcagtagctgggcactgcccacagcactgaggacttttcctaagactgagaaacagagggtggaaaaagactgatttagcacagcacagggtttggtgggatggcatcatgcttttaatctcctcccacactcccttagggtagaactcattatttcatgatggcggtggtcttcattttatctacacattaatccattctcattgagaaaaacacaaacaatataaagccaaccccatcccatttcctgaggatatgttatggcaacaaatatgaaaactgagtgtaaatgtaaaacattttccagaaaaacataaatcatggtcttaagagaggctgcgtacagtggctcacgcctgtaatcccagcactttttgggaggctgaggcagatcacctgaggtcaggagttaaagaccagcctgggcagcatgatgaaatcccgtctctacaaatatatgaaaattagccggacataatggcagatgcctgtaatcccagctactcaggaggctgaggcaggagaatcatttgaacccagcgggtggaggttacagtgagccaagatggcgccactgcactccagcttgggtgacagagggagactcagtctcaaaataaaaaatctgattagactcataaatatttttaagaaactgaagcagaactcttctcagaaaaaggaactaggtgtaagtagttttacagctgaggtattaaaaactttcaaagaacaggaaatcccttttttatatattccgttccagagattaaataaacatggaaaatgatgcaactggttttaagaactctgagagcagataggacatgccaagaatggaccactttcactaacataaatgtagaagtcttaaagtataagcaaataggatctatcagaagaattgtaaaaaataaatatcctaatcgagaagtctctttaacccaggaatacaaggttgatcttgtattatgacttctagttttaaagtgctggcatcagccgggcatagtggctcatgcctgtaatcccagcacttagggaggcaggaggtctccaccaaaaatacaaaaaattagctgggtgtgctagtgcgcatctgtggtcccagctacctgggaggcagaggctgtggtgagcttagaccatgccactgcactccagcctgggggacagagtgagaccccctgcctcaaaaaaatcataaagtactggcacagctgagcactttgagaggcctaggccacggggtataaaagtccatctctacagaaaatacaaaaataagccaggcatggtagcatgtgcctgtagccccagctacttgggaggatcacttgaactaggtaggttgaggctgcagtgagctgtgatgacagcattgcactccagcctgagtgacaaagtgagaccttgcccccacccccaccacacacaaaaggtgctggcataaagacagtgccacccatccccaacccccttagaaatcactgaaaagcaaacaaagtaaacaagatgggggaggctgaggcgggtggatcacaaggtcaggaattcgagaccagtctggccaacctggtaaaaccctgtctctactaaaaatacaaaattagccaggcgtggtggcccatgcctgtaatcccagctatttgggaggctgagataggagaatctgaacctgggaggcggaggttgcagtgagccaagatcacgcccactacgctccagcgtgggtggcagagtaagactccatctcaaaaaccaaacaaacaaaaggagcatacccaataatctcttatttgaaataatctcttatttgaaattaaaaaaggaggcttgggcatagtggctcagacctataatcccagtactttaggaggcttgaggcaggaggatcacttgagcccaggagttcaagaccagcctgggcaacaaagtgaaaccctctctctatgaaaaaattcaaaaattagctgggtgtggtagtggatgcccatagtcccagctatccaggaggcaaggcggggcgggaggattgtttgaacccagggtttcaaggctgcagtgaactatgatggcaccactgcattcctccaacctgggtgacagagcaagaccctgtctcaaaaacaaaaaagaaagagtgtggactgcagcaagagctttcctgaacctagccggcaacaaggagaatgacagaggtggggaggtcctgcactgtgaggagccctgtagttgcctgtggagaagaaaatcctgatagaactcttccaggcacccatcccacgtacagattcctgccagcctgggacacagtcctggcccgtctctcacaatgatctacttacaagagctcatcaagaaagaattcacctcattaagaaattagtaattaaaagggaactgacacaggagttaaagatattacaggaacagcaaatggcacatgaatacttaccagaaattgttgccagggaatagatgaaaattgtaacatttatccaagaatatgtaaaagagctcaaagcagagatagtaagacaatggaaagagataaaacaggggctctggaactagagcaggaggaaaatcaggccatcatagaaacaaggccaccctggagatcgtacagagattcaaccctgctgaggacttgtcctgagtagcagagccctacagggagaggagggctgaaaggcttcaggtacaaaatgcttcagctgccccatgaatagaataaaactttaattttaaatgaatagttaagctggggggaataaaatgagctccccagggtagacagtggggacctgtgtctggcttagtttaaagaagagtgggaataaaagggagtcttaattattatataagactgcacctgggtactttatctttttagaaacagaagtagggactaagtaataaaaaagaaaaactactaaaaagagattcagaggcatggaagagaaagaacatgcatctatcagagttctaaaaggggacagagggatgggagaaatcagagggatcatggttatgaacgtggaggctcacgcctgtaatcccagcactttgaaaggcaaaggccaaggcaggcagatcactcgaggccaggagttcgagagcaacctgggcaacatggcaaaactccgtctctactaaaaatacaaaaaatagccagatgtggtggcacatgcctgtaatcccagcactttgggaggccaaggtgaggtcggcagttcaagaccagcctggtcaacatggcaaaaccccatctctactaaaaatactaaaattagccgggcttggtggtggacacctgtaatcccagctactcaggaggctgaggcaggagaatcacttgaacccgggaggcagaggttgcagtgagccaagatcacgctactgcactccggcctgggtaacagagggagactctgtctcaaacaaacaaaactctcagatgaaaacataagaccaaatctccatgaccttggattttgcaatggtttcttaagacaccaaaagcataagcaatgaaagaaggggaaaaaaaaaaagcagataaagaagggaaaaaaaagcagataaactagacgtcattaaatggaaaactttttatgcatcgaaggacactatgaagaaaaaagctgggtgtggtggcttatgcctataatcctagccctttgagaggctgaggtgggtgtatcacttgaggtcaggagtttgagaccagtctgcccaacatggtgaaaccctgtctctactaagaatacaaaaattagctaggctggtgacgcatgcctattaatcgcagctactcgggggtgctgaggcaggagaatcacttgaacctgggaggtggagggtgcagtgagctgagattgtgccactgcactccagcctgggcaacagagtgagactctgtctcatagaaaaaaagacactatgaagaaatgaagccaacgcacagaatgggagaaaatctctgcaaatcatgtatctgataagggtttaatgccaagaatatatatatataagaattccctacaactgaacaacaaaaagataaacccagttttaaaatgtacaaggatagttctccaaagatagatgttcagtaaatatgctcaacatctcaacagcattagtcatcagggaactgcacatcaaaaccataatgatacttcatacccattaagatagctatcaaggctcctgcctgtaatcccagaactttaggaggccgaggtggagtaccacttgagcctgggagttcaggaccagcctgggcaacacagtgagacctcttctctaccaaaagaaaaaaaaaaaaacaaactgggcatggtggtgcacacctgtagtcccagctacacaggaggctgaggtgggaggattgcttgagcccagaaggtcaaggctgcagtgagctatgatggcactattgttaatttcagcctgggcagcagagtgaaaccctgtctccagaacaaacaaacaaacaaacaaaccccaaaagctatcaagaaaagtggaagcaagtgttgcaaagatgtggagagattggaaccctgtgcattactggtaggaatataaaatgatgcagctgctgtggaaaatagttgggtggttcctcagaaagcgagacatagatctgccacatgatcaaccaattccacttctgggtataaacccaaaagaattgaaaacagacttaaacagatacttgtacgccaatatttatagcagtttgactcacagtagccaaaaggtagaaacaacccaagtgtctgtcaatagatgaatagactctgactaaaaagaaaatctgtgtgtacatgcacgcacgcacacgcacgcacacagacagaaaactctaaacctcatataaaatatacttctcacacatggaacatttgctaaaaatgaccacattcttggccataaaatatacaataaattaaattacaaagaactgactgggtatcatacagatcatgtgttttgtttttgagatagggtctctgtcttgtcacccaggctggagtgcagtggtgccatcacggctcactgcagccttgaccttctgtgcgtgcgcaatcctcctgccttagcttcctgtgtagctaggactacaggagtgcaccaccacgcccagctaatttttttttttttgagatggagtctcgcactgttgcccgggctggtgtgcagtggtacgatctcggctcgctgcaacctctgcctcccgggttcaagcgattctcctgcctcagtctcccaagtagctgggactacaggcgcgcaccaccacacctggctaatttttgtatttttagtagagatgggggtttcacgatgttgaccaggctagtctcgaactcctgacctcgtgatccgcctgcctcagcctcccaaagtgctgggattacaggcatgaaccactgcgcccggcctaattttttatttatttatttattttttaaatagagaagaggtcctgctatgtttcccaggctggtcttaaacttctaggctgaactgatcctcctgcctcagcctttcaaagtgctaggattgtaggcatgagccaccagatcatgttttttgacattaatataaataggttagaaaccagtaatgaaaacataactaataaactcccatataaaaacaaagatttacacatctaaataacccagtcgtcaaagaaatcacagtggaagttgcagatcttgtcagatacagctaaagtagtagttaaagagaaatgcatcggcttcaaagcttatataaaaggacaggctgaaaaaaatgaattagcttccaatttaagacattagtaagggaataatacaattaacccaaagagaagagaaattaataaaaataagaggattaataaaattaacaaaccctgtcagactgatcaagatcaaaagaagacagatgcaaataaagattaggaatgagtaaaggataatgtgatatagctatactagaaaagatactcaaaactagagttatacacaaccatgaaataaaatcctggtttttttttttttgagaccgagtcttgtcttgttttgttgcccaggctggagtaaagtggtgggatctcagctcactgcaacctctgcctcccgagttcaagcaattctcctgcctcagcatcctgagtgtagctcggattacaggcacccgccatcatgcccagctaatttttgtatttttgtagaaatggggtttcaccatgttggccaggctggtcttgaactcctgaccgtgagctgtccaccttggcctcccaaagtgcaggattacaggtgtgggccactgcacctggcaaaatcctgttgttaaattccttcagagactatgagaagaggaaacgtcccacactgatttttgaagctagagaaccttaaaactacaacaggacaaggatagaaaggaaagattacaagccaatgtctcatgaacaaagacaaaattattaaatcacatattaaacccggcagtgtactaaaataatatatcataaatttagctgggtttattctgagaatgcaagactgattcaacattgacaattgtaatcacttctgattctggctaagacaaaccagtgagtgtcagacaagctgacttctcccaaccaccaacaaattaaaaaaaaaaaatcagtaacaacaactcattttcaaaacattaagaaactactaggccgggcacggtggctcacacctgtaatcccagcactttgggaggctgaggtgggcggatcacctgaggtcaggagtttgaggtcaacctggccaacacgttgaaacctcatctctactaaaaatacaaaaaataaccgggtgtggtggcacatgcctgtagtccaagctactcgggaggttgaggcaggagaatcgctttgctctgttgtccagactggagtgcagtggcgcaatctcagctcactgcaacctccacctcccaggttcatgcaattctcatgcctcagcctccccagtagctgggattacaggcgcccgcaccacgcctggctgatttttatattttaagtagagacgggatttcatcatgttggccaggctagtctcaaactcctggcctcaagtgatctgcccacctcggcctccgaaagtgctgggattacaggcgtgaggcactgcgtccagccttttctttctttttttttaagacacaggttcggccaggcgcagtggctcatgcctgtaatcccagcactctgggaggccgaggcgggcggatcacgaggtcaggcgtgagccaccgcacccggctgtattttttatagagatacaaaatataaaattagccaggcatggtgtttcgtggggtttcattatgttgcccaggctagtcttgaacttttgggatcaagtgatccacctgcctcagcctcccaaagtgttgggactacaggcataagccactacgcccagccatacacagaacttttgattttttttccttcatatctaacagcaactttattcagaggaaatgaaacacagcaagcctttaggcatagtgtgaatttcccaggacaaagtactgtcaatttttttttttttttttttttttcctgagacggagtctagctctgttgcccagactggaatgcaatggcgcaatctgggctcactgcaacctctgcctcccgggttcaagtgattctccggtctcagccttccaagtagctgggattacaggtgcacgccaccacgccccgctaactttttgtattttagtaaagatggagtttcaccatgttgcccaggctggtctcgaactcctgagttcaggcaatccacccacctcggctcccaaagtgctgggattacaggcatgagccaccgtgcccagccagtactgtcacattaaaactctgaggcatggcatgcgaagtactagaatcctacaacaagttatactaggatcaggattagaataaggattctgttgttagcattatgccaactctctataatgtgcacactgtctactaagcacagcataggcttctgaaaacaagtgatctgtgtggaccttttatttttaactgggcacatagcctggaatcaagcatttcctagactcccctgcagcaagatatgcatagttgtatgtctaaattctggccaaagcagtggaagcagaagcagtgcgtgggccagctgttctcctttgctgttggttcctttgctggctggaatgcacttaggatgctgggatccagcagcactctgacagttgagaagatcttatcaatgaaagccaattaatggcatcaaactgcaaggaaacaaaaaagcctgtggctccaccatcactatctgagacattcttgagaatgaaataaacagtcttgtttaaatcactttttagaaatgttttagtgttatttgtaggcaaatgtaatcccaattaatatagcctcaaaactagtagggtttgtaaaaggagtgaggagaggagttaatccaaaagaagggaagaaagaggaaaaaaggcacctcagaaaaggaggctgggctcagtggctcacgcctgtaattccaacactttgggaggcccaggtaggaggactgcttaaggctagaagtttgagaccagcctgggcaacatagtgagagaccatctctatttaaataaataaattaaaatacatttaaaaagcacaaatcccccaaaataacatggtaagaatgaacctaaatatatagaagtcacctcgtaaaaatggactacactacctatttctaaaataaaaatcaggaaactggataaaacataaaatccaggtatatgctgattacaagagacatgattaataaggacagtgaaaggtaaaaagtaaatggatggaaagagatataccagacaaacactaatcaaaggaagtctgctactgtaatagtcataatacatataactcttaggcaaacacaaacagagattctgaaaaacagaatggatcagtgaacatctgccaggaatattacaattctaaacttgatccatccaatatcttcaaaatatataaaacaaaagttttttaaggagaaatggacaaaccattttatagaaagtggtgtgatacagacatgcaatgaatggaaaacagtaaactcaagctcatcttttggatggacgcatccctcccacattccagttctgccttcacacctaatctcagtggtccttggagtgactggtgggcctcctctctcctggatgccagtttcaaatctgctctccagagacgtcctacgcgtcctctccacctccttaccctgaggtgatgactctgctcccatctgcctcacctcacctctcctcagacatggcctttctcctgtcactgtggagaagctatctgttctctacttgggcactaattcgattccttctcacctaaggataaccccaacagttgcctgttttctctccagcataataagctccctttctctaacaaggtcattctcagcaacatataaacatgcttatattgctccattaaaaaaacaaaacaaggacaggcgcggtggctcatgcctgtaatcctaacactgtgggaggctgagatggggggattgtttaaacccaggagtttgagaccagcctaggcaacaaagcgagattgcatctctataaaaaagaaatttttaattaggcaggtgtggtggtgcacccctgtgttcccagctacttgggaggctggggtgggaggatcagtggagcccaggagttcaaggctgcattgagctgagatcacaccactgcacttcagcctgggtgacaaagtgagaccctatctcaaaacaacagcaacaacaacgaaacagctgtctcctttgaccctacatccctccatttctctgcttccttgtacaggaaaatccatgcatgtggtctccaattactctcctgttttctcttctcttaatcctcctcctctcaggctaccttacccatgcttctgccatcacaattccaccaaaatggccctttatgtatctaatgacctctgcctttctagatctggcttggtgagcccttcagctgcctttgacactggattctcccttgagaacgttgttcaggtggcttccaattgctcttcctttgatcttgctgtttattcctccctttccaccgctaagtgttcatgtctctgggatcagtctttagacagcttgtcttctctacttattaggcattctcatcttattcatcttaatctatactctggtgactcccagatagaatcttcaaactggacctatccccagactcatatatccaactgcctgcttgacttctctattctgatgtctaacaaagcatatcaaatttaacatgttccaaaccaaactcctgactttcccccagatcgacatttcctatagttttccccatttcagtggcaatgccatcctcttcttcactcagactccaagccatgtttggctcccttactcttacccatatctaatctgtcgagaaatcctgttctatcttcaagatatatccacagtctgattcctccattaaagtctctcttacacagattgttaaatcctcctaactcatctcccagcttccatttgtgtgccaatggaaggtacacagaggttctcatttggatagagaagccagattaattctttttttttttttttttttttttttgag

SEQ ID NO: 4703 - DNA, 2789 bp, Homo sapiens
cacgtggagtgtggccctgtgggcaagggctgggctcttggaggtaggggagctacaggggcgactgggaggaggatgttgtgttacacacgcatcagagttaactttgcagtgagagcggccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcagagtttgctcagtgagccgttcactaggtgcaggggcagttccccgtctgaatttaggtgacgacactcaggtccagccttgccagtctcagcctccggtctccgttccccctctgcagaggtcactttgtctgctgcacgtgatcatgaggggttgtgaagtgcttgccccatcagtagccatgtgtgcatgtgtaaataccatcctctgtgtgccctggaggctgtccttcagatagcatgtacaggtggcagcatagggcctgtccctagtgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcaccgacgcccaggaccctggcctgcagagacgcccccgccacaggatccagagcaagcagcgccccctggacgagcgggccctgcaagagaagctgaaggactttcctgtgtgcgtgagcaccaagccagagcccgaggacgatgcagaagagggacttgggggtcttcccagcaacatcagctctgtcagctccttgctgctcttcaacaccaccgagaacctgtatggccagaaggcagggccgaggggtgtgggcggtaggcccggcctggcttagtggggacccagggcatcagacacaggtacagcacatagcccaggagccagggggtgactggggtggctcggctcgggaggcctgggaccccacagtgcacactgtgcccctgatgatgtgggagaggaacatgggctcaggacagcgggtgtcagcttgcctgacccccatgtcgcctctgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcagtccagggagctcccagagaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggtaggaggcagggccgctgcccaccctgggccggcacattgtaattctgtcctgcctttttcttcctgtatttaagtctccgggggctgggggaaccagggtttcccaccaaccaccctcactcagccttttccctccaggcatctctgggaaaggacctggggctggtgacgggcccggaggagcctttgcccgcgtgtcagactccatccctcctctgccgccaccgcagcagccacaggcagaggacgaggacgactgggaatcgtagggggctccatgacaccttcccccccagacccagacttggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 4704 - DNA, 914 bp, Homo sapiens
agcgccagggtccatgctgctgcctttctagacaccggcctgctccagaccattggagccaaggcgagccagtcaggagcacatccaccctcaaggcccattcacaggaatcaaaggagccgacacaggacaagccataaaccacaaggagcagcggcccccagcgcaggggcaaccaggccaaaagcacagatgctcccagacagtggctctccccccagcaggacactgggtgatgtctgggaacatttgtggttgtcacgactgggggtactcctgacccggagtgaatggaggccaaaggtgctgcccagcaccctgcagtgcccacggtgccccagagtgatccaggccagagtgctgacagagcccaggagacctgcctcggaataactccaaatgcaccaagagagccccagaaaggccggcacggccccatgaggttccctatcactccccgcactgcaacagcctcccccagatcacggccctctctggcctgaccaacaatcttgccaggtgccttgtgctcactctgcacaggtacaagtagtcacggcctctaggggcccagccaggagccccactcaggatgtctccttccacagccacccaataaacccagagacctgccatgggcctggctctgagctgcatggcccccggccacagtcctgggtatcctcgaagctgcccagaggcggctttctcctctctccgctgagtccttcctccctctgtgactttcctacaatatttccaggtgtccctgtcttaccattccccagtgtaccagataaaatcttccataaacctctctctccagttccatgaccgtgtgctgccttggaagccagcagaacacaatggcctgggcgctcgaggtgacccctctgagcctctgtcctctcccc

SEQ ID NO: 4705 - DNA, 2775 bp, Homo sapiens
tttggctccagccaccccaatggcatttcctcttaagctgttgggaaagacaggaagcctaaggcatgggtacaggctgagaggtgatactgacccctctgcgggtgggcttggggctgcttggtagaggaaacaaggacttcagcagtcacaggaggccagggctgtgccttcctcactccagggcaacagggcagagctggctctgggaagcagggcacacaggggcatggctggcctagccaggagggttgttggagccttcctcctcttccatttcaaacagaaaagcggggctgagacaggagaggcagccctccatctgggcaggtccccagtgctcccagcaagggcaggaattctgaggacatgcctgagcctcagagctgtaacctcaccccaggactttggatctgcccagagaacaagatcagcccccctgggacccataaaccaggcctctagacgtgttcagcctggcaaggccaacccggagaggagggcaaatgatagcgactcccagggaaaggcatgaagtggggctgggaaactggtatacttgcactgaaatgaagatcaccaggatgatttgtgagttgtctgtaaactttgtccccatatctattcattgagaattcattgatttctttgggctaaagaccatagatggagactggaatacttactcgagaatctccaaggttctgttcacagccaaggcttcccctagcacctgggcgcctgaagcaccaattgaggccacctggagactggggcggagagggtgccgtcagtgtgagccggctgggcccacctccctccgcatactccgttccctttcaccaccccttgactcaggatggaaagtggagaaacagcactgagaatggttggccagcgctgtgtctaggcactccatctcctacctacactgtctgttgcctaagacagagatctggatgctaaggagatgagaaatagaggctgtccctggaagggctcggggagaatgctccctgtacctcctcattactactctctaggtgtttgagcccccaactgctaatatcatatttcctatattaggaaaatcaaacacaccttccttgacttgtaaacaaaaataacgtccaggccaggtgtggtggctcacacctgtaatcccagcactttgggaggctgaggtgggcagatcacctgaagtcaggagtttgagaccagcctggccaatatggtgaaaccccgtctctactaaaaatacaaaaattaggctgggtgtggtggtgcacgcctgttatcccaactactgtatgggaggctgaggcttgagaatcacttgaacccaggaggtggaggttacagttagctgagattatgtcactgcactccagcctgggtggcagagcaagactcttgtctcgaggaaaaaaaaaaaaaaaaagacctctaacgtgaaaggatggcgaagggaccggtttcctgactgctgcgcacatctaggacttactagagagcagtgagggctgtgttgaccttcagtgcacgggccaccgcacacgctccgtcatccccgatggcgttctcctgtaaactagacacagagtatgacccctttgggtgcacggggcacagggagcattctagcaaggccctgccgcacttggacctgccaggtttaaccgactacacacaccatagacactcccagggtttcctggggataactgcccttcctccacaggccctgcagcccgccgcctcatactaagcacacagaggcgtctggggcctgcatgagtctgaaccgccagaggcaagcaggaaatgggacatatagagtgactgtcagcaggggcttgggacccaaaaggggatgcttttcacagccaaccagaaaatgaacttaaagccctcaatccctgagccattcttgtttgtcttgttttctcttgagacagggtctcactctgccacccaggctggaatgcagtggtgagatcacggctcactgcagcctcaacctcccaggctcaagcgatcctcccacctcagcctcccgaggagactaaagtacttaactagagacggggactacaggcacatgcccccatgcccggctaatgtttttattcttttatagagatggggtctcactatgttgctcaggctggtcctgaactcctgggctcaagcagtcctcccaccttggcatcccaaattgctggcattacaggcaggagccaccacgcccaacctccttggccattcttgctaattagggctttgtgtcattttttccccttctaagttggagggaactagcaggccctggtgcagtgagtgactgagtttagctcaagcgcacactggtatgttcaaggccaagagctgtttgcattcattattttaacagacatttgagtgtggccgggcgcagtggctcacacctttaatcccagcactttgggaggctgaggtgggtggatcacttgaggtcaggagttcgagaccagcctggccaacatggtgaaaccccgtctccactaaaaatacgaaaattaggctgggtgggtgtatttttagtagagacagggttctctgtctctactaaattagctgggagtggtggagggcacctgtagtcccagctactggggaggctgatgcaggagaatcacttgaacccaggaggtggaggttgcagtaagccgagatcccgccactgcactccagcctgggcgacagagttagactccgtctcaaaaaattaaaatg

SEQ ID NO: 4706 - DNA, 12817 bp, Homo sapiens
gatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggaatatacaatagagttttccagaggctgctggatgagtcatattgtaacagatgcaatgggaacatggagctatgggaactcaactgccttaagtgaagccagacattaaggagatttgaaaaaatataatacaatgccactcttctccctatttctgttttggaaaatgctgtttttcgtaaagtaggtgctttttaaaaaatatgttgtattagtcatgagggctctggtaacaacataccacaaatggggtggcttaaacgacataaatttattgttacagttgtggaagccagaagtctgagatcaaagtgttggcatagttggttccttctgagggctacaagaaagtatatgttccatccctttccttagtttttggtggtttgctggcaatctctggcattccttggcttgtagatgtctgactttgtcttcaaatgtcattttccctgtatgcgtgacaagttgtctgtctccaaatttctgtttttataaggacaacagtcataatggaccagggctcactctaatgacctcatttcagctctttaaagacactgtctccaaataaggtctgaggtactatgggttagaacttcaacatatcaattttgggaagagacacagctcaacctatatattaacatagaatagattttgaaaaattatattaataaaatatattaatttttttccgttttaattcctaatacaccaaatattgataggacctacataaacaaaaactgtttaggagccgggcacggtggctcacacttgtaatcccagcactttgggaggcggaggtgggcagaccatgagatcaagagttcgagaccatcctggccaacatggggaaaccccgtctctactaaaaatacaaaaattagccgggtgtggtggcatgcgcctgtaatcccagctactcgggaggctgaggcaggagaatcacttgaacccgggaggcagaggttgcagtgagctgaggccacgccactgcactccagcctggcggcagagcaagactctgtcttgggggaaaacaaaacaaaacaaaaactgtttagggtcttcagtgacttttaagagtgtgaaggggtcttgagacaaaaaacgtgagacacacttgtctacagaataggcttttttttttttttttgagacagagtctcactctgtcgcccaggctggagtgcagtgacacgatctcggcccactgcaatctccacctcccgggttcaagcgattctcctgcctcatcctcccaaatagctgggattacagacacccgccaccacgcccggctaattttttgtatttttagtagagacagggtttcggcctgttggccaggcgggtctctatctcctgacctggtgatccgcccaccttggcctcccaaagtgctgggattacaggcgtgagccatcgttcccggcctaggctttaggcaagctttggtattttgtattcatgttgatcatttgatacagagtacttatttttacttaaacagatgtagtatttttatttcctctttgaccaaatagctgtttcatatatattctaaaatacccacaattattaatttgtaattttgttgtgctattaaagtatatgataatatgattttctacttttttggtttctttcttctttttttttttgagacagagtttcgctcttgttgcccaggctggagtacaatggtgcgatcttggcttactgcaacctccgcctcctgggttcaagcgattctcctgcctcagcctcccaagtagctgggattacaggcatgcgccaccacacccggctaatttttgtaattttagtagagatgggtttcaccatgttagccaggatggtctcgatttcctgaacttgcaatctgcccaactcggcctcccaaagtgctgggattacaggcatgagccaccgcgcccggcctttttttcttttcttttctttttttttttgagaaggagactcgctctgtagcccaggctggagtgcagtggcacgatctcagctcactgcaacctccgcctcccaggtcccggttcaagcaattctcctgcctcagcctcctgagtagctggatttacaggcacgcaccaccacgtcttttagtagagacggggtttcaccatgttggccaggctggtcttgaactcctgacctcatgattctcccgcctcaacttcttcttgataagaattctggaaaatcaaatcttcaaggactaacccactccctttaaatccaagggattatttttatttttatttttaaagaaacagggtctcactctgttgcccaggctggaatgcagtggtgcaatctcagctcactgcagcctcaacttctcaggctcaagtgatctcacacctcagcctcctgagtagctggaacaacaggcgcgtgccaccacacctggttttttatttcttgcagagacagagtcctgccatgttgcccagtctaatctcaaactcacggcctcagttgatccttccacctgggccttggtctgttaggattacaggtgtaagccaccacacccatccaactccaggggattctaggaagccaaggaaccttcctgccctgcctgctgaaataaactcaaactggccaaacagacaagtctgacatcttttctttatgctttttttttttttttttcctgtcaaggagtctcactctgttgcccaggctagagtgtagtggggcaatctcggctcattgcaatctccaactcccgggttccagcgattctcctgctcagcctcccaagtagctggcattacaggcacccaccaccacgcccagataatttttgcatttttagtggggacagggtttcaccatgtcggccaggctggtcttcaactcctgacctcaagtgatccgcccgcctcggcctcccaaagtgctgggattacaggcatgagccactgcgcccagcctgctcttgcttgattttttaaattgtcagatcactaatacagagacaccgaatcaaaaggagagtaggacagttgttcataatcccacaaatcaaatgcttacctcctcatgtaccattgcttctctcacctataggcacacatttgaaataatttgttagttatccaaataagaagtgaaccaccagggaattaaatgctatgggcttaaaagggaaagtactcatctcctgccccagtcactcatcctctcagcctcccgacatcactttttttttgagatagggtctcacactgtcacataggctggagtgcagtgatataataacagctaactgcagcctcaacctcctggggtcaaagaatcctcccaactcagcttcctgagtagctgggacttcaggtatgtgctactatgcccggctaatttttgtattttttgtagagaccaggtctcgccatgttgcccaggctggtctccaactcttaggctcaagtgatccacctgcctcagcctcccaaagcactgggattacaggtgtgcaccaccatatccactgcacccacctccagccacttttaaccatatctgttccaattcttcttgaggacacctccgtaattctaatctttgatcatctttagtctttttttttttttttttcctggagacggagtctgactctgttgcccaggctggagcacagtgatgcaatctcagctcactgcaacctccacttcctgggttcaaacgattctcctgcctcagcctcctgagtagctgggattacaggtgcccaccaccacgctgggctaatctttgtatttttagtagagacagagtttcaccatgttggccaggctggtctcaaactcctgacctcaggtgatccacccacctcagcctcccaaagtgctgggattacaggcataagccaccgcatccagccaatcatctttagttttcactaacttcctgctctgacaggtgaggatctgactcacatccgctgccaattcctctcatattacatttcaagctttaattttcatcttctaaataaacttacatatcatgtttaaaagcctacttcctaaaaggatggtaagggaaacctctactctccactactactttccccatctactctcccacatctgcaggtggggctgacattgtcagtgacaggaataatgacaacagtgccctaccctacggccactatgaagttgtcaggtcacagccatgtgttacttcctaaaaattaaaagccaatacaggccgggtgcaatggctcatccctgtaatcccagcactttgggatgccaaggtgggcggatcacaaggtgaggagttggagaccatcctgaccaacatggtgaaaccctgtgtctactaaaaatacaaaaattagctgggcgtggtggcacgtgcctgtaatcccagctactcaggaggctgaggcaggagaattgcttgaacccgggaggcggaggttacagtgagccaagatcgcgccactgcactccagactgggcaacagagactccttctcaaaaaaaaagaaaaaaaaagccaatacctagggttcacgtcacagctatgcaaatgccattccctgaagggtcaatcaacaatctgactgcatctcctcctcctttattcaaatttcatgagctttttgccccctccagcaagaattactcacatcagtgtcaagtgaacactactttctaaagttaccttcacataggaactataaccatctagcagaatttgtatagtttgagcacaatttaccttgaagccttcaattaaaattacctttttttttaagttatgggtgaataaacattccttttcttgccctattccttttctagattaaagctattcctttcttagattcaaaactattttctctagagaaggttctgccatgccatttgctctgttttgagacagagtctcattctgtcgcccaggctggagtccagtggcatgatctagactcattgcaacctctgcctcccaggttcaagtgatactcctgcgtcagcctcctgagtagctgggattgcaggcatttatcaccacacttggctaatttttgtatctttagtagagacagggtttcaccatcttggccaggctggtctcaaactcctaacctagagtgatccacctgcctcggtctcccaaagtgctgggattacaggcgtgagccaccatgccagccctgccatctttttttttttttttttttttgagacagagtctcgctttgtcgcccacgctggagtgcagtggcacaatcttagctcactgcaacctccacctcctgggttcaagcaattctcctacctcagcctcccaagtagctgggattacaggtgtgagccaccatgcccgaccctgacattttttttgtttgtttttttttgagacagagtctcgctttgtcgcccaaggctggagtgcagtggcacaatcttagctcactgcaacctctacctctcgagttcaagcgattctcctgcctcagcctcctgaatagctgggattataggcggctgccaccatgcctggctaatttttgaatttttattagagatgaggtttcacaatgtcggccaggctggtctcaaactcttgacttcaggtgatctgcctgcctcagcctcccaaagagctgggattacaggcgtgagccaccacgcccagcctgccatctgtttttagtcgtggtgttctcagttttccacgatgcatgggtcttattaattctgataataatggcatgacctgaaaatttcctttcagccctggggaagtttccctttctttttcttacttatttgttcaatgtggaaagtaaaagttcctcttcaaagtttcccttcttgttaaagaataaatcataagtgttaaaaaataatagtttcttttataaactaacttccttgaaacctccttgctttgtgctagtaagtctttgttaggccctatcctatgtagctggtaaacatgctcacaggcacgtagtacgttctatgtccctgtaccttaaccaagttatttgtgctggacatgctcatggtcacgttccagcttacagcctatgctccttccatatctggcataagcaacttcctcttttccttcgtctttccactacttttacctatttagaaaagttttaaactgttagctaatctagttttagtttagattgtgcaggctggctccagccaacggagacaggacacagtagcagggacaaactgcctaaggaataaaaattgcttccctcctttgttcaggtgtgctcttgccattgttccatctgtgatgagcaccctttctgcagaaagtaaaaacggccttgctgagagaattaaatttatgttttgagtgctatttctttgcagcaccaggcaacaagcattctgtttctcactaaacattgtatctataacattgaacaatcttacttgtaatttcaaagagcctgttctggttctcattgttctattttatcaaagtatcttattttttatttttatttattttttctgagacggagtttcactcttgttgcccaggctggagtgtaatggcactagacctcggctcactgcaatctccacctcccaggttcaagcgattctcctgcctcagactcctgagtagctgggattacaggcatgcaccaccatgcccggctaattttgtatttttagtagaaacagggtttctccatgttggtcaggctgatctcaaactcccaacctcaggtgatccgcccgcctcggcctcccaaagtgttgggattataggcgtgagccactacgcccagtctgtcttattttttactggtaaccctctttttttttttgaaacgcagtctcgctctgttgctcaggatggagtgcagtggcgtgatctcggctcactgcaagctccttctcctgagttcacgccattctcctgcctcagcctcccgagtagctgggactacaggtgcccgccaccatgcccagctaattttttgtatttttagtagggacggggtttcacctgttagccaggatgatctcgatctcctgacctcgtgatacgcttgcctcggcctcccgaagtgctgggattacaggcgtgagccaccgcaccagaccttttttttttttttttttttttttagatggagtctcgctctgtcacccaggctggagtgcaatggcatgatctcggctcactgcaacctctgcctcagcctcccaagtagctgggattacaggcgcccaccaccacactcagctaatgtttgtattgtatttttagtagatatggggtttcaccatgttgatcaggctggtctcgacctcctgaccccacgatccgaccgcctcggcctcccaaagtactgggattacaggcatgagccaccacacccggccttgtaaccctttcttgactcacttttacgttaacaaaatgctttaaatatttgattctgctgggtgcggtggctcacacctgtaatcccagcactttgggaggccaaggtgggtggattacttgaggtcaggagtttgagaccagcctggtcaacatggtgaaaccccgtgtctactgaaaatacaaaaaatagcttggcatggtggcacgtgcctgtaatcccagctacttgggacattgcggcaggagaattgcttgaacctgggaggcaaaggttgcagtgagccgagatcgtgccactgcactacagcctgagcaacagaatgagactccgtctcaaaaaacaaagaatatttggttcctctgaatatctgtcttttctgctgtcttagataccttctctcatgatggagactttatcttttgctccttgcctcccacccatattgaagagactatcagaaagcagacaggaagctccacagacaggcggggctgctttaacagtacgctttgctcgagggtgaagagggcgagaaccagctatcaggagaaaggcagagggagatttgaaacacagaggaggtgatgagaagacacagcagaagatatctgaagactggaaagaatgctgcaaccaacaggagaaggaaaagacagaaatgtgttttccatttggagcatccagagggagcacaaccatatcaacaccttgattttgatccagtgacattgattttggacttgtggcctccagaacttttagagaataaatttgcattgttttaagccaacaggttggtggaaattttttacagcagccacaggaagcaaacacagactcctaactggtgcttagtcctagaatatcagtttctgttccacttctggatctcataattgcatctcagacatcaacactgacttcatattcttaatgcaccaattctaccatttcttcaggctgcaaacagagaaaaacttatttaagcattccagaattgacccaatagaagactctccagaaaagactgcatggtctctgaagcagcatgatcagcatgactggctgcatctgggctccaccgtttgccacttcagacaggtccttagcctcttagaggttcattttccttgctgtagcccggagtaagaatgtttagcctacaagatttattttgaggcatcaatgaatcactatgtgagcctcacacagtgtctggcactgatattacaaaatatggttgatcttgccatccttgttattgtcctggtggggattcctctctgttgaagatacggagcctctaaaaatgagtggcagaggctcccagctcaggatccttgtccaggtcctaaagatcctccactctgcttgtcactctgttcattatgtttgcatggccaccacggtcaacactactgcggcctacctcaagttctcatgcctcactctctgagctcatgaggacacaaggatcctttggcaacacattaactacactctgtggccatcccttgacttctgagaggatgtttccctcctctcaatcaaaagctctcttccctcctgggcaagatccttgcatgcacccagcaccctcacacctggtgccctcacacccagcactctcacacgtggtgccctcacacccagcaccctcacacccagcaccctcacacctggtgccctcacacccagcaccctcacacctggtgccctcacacccagcaccctcacacctggtgccctcgcacccagcaccctcacacctggtgccctcgcacccagcaccctcacacctggtgccctcgcaaccagcaccctcacacctggtgccctcacacccagtgccctcacacccagcactctcacacttgcactgtcctcatcccaactctgtggttcctctggggaatcactgtggaatccctcatgggaggatgttttcaaaagaaacaacagcccaatgaagggtatttgaggatgagaagcaggaaagaagtcagtgggtggctgagttgtgtccaggttttgcgtggccatggaaaatcaggtgaaggacattaaatatcttgcagtggcttctccattaggagcatgaaatgaggaaaggggctgtcctcacaggccagccaagagggatgcctatgccaaacagaaagactgacagtaaacagaatccaggatgacatgactgaggtatggtgtgcagggcatggcccagggaggagggtagataagtaagcctgggtgcaccttcagaggaagaaataacagaggctgcaggcgagagagttacaaggaaggaggagcaggaagacacgagaaaaattcagataaactcaacatctccagcctgggggaaacgtgagagggtggtatgaagatacacacgatgcatgttgcttagtgaaagcagccagtcggaaaaggctacgtagtgaatgaccccaactatgacattctgaaaaaggcaaaactatggagacaggataaagatcagtggttgccagtgaggcaggagaatagggtctgggggcagggagcctaaggctgattcatgctgacttcatgaacggaatcaaaaggaaaaccctaaatttccatgcccacgtaacaaaaggatcagaggctactccctttgcaactccccccaactttctgtgttgcagatgaaaaatggaaagtgcctcggattggtcccctcctgcaaccagtcagacatctgcatagagcgtaactttgtaacttcacttcagcctctgcttggtcaccttccacaaccaatcagactggtcatgggccactatttcatagggtgtaaaccaagtgaccaatgggaaacatctagagggtatttaaaccccagaaaattctgcgaccagtgcttttgagccttgcttgggcctgctcccactctgtgaagtgcatttttgtttcaatacagctatgcttttgttgcttcttttgttgctttgtgtgtttcgtccaattctttgttaaaaatgccaagaaccagccaggcgtggtggctcatgcctgtaatcccagcactttgggaggccgaggcgggtggatcacgaggtcaggagatcgagaccatactggctaacatggtgaaaacccgtctctaataaaaatacaaaaaattagacgggcgtggtggtgggtgcctgtagtcccacctactcaggaggctcaggcaggagaatggcgtgaacctgggaggcggagcttgcagtgagcagagatcgtgccactgcactccagcttgggcaacagagtgagactgaaatgcctaagcttgtttttactctaactggttactttgaattttgtcctgcttgtctctttaatcacctagccttgcttctcatgtaaataagactctctctagctgggaaggccggacaaactccaattgaccccttaatttacaagacactaagggctccttacccaaccccctttcctaaggagttggcctgggtaaacagatcctcagcatttcaaaagagcccaattaactgataaggcactaacaccaacaatgtatgaagttcccaggatttttctcaaagagataacaacagaaaaccttgagtttgtgtccggcatagaccctatatatctaattataatgaaagatttagaaccttgcacgtggtaccgttgctcttcttgtaaccgtttaagttgtttatctctctgtaaccattttgcttctgttgattcttgcatgtttttacttctgtagacttattgcatttgagtccctctccccttcctaaacctaggtataaaagttaatcaagccccttcctcgaggccgagagaattttgagcattagccgtctctttggccgccggcttaattaaggactcttaattcgtctcaaagtgtggcgtatttttaactcgcttgggtacaacaagactccatctcaaaaaaaaaaaagtaaaagaacacaatgccaagaacatagacaccctccactggtaacatattttggtgagccagccaggaggtaggctcgaggtttgggatttctttcttttctctttttgttttcccttttccatataggggaatccttttctctctctctttttccctttccaacttacggatccttggtggacagcacataagcatgcaagcaactgtaagtttctggccggagccactctctggtgaaacggaaagatttctgtgtggaagtgcctgaccgctaccacccagttcgggtgaaggaccttagtccttttcctttttctctttttcagaaaatctttcagctgccgtttcctactagttccttggtaactgagggcagctggccagggccaccctctggtgttgcctgaaggccaaggcgtaaatggggatagctgccctgcccagaaggggaaaagactcttttctctattttccagttacagtccctgatccctatctgtgatgcaactggcagcggcagctcatccagggcgaactcacgcatatttcaggtgacttaaatcctcttttcttatgcaaaattctccttaaagtcagcctgtaagggcaaaagataatgtatctcatgcatttgacttaccttctcttactcgatttgactgtctgaagacctttgggatccacaagcttcagtagacattctacatctcagacttcactgaggggatcccataggttgacggtcattgcttctgcatcaatttgctttccctgaatctcacagaaattctcaaccccagccaggtgcagtggctcacacctgtaatctctgcactttgggaggccaaggcgggtggatcacctgaggtcaggagtttgagaccagcctggccaacatggtgaaaccacagctctactaaaaatacaaaaaaattggctgggcatggtggcacacgcctgtaatccccagctactcaggaggctgaggcaggagaactgcttgaactcgggaggcggaggttgcagtgacccgagatcatgccactgcactccagccagcctgggcaacaagaccaaaactccgtctaaggctgggcgctgtggctcacacctgtaatcccagcactttgggaggctgaggcgggtagatcacgaggtcagg

SEQ ID NO: 4707 - DNA, 1045 bp, Homo sapiens
gtccaaggcaggagggccatcctggtcagctgagagatctgggtgttcacacccaccttagagagcagatgctcactagtctctgcagggctgcagtaagatggtggcatcccagggctcagcaggaatggactggggttgggggcagctggagttaggtgcagatgggctgggcagtggggctttctctctactgacacagactccctccctatcctttgaatcagtggtaagctccttgataagaggtctcttgtcttgcttaccactatatccccagctacgatctggcacatagtagatgctcagtgaatgtctgctgaacaaatcaatgaagatacccaaccttcatagaatcttggcaatagaatcccagaggtagacttgtgtatggattggcatgtcaattggacgtgatggttgcggggaggggtgcgtggattgcactatcaagcagcagaagaagtttagggagcccccctgaaatttggagaagagaagggaggtttatgcaaagtgagggctctggtactaggtcataaggcagctcttctcgggtgcccagaaagccaggcctgcctgtgcttgttggagtaaggagttccatctgctgtgggtaggagagttgtgctgccaggaagatctcacctagcaatgattgccctgctggaggcccaggctaaggaagaggctgccctgccaaggaggccgggcttggagctgtgcaactctagacctgtttcttcacacttatgagcaagtaagattagggggcttgccaaggcccctcctagctcccagagttccacagcccccacaaaagcctaagggtagatccactaggatggccaaggaggtctcagccccatccctacctccaagtctcatttgttgtcctttgggctctgtttgctcagtttggctctggcgtcccacctggccagcccttcttccctacagcaggagatcacagcatctggccttttgtggctacaacatgctgcctgtggcctggctcagtggaaccaaaaaccacatcctccat

SEQ ID NO: 4708 - DNA, 2053 bp, Homo sapiens
tgggagtggaggttgcagtgagctgagatcacgccactgcactccagcctgagtgacagaatgagactctgtctcaacaaacgaaaacaaaaaaaggacaaatcgtgtgtgactgcactcacacgaggaactccacacaatgaggtccaggaagaaaaacctgaacagtgtttttcagggactggggagggacatgaagggtcactgtgtgatgggagagcttcagttttaagatgaaaagggctctggagatggaagtgatagctgcacaacagcatgaatgtgtgtaacaccactgacctgtactcctgcaacagcgtgaatgtaacaccaccgacctgcatgcctgcaacagcatgaatgtgcaacaccaccgacctgcacgcctgcaacagcatgaatgtgtaacactaccgacctgcatgcctgcaacagcatgaatgtgtgtaacaccactgacctgcacgcctgcaagtgtgaatgtgtgtaacaccaccgacctgcaagcctgcaacagtgtgaatgtgtgtaacaccaacctgcacacctgcaacagtgtgaatgtaacaccaccgacctgcacgcctgcaacagcatgtgtgtaacaccacggacctgcacgcctgcaacagtgtgaatgtgtgtaacaccaccgacctgcacgcctgcaagtgtgaatgtgtgtaacaccgacctgcacgcctgcaacagcatgaatgtgtgtaacaccaccgacccgcacgcctgcaagtgtgaatgtgtgtaacaccaacctgcacgcctgcaacagcgtgaatgtaacaccaccggcctgcacgcctgcaatagcgtgaatgtgtgtaccactgacctgcacgcctgcaacagcgttgtgtgtaacaccaccgacctgcatgcctgcaccagcgtgaatgtaacaccaccgacctgcacgcctgcaacagcatgaatgtaacaccactgacctgcacgtctgcaacagcgtgaaaatgtgtaacaccaccgacctgcacgcctgcaacagcatgaatgtaccaccgacctgcacgcctgcaacagcatgtgtgtaacaccgacctgcacgcctgcaacaccatgaatgtgtgtaacaccaccgacctgcacgcctgcaacagtgtgaatgtaccaccgacctgcacgcctgcaaaagcgtgaatgtgtgtaacaccaccgacctgcatgcctgcaacagcgtgaatgtgtgtaacaccactgacctgcacgcctgcaacagcatgaatgtaacaccaccgacctgcacgcctgcaacagtgtgaatgtgtgtaacaccaccgacctgcacgcctgcaacagcgtgtaacaccaccgacctgtactcctgcaacagcaggaatgtgtgtaacagcaccgacctgcacgcctgcaacagcgtgaatgtaacaccaccgacctgcacgcctgcaacagcatgtaacaccaccgacctgtactcctgcaacagcatgtgtgtaacagcaccaacctgcacgcctgcaacagcatgaatgtgtgtaacaccaccgacctgtactcctgcaacagcatgtgtgtaacaccactgacctgtacgcctgcaacagcccaaatgtgtgtaacaccaccgacctgcacgcctgcaacagtgtgaatgtgtgtaacaccaccgacctgcacgcctgcaacagcgtgaatgtaacaccaccgaccacgcctggaaatggttaaggtggtgcgttttgtgtgttttatcacagtaaaaaacctgaaaacacacatgcacatacacacacacacacagtacctgctgtgatgagcaaaaggtagctccaggggaggcgcatccagccagaaagcctgcccccttacctgaaacttcttatcccctgtgagacgggagagctcccggaactccagctgaatgctggtcacctcggccacagtgctgtcggaggtccaccgtggcgggtgggcaactccagtaccgatgttcacatccgagtaaggaatcttggatggtgttctgaaggcaggcattagccgatttccaaaatcc

SEQ ID NO: 4709 - DNA, 2964 bp, Homo sapiens
agaactattttacgtgtttctaagttgttggctacatcaaagagatcatctgtattctgcatatgggctggctttggtgaagctgatgactggacttctaagaaccgttttcccaaatgggttcccatattcatgcacccaaagcaatggtccccaagcactgatgaaaactaatatgcatttcccaaagacccacactatgtatcaggagcctgcaccatgccatttgaatgaccctcagcaatgtgcctccctgccctcaaattcccagttgataacagtgtttgattaaatttccactcaagccaaacatggttactaagaagagaaaaacctgatgtttgcataatattttttttcccctcgagatggagtcttgctctgttgcccaggctggagtgcagtggcatgatctcagccactgcaacctctgcctcccgggttcaagcgattcttctgcctcagcctcccaagtagttgggattacagacatgtgccaccacgcctggctaatttttgtatttttagtagagacagggtttcaccatgttgaccacactggtcttgaacttctaaccatgtgatctgcctgcctcggcctcccaaagtgctgggattacaggcttgagccaccacgcccagcctaagattttatgattaaaaaaaattcaagctcaatacccacataaattataacgtttctcaggaagtagtcccttaaccaaaacgtctctgagaagtgatgcttaggtaatctctgggatccgattttcccacatgtctcactccacagtatgctaaagaagaaaaagtgagtgggcacaacactttgaccctctggctaagccctgggagtccctgacaggtccagaaacttctctgacacccattcaccagggtgctgagataggagaaagtgctcatttataatgtgtattctgtgcagctgttctcagacaagaccggatcttgtcatcttaccttttgctttacaaaaaaggcctgttgaagtcaatgctgtcttgccccttgctgtttcagcaggttagactttggtcttcactgcttatagctgcattggaggccaacgtagctgatgctcagggtcaggcctcgccccttcgccgcaggtctcaggatcggggataacatcgctcccaccctgctcatttagagatgggaaacaagcaagagcttgacttgcctcccatccctcagcctgtctgtggcagagcctgcaccaaaacccagagcttcttccctccgtgagggccacgctgtcaccacagtcctcccagatgggttttggattagcatcagtcctgtgtcaccaagtgccaaacagctgaggggtagaagtgggactcctttcccgagccccagcatgaggctgtggtgtcaggtttaggcctctctcaagtcagaaaaccccgggctgagacctccacagacaagggctccccatgctggccattggcaggggcccaagaagttcagtgaccaactggtccttccacaccacaccagctggtgctgcccatgtctgtcgaatcataacggaaaattccccagatcacgtttggatttaaaaactcatcccttgtcgtgcttcaatgcatgccatttgtcacttaccatacttcaccatggccgagcttcatgtcacatggcctggcgattgtgcttgttcacactggggccaggattttcatactaaaacgtcactgacaatggggctacttttctcctgaatagctcctctgggcttgttgcagttctagttttcccagtagttccatggcaggttcaacctctcagtgtcctgaaaaatggaaccacccactaaccatatgcactggctgcccaggtggctgcactccggggatcacgtttcagtactgagttccttcacgcacttggttcaccaccatcactcttgagttttggacaaaagaggtgggtatgccaggcacagtggctcacgcctgtgatcccagcactttgggaggccgaggcgggcggatcacctgaggtcgggagttcgaaaccagcctgaccaacatggagaaaccctgtctctactaaaaatataaaattagccgggtgtggtggcgcatgcctgtaatcccagctactcgggaggctgaggcaggagaatctcttgaacccaggaggcaaaagttgcaatgagctgagatcgtgccatttgcactccagcctgggcaacaagagcgaaattccatctcaaaaaaaaaaggtgggtaaagggccatgagcccaaaccactaggttgttcaccttttcatctgaaaatgctttactctgactatgtgctattgggttttatttccagaaaatatagttctccttttttctgcatgaaggatacatcgtggtgccacatgctttaagcaatttaaacaagagagataagaggaaaatgcaaccaccacatctgacttgcccaatgtagactttcctttattagattgaagtacacaacctaatatgatatattattttgtagtatctcagactttgtaaataaatgccattatttttatatggaaattttatagaagagctatttctgtatacgtaattactcctgattttctgaaattgcttctggtagataacagacaagtcctaagcagtgttccactaagggtggttccaggcctgcctgccgtggagttgactgggggaattttacagttttgcgatcctaggatgcgtcccagacgctcagtcagaagtgctggaggtggggcctgggaagctgtatttgtaatgaactctggtgttttttgtccattaaagtgtatctttgtccatcctataagattaaaggaaagaaaaagcatctcaaatgagtgtaagttgttcttgagaaaaaaatgtatcagacttttatgatttgaatgaaatgtattatagaaaaaaataaacactttaaaataa

SEQ ID NO: 4710 - DNA, 603 bp, Homo sapiens
agatcattgacttctgccccaagcctacctgggggcaggggaacatcatccccattttacagaagaggcctttgaagcacagagattaactgacgtacttagggttttgcagctcactagaggcagagccaagactccaccccaggtggccaggctcctgagcgctatgcctacctcaccctccaatgaggtggtggtggaggagaccgtgagccgctgtcacctgaacactggtgcactcagtctgctgctctgaggacgccgccccctctctttctctgtgtaaaggcttgatctcgacccctaaagcctgaagcttctccctgtggccacctccccaccgcatcatcttccgttctcagcgggtagatccctgcccaggggggaccccctggggaaggctgggagcatgacctcttcccaagggtacggcatctaaaagggatctccggaacattgaaaagccatgaaggccgggcacagcggctcacgcctgtaatcccagcactttgggaggctgagggaggaggatcgcttaaggccaggagttcaagaccagtctggacaacatagcaagacccggtctctttctataaatgaaaa

SEQ ID NO: 4711 - DNA, 1674 bp, Homo sapiens
tgttttctgtataaaaatgtccatcagatgaaggtcaaaggggttgggggcagatgcttatgcgggaatagcgaggtggcagccccagcagcctttcagccctctctcgtgcaggccttgctcggagtcccaggagatccacaggtccggcatgaacagtgagaggtcagaggtggaaggctcagcaggagaggagaggaggatcagcagaggtcatgagaaggccagaatccagggtcaggctgtctggaacaggaagtaaaatgggccgagatggagcgagcccccagtgtgcttccaaggccactcccacctccctgaaacaccctgctacgtactgatccaatgccctgcgctgtgtatgagagcaccttctcttctgaaacccctatacaagggaggggcccctgcggagaccgtgccctgccatccagtcctcaaggggattctaaaaaactagtgacaaagtagggaagcagctgagctggaaaggagttctgaggacgatggaaccttgggtaaggaggaagaaggctgcccacccgcccttttctggcagccaccctccctcacactgtccgttccttgatgacacagctgatgtgattaagatcgtccccaaatcgcttcacagcagccctcagcatctctatttccgtctccgtccacttcgcactgtcagaaggggagaggggggatagcaaaaatgggagggggggtgtggagcccgcccacaggctatgcatcccacagccaaccagccgcctccttccgatttctgggaccccttccacggatgcataaagaggtcctccgtaaggggaggcggaaagctcttgaggccctgcgggaaccgggaggaccccaatcacaagaaatcacaaccacctccaccttagacacccctttccaccatcaacgttaaacggctgctgtacacagcacactgaaaccaactcgccaggaagggcttttcaaaacagacccaccaacacagcctgcagccgtctgggggaattccatgaactggggtggttgggagtggcggtggtttgtggtcgacccgttcgcagcagggagaactgtgaaacaggagtctgggctatgggcctgtctgtatttttatctgtcattcattccctcacccaacgatcatttattaacaccgactctgtgctgtgccacgcacaaagggaaactaatgtctgtccctgtgctagagagggtccgtgtctgtgaccgagtccaagcgcccgctctcagcgtccacgtcccagtccgggctcacgtaccccgcaggagaagagtcggccacgggatgcagctgcatcgtcagctccccgagcttcgtgaaggcggcgccggccgccgagaagatctctccgacctgggggcggggcagcgtcacggggggccggcgcccgccctccccgtcccgcccggagcccctagccccaccccaggctcggctcccgcccgccccccgcccggggcggaagagccgcgagccaagtggggggcccgccctcccgtggccgccagggagcgctgtccgcgagggaggtcgaacctttgtggacgctgacgtcatggccccgcgcgcctcctcacggagacgccgccgccgccgctacacgcgagccgggaccacggagagcagggagactgagcggc

SEQ ID NO: 4712 - DNA, 1690 bp, Homo sapiens
tttccccactggatggtctggcaccattgtcaagaatggtttgactagctaatgcttttttgcaggtttttgttgaaatgtggcttcatcactattcgttggagatgtatcaaaaaatgcagtcccctcatgccaagctggaggttctgcactaccgactcagtgtctccagcgccctctacagccccgcccaacccagcctccaggccctccacgcctaccaagtactggctcattcgttcccttccccctgcccagagtgcatgtccatgcctggcaaagcaaggggccgccggggccggctgctggtgactcagaggctagttccaagcagagcgtagcccctgtgtcggggggaggcaggggtcagcctccagcctggcttggcccctggctttgtagactagtttggttgggggtgggggtggtggctttgtggcagaacgaggcatgtgggcatgtggccctggctgtccaggttcccggccagtggaggtgtcacaagctctccagtgttggaggccccgtgcttggccctggtttgaagagctggagtcctcaggcctcagcagtggctgggttcactgcactctgcagggtctggcgcttaggaaggagctgaagacgcagaggcctgggacttacgggtggtgtgggttctgccttgttcagaactgtcacccagcctggaggtgctgtgacccagagcctgcgtgtgaggcaggggggtgggaaggacctggggcttgaccctatagcccacagaagctgtcagtccttgacagcccagccagcacccggccttcatccggggagccctggccactcatatacacctccagaggcagattagagtgggtggtgacctcatagaggttgcagctgcctaggcagaaatgacaagtgtgtggatggatttgaggtcagtgaagcagagttcagacctgtagggaacttcagggatgacagaggaatctgtgagagccgggggagacgggctgtgctcacagccagtgatctgtcccgttcacctgggaaggagcacacatgattgaacaggaatttgagcacaagatgagaaaatgtgttggccccttagcgctggtgggctggatggcggccacagcacacgggggcacctcattccgcaggagccactgcagaggagaggaggaacctgagggcttgtgccagggagggaggacagtgtccagaaagcatctggcaaaccccatggtgggaaggtgaccagcgagacccaggtggggtgagctgaggtgctgtgagtctcagcccagtgggaaatgtgcggctttggggacacatccttaagaagcaagcaggtgactgtgaccagggactccatgtgggaacatggcccaggaggggtgcagagctgagggagaagtttggctcagcaaacctatgggaaaatagcctgagagggttccatgtgactgccgggggcaggggtggacagtgggccctccagacccttcagaaggaccaggtggtgtggggcaagtgcaccagcagggaaaggcagttttccagttcccatgtggaggtcttcccctcccctgagctgcagggaggatgttacggctcagaatcccaggccaggattggagggagggcctgggctgagactggaagaggagaaagatcctggtctaacttcccaccccac

SEQ ID NO: 4713 - DNA, 3596 bp, Homo sapiens
gcagttcctcacctaccttctctgctcaccgctgtgtgctagcaatcggaggacccttggcacacggagcgacaggggcctcccccacagacacctcattttgggaaagaagatctaaaaaataattagaagtagtatattattccattctcacactgctataaagaactacctgaaactgggtcatctttgaagaaaagagtcttaattgacccacagttccacaggctgtacaggaggcatggctggggaggcctcaggaaacttacaatcatggcagaaggtgacagggatgccagcacgtcttcacatggtggcaggtgagagacagaacgaaggcggaggtgctacacacttttaaaagaagcaggtctcatgagaattccatcacaagacagcactagaaggatggtgctaaaccactagaaaccacccttatgattcacctttcaccaggccccacctccaacactcagtatcacaattcaacatgagatttgggtaagtacacagaaccaaaccatatcattttgcacctggcctttaccaaatgtcatgtccttttcacgtttcaaaaaacaattatgccttcccaagaatcctccaaattcttaactcgttccagaattaactcaaaagtcccagtccaaagtctcatctgagacaaggcaagtactactcctctgcctatgagcctgtaaaataaagaaacaagttagttagttccaagatacagtgcaggtacaggcatcgagtaaatgctcccattccaaaagggagaaattggccaaaacaaaggggctataggcctcttgcaagcaaaacccaggaaggcagtcatttaatctccaagctccaaaatactctcctttgactccatgtctcacatccaaggcacactgatgcaaggggtgggctcccaaggccttgggcagctctgcctctgtggctttgcagggtacaacccccaaagctactttcatgggctgggattgagtgcctgcagctttttcaggcgaacagtgcatgctgtcagtggatctatcatcctggggtctggaagatggtggctctcttctcacagctccattaggcagtgccccagtgggaacttggtgggagctccaaccccacatttcaccttcacactgcccttgtagaggttcttcatgagggatccagtcctgcagcagacttctgcctggacatccgggtgtttccatacatcctctgaaatctaggcagaggctcccaagtctcaactcttgccctttgcatacccacaggcccaacaccatagggaagccatcaagacttggggcttacaccctctgaagcaatgacctgagctgtactgtggccccttttagccatggctgaaacgggagcagctgggatgcagggcaccatgtcccaaggctgcacagagcagtaaggccctggacctggcccacgaaaccatttctccctcctaggcctctgggcctgtaataggaagggctgctatgaaggtctctgaaatgtcttagagggattttccccattgtcttggctattaatatttggctcctttttacttatgtaaatttctgcagctggcttgaattacttcccagaaaataggtttttcttttctactacatggcaggttgaaaattttccaagcttttatactctgctttccttttaaatataagttccaatatcaaaccacctcttcggaaatgcatatgagcatatgctgttagaagcagccaggtcacttcttgaatgctttgctgctttgaaatttcttccaccagatactctaaataatctctctcaagttcaaagtttcacagatccctagagcaggggcacaatgccaccagtctctttgctgaagcatagcaagaatgacctttactccagttcccaataagttcctcatctccctctaagacctccttggcctggacttcattgtccatatctcactatcagtattttggtcaaagccattcaacaagtctctaggaagttccaaactttcccttatcttcttgtcttcttctgagccttccaaactgttccaacctctgcccatccaaagctgcttccacattttcaggtatcttttgtagcaatgccccacttctctgataccaatttcctatattagtccattctcacactgctataaagaactatctgagactgggtaatctatgaagaaaagaggtttaattgactcacaattctgcaggctgtacaggaggcatggctggggaggcctcagaaaacttacaatcatggcagaaggtgaaggggaagccagcacatcttcatatgatggcaggaactttatatgttatagaagttagccccaagaatgaaatcgtgtcctttgccaaaacatggatggagctagaggcctttatcctaagtgagttaacgcaggaacagaaagccaaatagtgcatgttctcactgataagtgggagctaaactatgggttcacaaaggcatgcagagtggtactgtggacattggagactcagaatgggggaggctaggagggaggtaagggatgaaaaagtacctgttgggtacaatgtacactacttgggtgacgatgggtccactaaaatcccagatttaaccactgtacaattcatccatgtaaccaaaacccacctgtaccccaatgctatgaaaataaataaaaccaaattagctctgtttctgttagatgagatgcaaatattttcccaagtttgtcctttgtcttttgactttgtttatggtgtttcactcatgcagatgttttttattttcatgtttttaacttgtcattattttctttcatgtcttctggattttaagtcatgttatcaaggctttcccactctgatattataaatgaatttttcctcatttctcttagaactttgattctttcacttcccacatttaaccttccacgtatccagaatttcccctagcataagttgatacggtcccaatgtttcttttttttttttcccaaatggccactcatttataccaacaccatttattgaatcgtctatagtccccactgatttgaaatgccagctttacataccaaagtcctgtatgcatttgcctctgttctgtttggtaggtctattcaagctccagttcccaaaagtgttgagtgtcgcttaaaatctagaagggctggtttctagttttccataattgctcctcttttctagtgtcctctgtcctattagggcttattgatttttaaatatgatttgtggattcagttttctttagttctagtgagcaacaaaaacaaccaagaaaaaaataaaaaaaaccctccctgttttcctttctttctttctttttttaatcaagatcaccttaagtttaaaaattaacgtaggataacttgacatattttatgatttttatgttactctccaaaaatataataagtggttctatttattcaactctactcctttgtcctgcaggaacattttgtttccttatcaagtctgatattgtcttttggtctgagatagacatatttaaaaaaattgtgttcattgatttctatctta

SEQ ID NO: 4714 - DNA, 2825 bp, Homo sapiens
gaacaagaacatcaatctttgaaatgatgccaagtataagcctctgtgtgtgtgtctccccactccaatttgtccaacagactgcttccaaagaaatcttcctaaaacactgaccatcttttttttttttttttttggctgcaaaatctttcatttcctcatcccctcacataacttccaatcttcttggcctggcactaaggacctactacagactggcactgaaatatcttccctaccttatcattccttgtgcttctccacaagcccactcttccccttcatcatacatgtgccgacctttcctgtctcttttactttgcagcaccaaatgctttctactttgtggtctaggaggaacacatgtcacttttgtaagctgctcgaaagcaggggccacaccttcatccttgttttccacacaacaccaagcacttagtagacacccaataaatcattgctgaatgaatgtattcagcctggaattgcactaggattttttggccaacacattgtattcttaactgataccagacttccaatcaaataaaatccttaagcctttttcatagtctttaattaaactacttctcttccattatttccctttgcctacttttgaactgatattcagaacttttctgttaatgtttaattttcatccattattcttgtctgtacagatctttttgatttttgactctcttatctagttttttttttttttttttggcttcccgttgtgttatccacaggcacaatgggtatattgactatcgttcattgaagttgttgatacaaatgttgaacaggagaaaaaccagtagcttgccaacttggcacctcattctctagcttgacagtaatctcttatctagtagtttttagatatggttatttaatcaaatatcactagcttctaattttgttataattcattcatgtatacagacaatgaagaatcatctttcttcattcaacacatttattgggaaccaatcattgtccaaggcaatatgctaggcattgtgtaatagaaagcgattaagcttttacccctgtcctctttggcctgcaaagagcaggtaagattcatgcacagacaaatgtagtaccaggtaaatagtgaggccaaacacaagaggcaggtcaaagggctttggattcagaggatggagaagctctttctaggctggtgaaatatttgcagaatgagtaggctcataagtggaggtgaggtacaggctaagctgctgtaagaaagagtccaaaatgcaaaggatttaccacaatgcagttaatttttctcacaacggtcgaggtaggcaggtggtccaagtccagttaatcagccctcctcaacacaaggcttccccttgtaagctcaggatgaccgctccagttctcatcatctcccaggcagaaaaacgggagaaagagaactagacgtaccacccagtcattttaaggacatagccaggccaggtgcagtgactcacatctgtaatccaagcactttgggaggtcgaggctggaggatagcttgaagccaggagtttgagaccagcttggataagaaagcaagaccttgtctctacaaaaaatttaaaaattaaccatgtgtggtggtgtgcacctatagtcccagctactcaggaggctgaggtggaaggatcacttgagcacaggagttggaggatacagtgagccatgatcacaccacctcactccagcctgggcaacatagtgagaccccatctctttaaaaaacaaaacaaaaaaacatcaccaggaagttgcttacatgtcttctattcctataacatcggcctgagcttagtcacatggccacacccagcagaaagaactctaggaaatatggtcttatgctaggtaaccccaaacccagctaaaactgttgcttttgaagaagggtgaaacagacaatgtggaggagaattaccagtctgccacaaagagaaagaattctatgtgaggaaaacgctctagaagagggagctgattaattagttatatctcagccgagaggatgttatgagaaacacagatttgggtttaatagaaaaacttagaacccttcaagaaggaatgggcggacttgagagtgtcctccgcttctgaaaatgatcaagaaaaatggtaagaatgtacacctcaagggtggatggtaaaggtcagcctttaagcctcaatggcggtgtggttgtaggtggggtgggggtggaggccccgaagacaggcagactaccacagtagccccgatggaagcagtgagaatgaactggaaggagcggctgtgggagcgacaacgtgatgagaataaacccggcttggctctgccctgtgcacacacaggtgagctgtgtgctcccggatgtgtcagctggtatatgcgtctgtcagaaggcagctggggagcactgttagctcagagactaagaggcagacccaggaagcccttctttgcattggtcagggtttgctgcattttcccaagcccaggaaatggaacccagttcttcttctttctgtgtaaaataataagcatcacaataggctgtgctcatgagaacgcattttgtttccacagaaatgttttttctcactctgtcctgattttgatttctgttaaactcagtaaacacattaccaaattttaaaataaggtgacttgttttccccaactcacagttcaccaaaggtatttcatctgtttgttctgaaaatgcagctgctgtctagatttatgtgtgctctgacaagaaatgttttgtgtaacaataaaaatcatttcctttgatgaa

SEQ ID NO: 4715 - DNA, 866 bp, Homo sapiens
cacatcctccaagatcctagaatggctaaaatctgtaaagtgctgagagtcttcagagagttaaataagaatccagagaaacaaggttaacgttctgaggacctcgttatttgccaagaacaagcacaggggtgtcacctcctccgtgcagccttcagtaaccccaccacccaccaggaacagtaggagctcctgtactctcattagattcttgtacctacttgtcacattgtaacatgactgcctgtttgagtgcctgtctccctagatgatcttttggggcagggaccatgcctcattcatctttgtatctccagcacccagacggtaaccagcaccaaagaggtatttaataaacacagaatggacagataaataatgcctcgtggttgtcaagatgcctaactctaccaaatcctcttctttgtctgaaagttgatatttcagcttgaaagaattgtgtataaaaacagagtacgtcaacccacactgatagcctagaggactctcctaggactttagcgcagaagctttatgcctcagcttttatgcttttaatgactcagaaaccccttctgttgatttgttggatcttggtcaccactccagtggagttgagatctgagtatgaaccccagcttgggaattcactttgggttttgccagctgctttctatcaccggctacctggagtccacaagggtcaacctgagccctcatccaagaacagaaccaatcccagcctgacagccatgagtgggggagagaggagcagtggcccaccagccccatcagcctcccgagtctccctggtgacatttattgaccctggccctcaacagtcctctgcccgcctgctcagttat

SEQ ID NO: 4716 - DNA, 703 bp, Homo sapiens
gtgaacatgacagcatcacagtggaaagaccaattctgtagcggagaagtccaagtggccttaccaagactcgaagagatgacgacctcacatgcctgttgatctcatccacccactggtgacagatggaacttggagagatgatcagagttgctcttgttgacactggttccattgcaacaaggcagtgggggcagtaaaaaggcttgatcttcagatttttctcatcataattcacacactttgcatgttgccacaggtgacacttcaggcattgaacacgaggcttacgatctatctgatcaagttcaccacatatacactcaaagcggtaatcagaggtgttaaagggactcatggtattagaaggtggtacatcactatcagcatgatttagagattcagcacagtcctctgtttcatgttcttggttgaattcagagatacatgtacttttagacatagcaacatcagttattccagagtcgctagtagctggacagtgaccttgtgaatcgggattgataaatggttgactttttcctttttttgtggatggaacaagctttttcctcaatttactgcgatttctcctggacttataataataatagtaaggatcatcatcatcatcagaggtgtctgatggcaagtattcagaatctgtgtccttgttccctgattttctagtttctttctgaat

SEQ ID NO: 4717 - DNA, 421 bp, Homo sapiens
ctgggtcggaacggagccatcgccgctggagtattcggggcccttttcatcgggtactgcatctacttcgaccgcaaaagactgaagtgaccccaacttaaagaataggcgtccagaataaagaaagaaacagaagctggccgaggagtgagttgagctttccaagttagctgaccttaaagatgctgaagctgtccagaaattcttcctggaagagatatagctttggtgaagagatcctagctaaaggtgtagaccacctgacaaatccaagtgctgtgtgtggacagccacagtggttactgcaagtgttacaacaaactcttccactaccagtgatccagatgcttctgacaaagcccctaccagttaatcagagacttgtaagtgctggcgcttggccaaagacgatgtggaatga

SEQ ID NO: 4718 - DNA, 3221 bp, Homo sapiens
atacaatggaatactcctcagccataaaaaggagtgaattaatggcattcgcagtgacctggataagattggagactattattctaagtgaaagaactcaggaatggaaaaccaaacatcgctatgttctcactcataagtgggagctaagctatgaggatgcaaaggcataagaatgacacaatgaactttggggactcagggagaaagggtgggaaggggatgaggaataaaagacaaaaattgggtgcagtgtatactgctcaggtgatgggtgtaccaaaatctcacaaatcaccactaaagaagttaaccaacaccacctgttccccagtaacctatggaaagaaagaaatgtctcatatgtttctgcctaaattggtctttaatactttagcgattctcttgagtttggactataaaatagttttggtctttttgtattttctgctgtaagcctgtatgattatgtaatggtgagtaaaattgctaggccagatacgcagttctaggaagttattcaaagatgtgctttagtatattattttctacctttttaaattcattttgagcttggcttttgagcctctattttccaaggtgaggtgtatgtttttataatgttatgcttagcccttgtgtattttcatctctgagtttgaaatttggggttatattggcaaagggaggtttgggttttaattaggtgacctgttacaggaaatgttaagcttctgtttctttggggtagacagtgagagatttatcaagataaagaagaaaaataaatcctaaagttaatattcaatacatgatgatgtcacccttactaaagccaaagagggcattatcctatcattctcatcgctaagaactcttctcctcttggcacatgcttattcagttaaagataagccaagcctttcttttgtattttttttttaagagaaaaaatttacttcggttttgagttttattcctggctctgggtagcttatttttttgacccttattttccccaatttataaaatgaaatagttatcttcactccccaggattgttgtgaagagtaagtcaaaagataaaatgaggtgactcaggcaaaagtacctggccctgtgtagtgagtacattgtatgtgttacatatattcttattgctgagaatccacgaaagaatgaattaaataatgaggaccctttcatcagggtttttgagtgagttttttaaaatacaaggtagtagtttgtgtaaatactaaatccattggtacctgtgcagaatgtaggaaatggagttgctaattccaaaaaaaacagcacatatgctgaggaaagtataatacctaatatatatggtttaagcaatgtaaaattccatgaatatgttccttttcatcttaaaatttgtgatttaaaaaacattgatattactataaagaattattattatttcccttgatttacagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgcgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtacacaaagtttttggtaaattaagaatattatttcaaataaattaatttcatccccataggagccagtttatcagataattcgtttctcatttctgcaaatcagtacacaatgagctcatattcagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaaacaatacacagaaaccttttttgaaaattaaaaacattaagaaacttcttgtaattcacaaataattgaaattaagtaattttctcagcttaagagtttgtattttttaagtgaatatcagtaattaatccattaacattgatgctctatttctgcttttaagtttgaactgaggctgatcaatgttcagtcaattctcctttgagcagggattggtgtcaatcaaagacaaatcacaacaagtgattgtccagggtgtccatgagctctatgatctggaggagactccagtgagctggaaggatgacactgagagaacaaattgattggtcctcattggtaagtctcaaaggattcacagttttaaaacaaagtgaaaaatatatttgaaagggatatcatgtgccacttaaacagattaaccattcaggtcctcttttaaaactaaataagcttgtggtcaatgtttcatctttatcatgttacaacgttcgtaaaagcttgttaggacttttgttcttcttcagttttagaaaagtggttaatccaaggaccaatgtgactttgatgtactgacctggaaagttaaagatggaatcactcaattgctattctttttgtaaatttctaaacaccataaagcatttaatgaactggaattgataggtgaactgtgtcattttaataagcataatgtaatc

SEQ ID NO: 4719 - DNA, 2648 bp, Homo sapiens
gccggggtgcagcgcgcccttggcggcccccaggcgccccaggctcacgtagccgtactcggccggcttcttgcagttcttgcccccgtagtcgtcggagaagaggtcggagaggaagtcgtggtgctgcccggaggaggcgggcgcgggggcgggcgcgggcggagccgcctcgaaggtgtccgtggccgtggcgggcgccggggcctgcggcgcgcccagcggctccaggtccccggctttagaaagaagacttgacgcctgtgacgactcccctcttaagccacagacaatatgaggaccccgggggtcggcgcgaccgggcaggatcgcgccccgcttggggctggaccctggtccacggagccccgcccctagccccgcccaccacacctgccgcctgctcgaggcttggacacgcccgggtcttctcttgccccgcgctgcgccacccgacctgggccctgggatggggcaggggcggggggtgctcggccctgccacactgtgtgaccttgggaagatgcttttgctgctgccatttcacagacgggaaagcgacaacggcccgcctggacttgaacacaggcccaaggccttctgaccacttgcccgcctctgctggtcttgctgtctgtccccacggccttcactactgtgtccctggtgcctagaacagagcctggtacatagaaggtgctcgatgaatgcttttccctatcccattttcaagaggagaaaactgaggcgatttgccaaggggagatccacgtggctgctttgacagagagtgttctgcaaaagggcttagaaatcagccagcaggtggcaggttctgggactgcaggagccattcacatgcgtgaagatccgctgggcgcccttgctctgggatcaggaaaggccggtgccatggatgtgatagatgcacacagggcatcagcaggccgccgagaggaaccagagtgtccaacgaacagaaaacagtgctcaaccttcacatttatcgaatgttccttggcacatgctgtaattctggccctaaagacacattcatggacaagacaagcaattcctgttctcgtggagctgaaattctcctgggggaagacaagcactaaacaagatcaatgattaaagtatagattgtattagattctggtcagcactatggaggaaaatacagcaggggagcagagcaggagttctgggagatttgattttttgttttctggggttttttgtttgtttgttttttgagacagggtctcactgctggagtgcagtggcacgatctctgctcactgcagcctctgcttcttgggctcaggtgatcctcccacctcaacctcccaagtagctgggaccacaggggcatgccaccacacccagctgattttttaatgttttgtagagatcaggtctcattatattgcccaagctgggggagttgattttaactttatgttagagtagtcagggaagacctcactgaggtgacatttaagcaaaaacctgaatgtggtgaagcaggtatctgggggaccttggaccacacaaagggaacagcaagtgcaaaggccctgaggtaggagcacgtagttgtggtgatgacggagagtagcaggaatttgtgtcatagaaatagtgggggctggccaggcacagcggctcatgcctgcaatcctagcactttgggaggccgaggtgggtggattacttgaggtcaggagtctgagaccagcctggccaacatggtgaaaccccatctctactaaaaattaaaaaaaaaaaaatggccaggcatggtggcgtgcatctgtaatcccagctattcaggaggctgagacatgagaatcacttgaacccgggaggcggaggttgcagtgagccgaaattgtgcctctgcactccaacctgggtgacaaagcaagactctgcctccaaaaaaaaaaaaatggaacatggaaacatggaatgggagaaaatatttgcaaatcatatatctgataaggggttcatatccagaatacataaagaactgttacaactcaacagcaataaaaacaactcaattaaaaatgggcaaaggacttgaataaacatttctccagagaaaactgtgaatggctaataatcacatgataagatactcaacatcactaaccattaaggaaatacaaaccaaaactgcaatgaggcgcaacactttggtggatcacctgaggtcaagagttggagaccagcctggccgacacggtgaaaccccgtctctactaaaaatacaaaaattagctgggcgtgatggtacgtgcgtatagtcccagctacttgggaggctgaggcaggagaatcacttgaacctgggaggtggaggttgcagcaagccaagatcacgccactgcaccccagcctgggcaactgagtgagactccatctaaaaaacaaacaaaacgcaatgagaagagaggattttgaatgttcccgacacaaagaaatgataaacgcttgaggtaatggatatcctaattacccagatttgattattacacgttgtatacatgtattgaaatatcattttgtaacccatgaacatgtacaattatgtgtcaactaaaaataaaaggaataaaacacaatgagatacc

SEQ ID NO: 4720 - DNA, 567 bp, Homo sapiens
gtcaagtatttaattaattattttttgagacagggccttgatctgtcacgcaggctggagtgcagtggcgcaatcatggctcattgcagtcttgaacttctgggctgaagcgatcctttcacctcagcctcccgggtaactgggactataggcacgtaccactctacctggctaattttttgatttttggtagagacggggtctccctaagttgcccaggcttgtcttgaactcctgggctcaagcgatcctcctgcctcagcctcccaaagtgctgggattacaggtgtgagctactgcgcctgatctgttaatttattttttgagacagggccttgatctgtcacccaggctggagtgcggtggcacgatcacggctcattgcagtcttgaacttctgggctgaagcgatcctttcacctctgcctcccgggtagctgggactacaggcacgcaccactatacctggctaatttttttatttttggtagagacgggggtctccctaagttgcccaggctggtcttgaactcctgggctcaagcgatcctcccaccttggcctccc

SEQ ID NO: 4721 - DNA, 3698 bp, Homo sapiens
gtattgtaccactaatataaacagctaaaaaatggggaaattgtaatgttacgcctgtgcaatttttaagtggcatattatggcagattaaaatttagatacttggcttttcttgggcaagccactaagttgtggcggaatgttttctggtgttcttggactgcaattatgcactattaaagtagtggcctgctacataactgcatttagccagcatttctgcagtgcgtaactgtgaggaacgtagtaccgcaaatggcaatggacattaggacccggatgtagtattcctgcttgctccaagattctcattgccgactgcatacaggtaggtaacaagcaatataatctaacttggtgacttgtatgtacttttattccgtgggcattctggcatcacatttctgacaatgaaattacagtgcagcacctaacacttgtatggtaaagctagcttacatcaaaactgtgtgggtgtggggttagagctgtaatttgtcaggcagaattcagtgctgttgcagttctcagataaaaagtgcaaacttgattctttggtatatctgactcagttgtgtggtttcctttagttgcattgtaactgaagataacatggaacacatcagtggtgtgggggagagggaactaaactatacttgggaactagggtgcttttagcaccttgacatggaccgtatagcatgtgataattagtctctattgtagcaaactgacctgcccatagatcggcaatatcagtaatttcattatgcaatcttggtaattctacaagttgagttgaactaaaagtacaggtttttttgtaatgcgatttaaaatttttaaaaacatgggcttcatgaaaacaccattgttactaacttgggcttagatgggaatctaatgtgaatagttcaagttatgggacttgtctaaatgtgtctatactctaaacctgggggaaggtggtgtggaacattgacttgactacagtcgaatacatgttgggaatcattcccaatcataagacatcgtcgtttctgtaggatgactgcatatgttcagagtagctttttgaatttggttcccttagctttagggatgtgatgttatagtccaaaatgtttacaagaaaacctaagtcttcaaaagcacaacttttgttgcttaggactttgcatcaactgttgttccagacctcacttcaacttcttggtctctgaactggttttagctagcatgcatgagagacagttttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacaactttggactctactgatagatgaaagagcaaatgatgactagtttagcctctgcatatcaacaatataatgcagatcaagtataatgctcaatattagtgacatgagtatcactaaattacatagaaccctgatggggtttcctgtgtcgtaatccattaaatcggtggccagtgcttgctgccgtggtttagtgattgggtgttagaaataaaaactcaggtctatttcttaccagtcagtaacaatttttagagaatgtacttggtatataatatatggacttcaggaactttattggggtggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatgagaacagtcttgggttcagaggtgtgatgccagaatgtattttcgtactgttaggcccttggaacagataccggtgctttctgaaagatgaaagaaatgcaatgggtgctcttcatgcaaggttgcaaacctaccaagaatgcataatagtctcacttttccccaataaagagatgcgtgtgactagttttggacttttaaccttaatgggggttgcatgtctcctattgttaatcattgtcagctgcagtgacatgatccacagtcctgcatttactgcctttcacttaatgattttggacaggttttagagagccaggatgttggtctgggcctttatttggttttggctttagctgataatgttttagtgatgtcagctagtgcagttctcaaatggctgcctattagggaaagaattcagaggatttgactgctcctaatcatctgtcattgctgctagataatgattggcaatttttaagactcaactggaaatctcaacagttgctggtaaaccattaaccataaaaacgttgcttttgaacaccagtgctgaaaaaaatatttttttttttttttttgagagtgaaaagggcttggacttaagataggacaatgtggagaatggggggaagaatgcaaaacgatatagtatcccttatggatggtacatgtgcaacagggaactcttacttcatataccctttgcagtaatcattcagggaggaagaaaaacctggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaaggtggtcagcctgcctgacaatggaagacatacttgaatggggagcagggtatgtgctttcatatgaaaaaagagctgatgttaaaactcatttggtgaggtcaacgttgtcacataccttcacataagggatagtatattttgggttgcagtcaaacttgtgctcagactggtgaaactgagagtcaggcttttacattttaaagaaaatacagttttcattctaattcaggtgtctacttattttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttattattctttaggtaagaatgattgatgttggctgatattggagtgctcattcacatgaagtggatagatacttctcaagacatcacacagcgtgagtcaatcaaggagggaagccacaagcagactgacaacgtttctaggtaagttaaatgattcttagtctgttaaactgtcttcagaaaggcccttgggtggtacaaaaataacaatactaatgtgggaaccattaattttttattttttgagatggagtttcgctccttttgcccaggctgtagtgcac

SEQ ID NO: 4722 - DNA, 12592 bp, Homo sapiens
actcaccttggcggcgtctgacagctgcgccagcagcagcacggaaagcgccaggcacgacaggctgagcaaggagccaagccgaagaaggcctccccacagggtcgccatcgctgggggcccagcggtcccacagcccggagcccccgcgaccggctcccggctcgggctcaggctcaggctcaggctcaggcacaggcttgggacccggctggggatcctccgcccgcacttccgtctggacgcgaaggcgtcaccgggcgcgccgggtcagatgcaaaaagcatccgccccggaaccggttaccagtgcgaagggccgggaggctgggcagtcctggtgcccgccttggcctagccccggccccgggacggaagggggcctctggggtggcagcctgggcccagtagagctttgcatctcttggatatctttcccgggcgcagaagctgcggggcttagggagtcgccattgcgctggaaagtcctcccgcccacggagaccccagcaaactccgagtgtcacacagtcgcctctggcgacccgtgcgggccggagccgttcgcgcacaggcagggcgggtgctgagcgtggaaacggggctggaattggccgagccatgcctttccgggatgcccaccgccagtcaaagggttgggggtggtctctgcaccttaagtactaacctgccgcccacgcgcctcctgaccacagcaccccgtcggctttctaattctgtgagctgccctcgtgggcgtggcctccctgtggagctccccatgtgcctccccttggtccagcctgcagctaggaagtgggtcacagcgacggggctgggctgggccaggccaggctccgggagatgtggaattggcgaaacaactgccccagtagtatcctccgcctaggactccaagaggtggcgaattggggcactacgcccgggaaccagggtggcagggctagatgtcctctcaccagactgcccagtgaaggtgctgtcactttgatgaattatcaaggctttgtagtgggtcttctactggacaaaggacaaactggagactccctggatcaaatgtgttggtgaggcactgaatctgattgctgaaagaaaatgttatagtgctgtcaggaagtgctgttctggaatacagaatgtggctgccgtgagtggagtgtgactatgagatagtcgcctgactggagacaatgaagcctcaggccaaggatgctccctcctactcagccctgtttagtgggatttttcagcccactgtaaagcctactgctgcctgtaaagccacctaagtgcatcacttgctggtgttcaccatgataacaacaatttatggggacagaatatgtttctagagctgctggtgccactgctgatgttactgggttccctgaaataaaacaccacagtgcaggtgagtaccaaagtggggagaatttttagttccttttagaggtgctaaatcaatattgttgatttcccagtaccttagaatatttaatgaaaacaggtcaggtgcagtggctcacgcctgtaatcccagcactttgggaggccaaggcaggtagatcacttgaggtcaggagttcaagaacagcctggccaacatggtgaaaccccatctctactaaaaatacaaaaattagcagggcgtggtggcaggcacctgtaatcccagctactccggaagctgaggcaccagaatcgcttgaactcaggaggcggaggttgtagtgagtcgagatcatgccactgcactccagcctgggcgcatggtggctcatgcctataatcccagcactttgggaggctgaggcagtcagatcacttgaggtcaggagttcaagaacagcctgaccaacatggtgaaaccccatctctactaaaaatagaaaaagttagccaggcgtggtggcaggcgcctgtaatcccagctactcaggaggctgaggcataagaatccttgaacccaggaggcggaggttgcagtgagctgagattgcaccattgcactccagcctgggcaacaatagcgaaactccgtctcaaaacaaacaaacaaacaaaacaaaaaaacttaatgaatacagtccctcctaagattttcaaataaatgaaataccacattaatcatattgttttatttttatcattacattaaaaatcaaatagtatcactaggtttataatgaaaaacagcagaccctgtcccagccctccacactctcagtttctactccctagatataatctctattcacccagctacctcttctggtatttatctccgtatttctaaatagcatgcttatactactaattcttaatttttcagtttgggccattattttactttttctataggaaataagatatgtgtttatactctgaagactggtaatacacacatgtatttctccatcttccatccttcagtttatctatatcaccctatataggtagagtactattcattatactattataaaggtatgtaattgatccagttagcataatatgattatatttcctttattttgattgaagttaactattgcctctttctccatgcaactttcttaagtacctagcattcaagtgtctataatcaatttattccaaactgtcctttcaaaacattgaaacacatcaagtagtctatcaatcagtttattttttaaattggagacaactctctaggagcccatcatcctccttcactgtggactagtttttctctaagcctactgcacagcttttgtcctgaaataattttatcctttctaccctgttttccacttctttttgtttttctgaaagatttccaccttccagcttttcttttgaattttaaaatttctgttatgttttaaatttgccagaatactttcttgtcaacctctcttttaattaaaaatattttttatttttgtaatttaaaggtttattgtaaattgacaagtacaaattggatatatttatggggtacaaagtgatgttatatgtatacaatgtggaaagattaaatcaagctaattaacatatccatcactacaaatacttctttgtggtgagaatacttgacatttaccttcagcaattttgaaatatacagtacattattattaaccatgctatactctttatctcaaaaaatgtattccctttatctaactgaaacttcgtactctaaccaacatctccttgtttcccctaccaccccttccccctactctctgataaccatcattctactctgattctgtgagtttgttttagattctacattaggaatcatgtgactttgtctgtctgtgcctggcttattccattcagcataacgtcctccagggaagcactttcttgtccacccccttcccctttttaaatagcagtctgttccatttggtggatgcagtatcttattactctaagaatattgctaatgttttcttttgtttcttgaattgtctgtgttgaatttttaaggcttgtttctgttttgtgttggaagcttttcttaaacgtctagagatccttggccatccattcatatgtaagagtggggcactagaaagccaatagaaagttctgtgtacactggccagtgaggtggctcacacctgtaaccccagcactttggaaggccaaggcaggcagatcacttgaggtcaggagttcaagaccagccttgccaacatggtgaaaccccatctctactaaaaatacaaaaattagccgggctggtggcgcacgcctgtaatccttgctacttgggaggctgaggcttgagaatctcttgaacccgggaggcagaggttgcagtgagctctccagcctaggcaacagaccaaaactctgtctcaaaaaaaaaaaaagttctgtgtacatacttaggacttgtaattggtaggacatactgcagtatttttcaaacttctggtcgcaaacccattagtagtttgtgaaatcaatataatcagttttatttcccccaaatgacagaacagaatagaaaacaccacctcagaatacatctacatagaaagagaattattttatgaaactttggtttcttacacatatcatatatacatattatgtactggtttgatcccataaaatgggagttttttttttttattgtgggtgtttcttcaaagaaatttgaaaaagtacaacttaggataatcaaagagatctccaactgtcaggacaggtaggtcttttctcttagagaggttaagttccggcccagtgcggtggctcatgcctgtaatcccagcactttgggaggctgaggcgggcagatcatgaggtcgggagattgagaccatcctggctaacatggtgaaacctcatctcttctaagaatacaaaaaataagtcaggcatggtggcacgcgcctgtaatcccagctactcgggaggctgaggcaggagaatcatttgaactcgggaggcggagattgccactgcactccagcctgggcgacagagcaagactccgtctcaaaaaaaaaaaaaaaaaaacggagataagttctcctggagtaaaattctctaaacttttgcctgcatgctagtctgatagacagtactcattcattcaggtattggttgaggacttactatgtgccaaacactgttccaggttctgggtatacatcagacaaaactgtctcctgggactagattctagtgagggagataaacagtgggttatatagtatttagatcttgcgctaggtaacacagcaacagaagggaaagctgaacatatgcatatagatgctggtaagagggtggatgtggtggatgaatgaagtagaaaacaaggtcatcatctgagagtgaaaatggggaggaagtgttggaagaaaagagaaggtgtgaaataatttaggacacagcacagcaaactatagcctttggtcaaatcctattttggtgcaatccacaagctaaggatacttttttacttttaaacggttgggaaaaaaatttaagatgatattacatcatagcatgtaacaaataaatgcaattcaaatttcatttatttacatattgcctctggctactttcatgctacagtgacaaagctgaataattgcaaaagagactatgacctgctatgccaaaaatatttatctggccctttacagaaaaagttggctgactcctgatctaggaggatgggaaggtatatagagtagggaaatatgattatcaggcagcattaaggcctgaaggttatggacatgaatttaaagtaagactaaacagcatagttgctgcacagaagtaggtacaaaggcaaagagctggctttaaagttgtgattttgcaaactgaaaatgacaaaaaggggtagactaagttaaaagtacatgcaagttgcatgattataatgagtgatcctgggatttaagttgattatgacaggaacagaaggaacttggagattagggacaatgaaaaggtggtagtgaaaggagtgttggagttaagttactagatgtctggaagacagactgtggtggtcagataatgagatagattatggaggggttacagtttttggtaataacgagagagatctaaggtatgactgagagtgaatggatgagaatagcagagaacaaggtcagtggaaaactactcttcaaagaacctatagtcagggtgttgaaagattaaaaattgctaagaattaaatcaggagtagtgctgcgggaaatgaaatgagcagtgaactaaacttactgagaaatgagaggggatgacccaggggtttgtagattttgtagatgatagcaatgaagagaagagatattatttgatggtatggaactcaaagctgagagttttaagggaagataggagacgtgtctagaagtagtaatgaggagcaagaacatcatctaccccatctccaggaccagtaataggaggactgtgggagaaaaaaatcaccttgagagggctgtagtgaaagcagtatcctaaggtagcagccaagtttcagactgctgggatccaagccagggaaaggtttctgactctttagaatgctgagctttaggctgggcacagtggctcacgcctgtaatcccagcactctgggaggccaaggtgggcagatcacttgagtccaggagttcaagaccagcccaggcaacatggtgaaatcccatctctacacaaaatacaaaaattacccaggtttggtggttcatgcctgtagtcccagctactcaagagactgaggtggagaatcacttgagcccaggaggttgaggcagcagcaagccatgatcacaccactgtactccagcctgggcaacagagtgagaccctgtctcaaaaaaacaaacagaatgctgagttttaaatccctatattcagtaggatgtctcccctcagctcccagttgttgttggtggcttcaactagttcatcttccccaggagataatgaatgaacaaatgaatgaatgaatgaatgagtttataaggggcgaggatctcaggacttcatagtctttcaagtaatcatcttgtttttagccctctacctactacctcttgcttttcagataactgatgcctccaattcctaagccttttctggggttctgtggtacaaacatgcttgcttattgctagtaacactccaccagcccctgccccagacttctgctttctctggtctactcagtttgttccttgttttttgctttccggattcaaagattttgttgacattgcctggatgctgccatcttttgtctcatattctttgtccttaatcatttaacattcctttactgtcattttaatggcatttcaggaggaagccatgtttctagtccaccgttcttttttgttgtttttgagacagagtcttactctgtcacccaggctggagtgcagtagcatgacctcagctcactgcaacctctgcctcccgggttcaagcgatcctcccacctcagcctcccgagtagctgggaccacaggcatgcgccactacaactggctaatttttgtatttgtaagtagagatgaggtttctccatgttggccaggcttgtcttgaattcctggcctcaagtgatccacccacctcagccttctaaagtgctgggattacaggcatgagccaccacaccgggccaatccactgttttttaaaaagttgtcaagagttttgttaaggggtcagacatgtctgactggttgacttttcccagaatgctgcttagtccctcaaacacacaaattcctgatgggtccacccactaggcttctggtatacacagacagatctgaatcccagtggtggaaacaacctaggctgattctgagtttcccactgcatttcttcttctaattgtccctcttttccattcctgtcctttccctcatcccttacctgctgaaaatgaatcttaccatttctaaaattccactcttccgggggcatccacagctggatcctcttcttcactgccattcctcaggccttagaacaggtccccttcttacacccttgtgctccaactggtctttatgaaacctgttcacttcaatatacttttaggccaggctcacgcctgtaatcccagcaccttgagaagctgaggccggtgcatcacttgaggtcaggagttcgagaccagcctggccaacatggtgaaaccctatctctactaaaaatacaaatatatatacatatgccaggcatggtggcatgtgcctgtagtcccagctactcaggaggcagaggcacgagaatcacttgaatccaggaggcggaggtcgcagtgagccgagattgtgccactgcactccagcttgggcaacagagcaagactccgtctccaaaatatatcttatctatatatagatatagataggtatatatagatctatatatagatatatactttcaattctccaattgttcccgtataccatagagaaactcttatgagctcagtttctgcaggacttacaaaacagggtaattgcctcctcattatggtcagctccagcaccattcaaattctctgtccttacccatttccagaacaagcaggatgaaaatcacttatcactatagcacccacccttaagcacaaggttatccaatgttttcaaggagtccagcatttcataacagaaccccctgattagtttgctaactgatgaaagcagagttaaattcctgttatgcaggtttagagtacaggagattctatgtccccatatcctctgccccccaatctatcccttggcaaacacaagtacctctactagaataaccatactccctcttcccaacccacttctcttgtttaagggcactggcagtgtttgtgtatgtcaacaacatcggagtatctggggtccctggagagttagattttctgtattaattacagactgggagattactctggctccagtaaaagcaataccaggattgaagtcccctctctgattatggtggctgggatttgctggaagaggcataggtccagaaaagaatgtaaaaaaggtactagaaagaaagaataaggcctatagccatcaggctgctagaacctttggacaagtcactatctaaaagcaggtaaagacccagctttttgtccatctggtcaggcacctggtggcgtgagtctttcagaacatactggtcaggcggtggctcacgcctgtaatctcagcactttgggaggctgaggcaggaggatcacttgaggtaaggagttggagaccagcctggccaacatggtgaaaccctgtctctactaaaaatacaaaaattagccaggtgtggtggcgggcatatgtagtcccagctacttgggaggctgaggcaagagaatcgcttgaacccaggagtcggcagttgcagtgagccgagatcacaccactgcactccagtctggatggtaaagtgagaacccatctcaaaaaaaaaaaggaacataccacaacccttcaataaaaaggtctctgagaaaacagttgtcacaatgtccatgtacttgtacttgacaccatgtgagaaacagcctccagtaggtcactggccagacaggtgagtatgaaataggacaacactgtattatagctcaggatgcattgataatagaagtttgaagcagcagctgacagacgagtctaagcaataacacacagactagtttgtctctgctcttgagaacagcagcctgcaacccttcaaacaagccataatgtgtgagtcaacaagaagctacatttgattgacaatgccattttaataaagatgttctagagtcaaagaatttggcgtgagaaattgtgcccaggctggggtgcagtggtgtgatcatagctcactgcagcctctgagctcctgggctcaagggatccccctgccttagcctctgaagtagctgggactacaggcatgcaccactgtgcccagctaatttttaatttttttgtaaagatagggtctcattatgtttcccaggctggtctcgaactcctggcttcaagtgatcctcccaccttggactccgaaagtgctgggatgtgctcaatattaaatgtcatgaagatactgttaaaataataattgtgctcaatagttgtatctttatactattctgagccttaggtttcttttctgtaaaactgaacaatactaccttctttgcaggggatagcatagtccctggtttacagtaaatgctttcctccaattgaatcaagatatacctctctgctacctccccatctattagaaatgcttgccttctggtaccagaaaaaaaaaaaaaacaccttccacatgacaactctgaagacaataatcacactaccattgtgtttttctggatgtgccacacattgtatacatgtccctgccttacaaatgacatctcctatacacagagtccttaatatttctacatgcaatgtataatcaattaaaacatcagtatcatcttaatgtgaatttctgttaatccaagttctcccccactatgcaagtgcaataaatatttaaaaatgaaggtaacaatatatatatatatttttttgagacagagtctcgctctgttgtccaggctggagtgcagtggcgtgatcgcggctcactgcaagctccacctcccgagttcatgccattctcctgcatcagcctcctgagtagctgggactacaggtgcccaccaccactcccagctaattttttgtatttttagtagagacagggtttcactgtgttagccaggatggtctccatctcctgaccttgtgatacacccctctcggcctcccaaagtgctgggattacaggtgtgagccaccgtgcttggccaacaatatatattcttaactgtgtaaattttaatttgttggttttattcttttgagattattatgaatattgattctgtcattcatcgcttaaggaccaggcaggtgaaccacttgacattttttatcatcagaataaattgacaaaaacaaaacaaaatactttgaggtggaatggaagtatcttgagtagtagtaaaaccatagttctagatggtgataatcattgtcataatgaaagcgtgttgcttgttgactatttaaccatgctgtttaagtcatattaaaaacatcaatacgtccctctccctctcccctctcccctctcccctctcccctctcccctctcccctctcccccttcccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgttttttttttttttggtggagacggggttttgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatcttggctcgctacaacctccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggcctccccgtctgagaagtgaggaaaccctctgcctggcaaccgccccgtctgagaagtgaggagcccctccgtccggcagccaccccgtctgggaagtgaggagcgtctccgcccggcagccaccccgaccgggagggaggtggggggggggtcagccccccgcccggccagccgccccgtccgggaggtgaggggctcctctgcccggccgcccctactgggaagtgaggagcccctctgcccggccagccgccccgtccgggagggaggtgggggggtcagccccccgcccggccagccgccccgtccgggaggtgaggggctcctctgcccggccgcccctactgggaagtgaggagcccctctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccatccgggagggaggtgggggggtcagccccccgcccggccagccgccccatccgggagggaggtgggggggtcagccctccgcccggccagccgccccatccgggagggaggtggggggggtcagccccccgcccggccagccgccccgtccgggagggaggtggggggatcagccccccgcctggccagccgccccgtccgggaggtgaggggcgcctctgcccggccgcccctactgggaagtgaggacccctctgcctggccagccgccccgtccgggagggttgggggggggtcagccccccgcccggccagccgccccatccgggaggtgaggggcgcttctgcccggccgcccctactgggaaatgaggagcccctctgcccggccacgaccccgtctgggaggtgtgcccagcggctcattggggatgggccatgatgacaatggcggttttgtggaatagaaaggcgggaagagtggggaaaaaattgagaaatcggatggttgccgggtctctgtggatagaagtagacatgggagacttttcattttgttctgtactaagaaaaattcttctgccttgg

SEQ ID NO: 4723 - DNA, 682 bp, Homo sapiens
gtaattggactacaggtgcgtgccaccatgcctggataattttaaaattttttataaagacaaggttttgccatgttgcccaggctgttctcaaactcttgggctcaagcaatccacctgcctcagcctcccaaagtgctgggattacaagtgtgagccacctcgcccagccaggatttacataaagtattttaaaagtcatattggggcagacgtagggtgaggagccgccgaggccgaggcccatgactccatggagggccagaagagagcagaaaaacgtccagggtctctcatgcattcctatagacaccagaaagggtggaataagaaagctcagctgggaggacaagaaagagactcaagagatcgtttatgactgtttctgagaaagctcctggcatggccatgagtggccttccgggagtcctgtaaaaaggaaagcacagaaaacaggaaagaactctccctacacgtccctctctgcctgtttgtgtcctcgggagactccaagcggtggtaaagcaccaacagggctcttcttggagcaagagaaagaaaagactccggggtgagtaagctctcccaggaaccccacagcaaaccgtgaccttgaacacagatggcaaggtcaagtcatttacaagtccacattcaaatccaaatctcccacctgcaaaat

SEQ ID NO: 4724 - DNA, 367 bp, Homo sapiens
caagggcccacaggcccaccacaggattggtgaccagcattgaggggacactgagaaaagttcttcaggctgtttcttcccagccccgccacaggctatgctggcacctgagagagttcttatcccaccctgtgcggaactcctgctgagcagagtggctttgtattcttccttccaactcaggctgttggtgcactgctagagggctgctgtctctgacactgcagtagccacagtcgagcttgagctggctggtccagcaggggctgctccgcagccctggggctcagaccagagcaatgctgtgagagtcctggtactggccagtgcagagactgcacatagcaagggctcaatgaagtttacc

SEQ ID NO: 4725 - DNA, 1105 bp, Homo sapiens
agcctcccaaagtgctgggattataggcgtgagccactgtgcccggccaagagcaacttttttaaacctacagtccaattcttttcccttatctctcaggagactttgggctcacctaggagcccacttttacctccttcctcagttgtgcatataacagaggaaggggcagaatcggccttcagggtttaaaggggccatgagtcggggtcagccctgaggaggagtggggtgaatgctatcccaggatagagatggagccctggtggcctgattcctcctggcctggccagtaccactgaagcttcccaacacctccaagcttattaaagaaccagagtgacttgcctgtcccagagagacttgggatggtcagaaacgggggtgaggggcccggggcaagccaagcctgtaaatgatggcagcctggggctttagtttgggaacacactcacacctcctacaggtcaggctgcacactcgtgttatttgataaccccatctgcaggtgaggaaactgaggcgcagttatttgtcctcaggcatgctccttagaggccacttgattgcagagaaggtctacagagcagtggttagaacttggccctgaggacagagcttttgctccgtatgaggctggcaggtaacgatcttctcagttttctccccaggaatctggaacgatgaaggtgatgattgtgcctgtggccaagaccgggagaaccctggatccctacaccttccccacccctggaatgtcactatacatatctgacttcttctgatgttgcctttgaccctaaagtcaatatgataaagtaacaagaagctgggacagaggaacaaacacagcccactcaagcagtggtggcaacattctgttagaaaggaggggagtcaaagaaaaaaacacccctccgcccatctccttatcacctccctaaagacagaggagaacatggacaccctccatcctgatagacatgccatgtggtcagtttgtgcggtaaacaggaaaaaaaaaaaacctaaagatattgtagacctttattttctttaaatctcctaataaaaacattaaactttcaagaagattccaaactga

SEQ ID NO: 4726 - DNA, 19931 bp, Homo sapiens
gtacctgttgacctcatctgggctgcagttggtgactgctcgaaggggtgggaggaacagtataaagtcctgtccccttcctgccttcaagggcacccctgaaggaccatatccactgtggacccccttgggatcagccgaggtctgtagaggtgacattgcagcccagcacctccctcctccgccctgccctcctctgtcctccttccacaggtgtggccaagggcactgcccagttggcctgtgacccccagctgaggctgcttcctgggcagctgacttcaagtttgtgacctgagctctccaggcccccgagcggctggtgccttggccctgcagttctgcggccaagactcctcctctgggatctcgtcttaccctgctgcgggtgccagggctgcatgaagcaagggcgaaagtccccttcgcccgggcgctgccctctgcctgctgtcccctgtgctcctgttccccgtggctgcccagggacaggtgtgtgggatggaggacgcgggagaggctgagtcctccccagtggacccccagatgcagaccctgaggcaagggagagtgagaaagtgaaggaaagaacacagctggaaatgcaaccaagaaggaaccccagcccggaccactgtgagcaaggagagccgagccccggggagccctgagacagtgtgggagtggaggcctggggcgcctccaggcaaggcagcgggatgtctatgccccaagccctgccagtcgtggatggagacgcacactttagtgcgggctccagagacagagggagccccaggccgagagctgtgggtgctgggcaggtgggcattggccagcattgcccccactcatggcgggtccaccttaattcgacgggtgtgacactctcctcacacatgtgcacattcaagaggcaactgtctgtttctataactgggtgcatttcggtctggagccgtcgagccgggtggtggccatgaatcccaggcaacttggggggcccaatccagggttgccttttgggggccttggggcggctagtgcagttccacatgctgttaaggaccttgagatgggagattattctggatggtcagggtgggcacagtttaatcacagcccctctaagagggactgggagggtcagggtcagaggaggagaggggacgacggaagggagagagaggctgggagatgccgtgcagccaaggagggcaggaacctctagaaaccacaaaaggcgaggacacaatctctcccctgaggcagagacccagggctgccccgcacagtcgcgcagatcgtgtactgccctgctcctggggctcattcacacaggttgccatggctgtggggtccctggggctgggctatctgccaacctgggggacgctgcaccctgttttctgtcctgtctactccagcttttcacactctctgttgcccttgtccttgggcatctcagtgactcgaaggaattgggtcttgagacacagccgagcctgtgagcgctgacctgtgtaaagaagacaccagaatgagatgtctccacacacagagagctgcagccgatgccggccggtgacttgggacttggatgcttaacaggaggctccccctctcttgggaggtagagagcagtgaggaaggggactcagcctccatgcctcccgccagcccagctgcgcccgaatcacctccctcctgaaaggatgtcagcctctgcttggacaccgtggagacagggccctccttgtgcttcagaagcatcaacgtgtcagaaaatcatcttcacgccaagtctggaaaaaatggctttgaggttgtgcacacaaaggaaggagggagagccccaggtgtcgcggaggaccatgcggctgacagagccagcagggcggtggcgtgtgagccgtgctctggatatataaggatctgacgctgctggcaatgtctgagctctatgctcgcccatctgtcggctgctatcatcaccgggtgggattagcggagatccactctttcatatttaaatcttcacaagagaatgaatcacttttataataaaagaaaaagaccgtccatgttgttaatgtgcacacagcaagttggaaggccggggagggcagcgggtggggacgctgacccaggcgcccccctgctgcctggaacagccccaggcctgctccactgtcccctcggggttccctgtcgaagaggccaaagagtggaggggctggtgcctagagggtgtggagctgcaggtgcacagtacagctggcacctggcagaggtggttcattatcaagcaaaggatgaacaaggcacttggagccccttcacaactggaacctccactgcaggcacaaggctgggctggactggggtctcctcctctccatgacagccttgggcaacctggagcccgccactgcccctccccaggtgctgtccccttgaagcttctcccaacggtttagtattgtagagttggcacatctcacgtgaacaagaacagccatcactgaaacgaatgctcagagcggaccggcgttttttcccagccaccctggggtgagcatggctcacgttgcacaccaggaagcccaggagcggggaattgaaccagttccatccagtccctggcaagggaccaccctgtgtccgaaggccacgttcatttttcagattgcaggaaatggctcagcctgaagttcaagttttcctctgagctcctgttgattaatgtggcaaagagagcatgctgtggaatatgctggcagaaatgtcaggattgctaaagcgtttcactgcaaatgctcaggctggtggggaggtgccttggcacaattctgcagagggtatttggcaatagcaacaaaatcacaaaggcacaaaccctgtgacccagaaacaccaatttcacggtaggagctgctgccgcaggggtttgcccagagcacagggaaagatgtgctcactgtactcgctgggacaagcaagagattggaaagagctcagtgtcgtcattcagggtgtctcctgtgtctcctgatcgctataaggggttccaggctggtccccgggggaggagctcctgatcagacgcaggccctgccccctccccagcacagagctggtgaaggaagtggacattcattcattcaggatgttctgagtatttcagcaccaccaggccctgggaaatcaaggtctcagcagatgacggtggcagtttgatttttggctgaattgtcctctacagcagtcactgggggttgcgtttttctcacactgcccagtcatgcagcacacggaagccatccatatgccatgggaaaatgctttgtctcctgcctgggcgccccccgagccagtgagtacagtcctgcctagtggcaaggtgagtgtcctgttcccaagtcatgaaaatgctcttcactggggcgggtctgccgagttgggaagggcacttacggtttaaaccgagagactctccctgcatttgaaatgaggacatagagttctttttctcttttcttttcttttgtttttttgagacggagtcttgctctgtcgcccaggctggagtgcagtggtgtggggtgatggggcaaatggggcagggcggccaggtggggccaggcgggcatctcccgaggatgatcctggaggtcagctgcccggtgtgggtggccatgaccttggtagcctgtgaccttggtggctgtgagcttggacgagaacattttcttctgccagtgcaatgcctagagaggcaggccactgagggctggggcagtgaaccccggggacatcgcgttggggagtcctgccgtgatagagggcccctgggcaccacagtgcagcgtgtactccaccgtggctgctggatggccacccatgggcagtggagctggggcagggatggcattccaggtctacaaagtagggagagtgacggcccaaaggagcgagggtccaggcgagccgcacacggaggagcgagggtccgggcaggccgcacatgggtcggaggctgcagagcccatgctgacggcgcacaccatgggctcggcctgctgtccctagaaagtgtggggcagaaagaacggatgcacctgtgtgctccttgctggaagtggcagggggctcttcccatgctggatctccggacactccccttggcgctctgcctggtggtccgccgctgcacacgggacacggcaggctccgtcccctcggcggccactctgtccccttttaaggcatgtcagaaacaaagccctggacggctgtggctgggttgggcgttcgccccagtccctttaagccctctgggaagggtgggaagtttccaaaacttcccgttatccacaccaagctccttgaccagagtccagtaatgggacgctggcagtgcccggatgccccgatacaggcaggagaggcaccgtactgggttcatccaaggccagcttaggtcctgggagctaggacgaccagagaggagaaaggcaaggcagggacatggcactgagacagaagagaccacccccagaacagagacccccgagagggcagagaccccgagacagcagagacccccagagggcagcaatcccaagagagcagagacccggagagggcagagaccccaggagggcagagactcctcagagggcagagaactctgaggccagtgacccccaaaagagcagagaccccgtgagaggccagagaccccagagaggtcaggggcccccgagagagagggcagagaccccgttccttgtttttccttgtttgccaccttcaatgtcattcttgccctccctcccccgccgagtgggggactgtggtggccttagctaccctcacgtggctttaggaccctcagagcataactaagcccccgaaggctctggtcttccaacaacatgatctttaggagggcaaagctcctgcggctcctgtgggctggcattgtgactgccctgggaggtggcaggtgtgactcgctgtccctggggaggcgggacccccctgggcacctctgcaggtgcgaatcgggggtggtctttctctgcgtggctgcatggggtgagagcctctgtcccagggcaggtgtggggacaggccctggtggagcgtgcgggccggctggagctggggtgcccggaactgtggtttgtgcaggcccaggagcctctgtcctcgtgtgatctttgtgcactcaggacttcgagtcacacctggatttggtgaagggctccggttttagttccagctctggtagccacacctctgggatcacgggcaggtcacactccctttcccagcctgtttccccatctgtacgacgtgcatcctcctgtcgcgaggatgtgtaggtgcaagagacgtccacctcacctggccctgtctgcaggcatgaggctctgtgaggcggggccctccctggggactctgtggggatgaggccctcacctggggactctgtgaggggggaccctccctggggactgtgtgaggatggggatgaggccctcacctgggggctctgtggggctgtgctgtcagctgggtgaggggagtcctggccatggtaacaacaggtccaggagcttgcccctttgcccagaacattcctcccatctgccccctccaggcctcagcttccacgcctttccctccaggggacctcctcttcctttcctagttcccccacctccctccatattcacccgtgcgcatgccggtgagcgggcgtccaggctggagtgccagcgtctgggtctgggtcccggtcctcaggctggagtgccggcatttgggtcccagtcctcaggctggagtgccggtgtctggatcccggtcctcaggctggcgtgccagtgcctgggtcccggtcctcatgctccctacaccatggctgtctcctgatgtttttggctgactctccctggaagcagaatgaggccagggttgatgtggaagctgttcatttctttgggaggtgacccaggaagacagggagtagggaaggggatgcacctgtaagggctgatggcttagtgcccctgctgagcaccctccagtgactcccctggagcggggaggaggctgagtatttatccaactcctgcctgtgggggtaacaaacgaggccgctctgggggtgcgactgcctgatagccggcctgccccagcccaggcagagagccctgggcagagccccctattgccgccagtgtcctttcctagcggtcattctcactgctgtacttgcagcgtggtggcccagtcacaggccctccctacccccagggttctgccccatcctgacagggctggccaagagcctggcactggggcccgagatgagacctcagtgccacatagtgactggggtgggggaccgaccagagtgggtgggaggcaggtgctttctgaagtgtgcctggcctagcctttgtccagcgagctctagacacagctgctgaccctgagggctccggcacctgcccttttgcccagctgcagactggctctcggtggccatgggccttgaaccaggtcagatgatgggggttgagctgacagggccttgctccaggccctgggtaattggctggggtctgggcctggctgggggtgtccccagtggctctgctagtcacctggttagttggcctggcaggatgagaagcggctggtctcacagacccaaggaacgagcccttcctggtgagatgggaggccctatgcaggctgaatgtgcccgggtgtgagcacttgtgtgtgtgcactcatgttcacatgccatgcctgtgtgtgcgtgcaggcatgtgtatatgcatttgcctgtgtgtgtgtgagttgagtgtaaatgtgtgcatgtgggtgcatgtatgtgcacaagtgtgcctgtgtgtacacatgtgtgtctgtgtgtatatgcatgtgctggcacatgtacatgggtgtgtgcccatgggttcatgtatgtgcacaagtgtgcctgtgtgtacacgtgtgtctgtgtgtgtatgcatgcgctggcacatgtgcatgctgtgtgcatgtgcatggggtgcctgtgtatacgtgcacgtgtgctggggagggcccactcaccacgtgctgcgggcgccctgcgggtgccagcccctcctcgtctgccttgctctcctgccctgccttggctccctgccttcccctcaccggttctctctctgcttggcgtcattcctttcataaattcagcctggccatggtttccatggtgctctgataaaaactggaattccagtcataattgcagggagttggggagctgggagagagggtggaggcaggagggaacattttctatacaggaagctcaggtctcaatggctgtggctggtttttcttccttcagaggtatttagagtgtatagaattctctctcaagagctcccctgttgcctcgcgatggcgacgggccggcactgtcctcctgggtgggcctcctagccgatgggcttctgtctctgtgctggaacagggcggagctcggcagacctgctgggtggggaggggcttgacccgggctctggcttcaggggactggagttcaggggtgcctggggcaggctgcccggccagtgtccccagatctcccgctccatgactgagctggaattccatggttgtatttccattcctatgatgttgtcgtcaatgtcagtgttcctccggttggggtgcagtgatctcctatgccctggagtgaacgggggttgtgagaattccttgcaggggctggggcagcagagccccacaccctccgttctgtgccagccaggggggtgccgagtcagccaggtcccgaggagcactgagcagatgaatgaatgaatggatggatggatggatggatggatgggaaggtatagggaggtggctctcccaccccagggcgcatctgactctcctggataagtcgttaacatgcagattcccaggccaccctaccttctgatcgcctggggctcagctggggcctgggaaactggtctggaacaggctccctggtggttctgacgtgagcccgcccatctgcctgcccaggagacacagggaacaggggcagcaggagcactggaggcctgtggttgggaaaggggctttcttctttgtcccccagaggacagcgtttggctgtcaacaaggccctgcctctgccctagtggcttggggctgggcaggggggtttgggggacccctctgctatgtgagatggaggcagaggcagggaggtgggaagggggatgaggcagggacacacccggcgcagaaggcacttctgtggggctgtcagccctcaggggggtcctgccatgggggtgtcttctcgtcctcctgtgggggtgtcctcccgtggggatgggagggagggcctcatcagctcagaagcagatggtggctgggttcttccttccttccttccttccttccttccttccttccttccttccttccttcaaccttctttctttctttctttctttctttctttctttctttctttctttctttctttctttcttctttctctctctctctctttctttctttctttctttcttttctttttctttctttctctttctccttccttccttccttccctccctccctctctttttctctttctctctctctttctccttccttccttctctctctctctcttttcttcttttctttcttctttcttctctttctttctttctctttcttcttttctttctttcttctctatctctctttctctctgtctttgacatggagttcttgctcttgtcacccaggctagagggcagtggtgcaacctcagctcactgcagcctacgcctcctgggttcaagtgattctcctgcctcagcctcccaagtagctgggattacaggtgcccaccaccacgctcagctattttgtatttttagtagagacggggtttcaccatgttggccaggctggtctcaaactcctgacctcaagtgatccgcccgctttggcctcccaaagtgctgggattacaggcgtgagccaccgcgcccagcctttttcagttctttaaacgctggcgtgtgtgtggctgtggatcctacggggtgtttatgaaggacgcttggtgtgtccttggtccccacgcatcttactgctgctcccacctgcccacccgggaggaggctgaccttgttgcctcgctgctccagctccttcctccttggcacagagcccagggatccctagagagaggcagaactggaaagaccacagggacctcaggctgctcccgcttgctgggtctcagtcatgaagagccgtgggtgtgcgaaaagccgggagaaaccaagtggaagccagtcgggatggtggtcaatgtaacaaagaccccagagaaaggaaagggctgtggggctaggcggtcttctgggagggagagtggggggctcagagggaagcacggagtggaaggaggagggcgggcaggaggaggggcagtgactgttctctcggttgttgatctgggtttgcctccatgccatgtggcaccccatgatttattggggtgatactgaaactcaccaccaaatggtacttattcctcccggctttaggcacagactttcttactttaaggagaactatgttgtctgaatccaataattttactttaaaaatgtagccagagttaaaaaatagctattggctaacagcccgtgtgaaaatttgccgtggggaatgagggcgaggacctgaatgggtgggtgggggagggtgcccgtcatccgagaccacccatgccttgtgtttgctccttcacctctgccctcccaacctgcgccccagccctgcccctgagcctgaccagcgtcctggggtcccctgcagagcccaccttgctgcggtcacccttttggtcaacttgcctggggtgagagcccgccacatccacctctgcctggctgcccaaccagcgttcctccctggcatgctttccccatgccccccagggggaagagaggagccaaatggttcccagaggctgaagcagaccccaggaggctctgggtgtagcctggacagtgtctacacagctcggcgtctgaggctgaggtgggagagcctgggcatgcagggtctcctgccgggtgagcatctctgatttgggggcaaagcaacccgtaccctgtccttcatccctctctgagccccgcagcctggagcttcctcctgccactgccatcagtggtccctaccagtccctggggcagcagcttggctctgccctctcactgctcctgggtcttggtgtgctggaggctgggtgcttttctcacctggcagctcctggggaggcgtgccctccccaggagggggtcacggtccttgggaggtggggtcttctgaaggtcccacaatggcgagggcagaaccaacaccagctccgtgcagctctccccctccctggcgtccccagctgtgaaacaggtggagctcgccttcggcctgtgggcctgcagggtgggtcaccgggagcacatgagggctgataggaccatggtcttcaagcttagggaggctgtgggtccttggcagattaccagagccttggcttccttggccagtcaaatgggaacaatgacctaaggatgctgagccccagggcggccggaggctccctacacacagctgggttcagccagggctcctaggtgatgcctggcagaatctgcgcttaaagtcctgtctcccaatcctcttcctcctcctccagagatgcagtcagagagacagcccccagctccagggaggaagcagggagagggaggagcagggagaagagaggagagggaagagaggctcggagggaggctcagaggggagggagcctcagaccagggagaggcttgaaggggagagaggctctagagtggagaggagagcagggacctggttgcaggcagtgctataccctgggccacctccagagtgacaggagcgggtggcaccaggctccactgttggtggagggggctcagactaggccggggcagagaaggagccgggcagccaggcatgaagctcatgattgacaccaattccttaaccttaaacatcacggagtgtccaactctggggacgaatcggggtgtggacaggttcaggcagggagcccgtggagggcagcagtcgagggcccgggtaccgctctgggccaggagggacactggcctggccgccaaggccagatgccaaggaaggcagcctccgcctccctcccagctcccctgacgcggccaaccttggtcctgcgggccgggccctgagtgctaacttccaccttatcccacgtcccagctcacagtggcagagctggagtccagcccaggaccctgtgcgtcaccacctgtgcgctcatggctgtgctgtgctgccgggggaagagctggcatcccctcttcacccagtgctcgccacgcagcctctgggtgcacaacacaggccccccaagggctccacatggtgggtgccctctccctgtgcccaccttgtggccacgcacagccgaggggaagcgggaccccgaggcagcaggctctcctcgtccccatccggcctcctcctggctctggcttccctctgtcgggggtttaaggcttcctagagagagcagctgttgggtgagagggtcttcccggagaccctgcagcctcttctgaatcaggggcccaggagtcctcactcaagccatccccacctctgagctgggcaggtgcggctcggaggggaaggtgggggaccatgcccttagggtgggtggggttgtcctgtgtttctgctgtcctttgggttaaggtgtggggatctttgttaccaggagatgctgtggccactaacgctttagcacagataaggacaggctgagcctggtggggatctggggcagcgccgcttgggagggcaggcgaaggtgagtgctgggtgctgggagggaggggcctggcagcgtgtgccaagatccctttagatgatcagggttatagtttatctccccaccctcacccagacccctcccagccctgctgccacctggctgcccccaaaggaaggagtcctgagcccccaggcacaggaaaacaacacttagagaatctctaagtgctgcagggaggtggaggcagggccagagctgctgaggacggccaagaggaccccctcaggaaggggtgctccctgccatcaggacccaggaaccatggcaggctcctgaccacgagggccccaaggctcctcccctctccccctaggcccctactcagcccctccatgggcgctcaaatccctcaagctctcaacccgccttctccctcccctattgctcccctagcacctgcccttctcctctccagccactctgagcccctcatgtccctggggagacccctcactcctgcactctcccttgctcaggctctgcctcccactggcccacctgcctcctcctccaggcagccttcctggactgttcaagcccaagcaaatgcttcttttgctgagctccacagggtgagcccagcactcctaatcctgaggcccaggaggcttatgagaaagaccccagggcaccaccctgcagactctgctgtcaccggcctcttgtggctcaggctcaggcaagccggagaaaagcttttggtgccctaaaaaggagcacagcagagagccagagccgcccaaccagggatggagaatgacccgggccttggcgggggagaattggaaacggtgggtctgggaggtgcctgggaaccctcattttcagagcagaagccctgggggtgagggttcagctgcatcttctgtctcctcagtagcctgcacggggctgggcccaggccagaggctcagtactgcacccgggcctatctgtccactgctaaggcctcgatggggccatggccccctcccccacaaccacaggacccctgggctggctagagggggccatggagatctgagctgagcggtcatgggaccccgggctccccgcttcactgagcgtcctctgtgttcagctcacagatcaggagactgaagctcaggagacggtgaggacttttgcccacacaggcccctcggtggtcactaggccctgcagggggcccactgctccttgaagcactagggagggtgggtgggctgtgagcagagggatcccggcgccccccacccgccagcttctgggaccagagccctgtagactttggtaagaggcccagtgcaggctggctgctgcgtcggtgcgtgtctgaatgaaggagtgaatgaatgagtgggtgggtgggcacatgcaggccctcaacactcaagtccacatcgaggcccttcggccacctttattgagagatacacggggtttgttttcaccacctgcagatggtgggagtgggggtgggcgtttgagctgtgagggctgtgccgtcaccaggggccggctcaggggctccggactccatgaccgacgcactcatggcacgcagggccagcttccggggccacatcatgacctggccgcaagctagtgatacgagatcaggtgtcgtgggtgtgtctgtggtgcgtggacacgtgtccctacctacggtaagtgcacagataggagcatcaagacatcaacgggaaaagccgacttcagtcacagccacagaccccgccccagagaccccacgtctaccgagggtctagggcagtggggcatccactctgccctctctcagagcaccatcctgagagacaccattctgtctgttccggggtggatcctccaggacagtctcatccagctgagagggcggaacgaccacatctgttccttagatggggaaaccgaggctcagaaattatggcccaaggtccaggagccccagagaagggtctgaggctgccctgtctggctctgagtccaggtcctcgttcagagcccagcctgaggggccttagcatttgctagactctgagcccactcctgagcaggggtaggggctgcactgacctctggacatccctggctggcagcaaagctcttccgcccagagcagactatgtcatgggggctctgtgggggaggaaggcccctctgtgctggccctgtttccctggggttggtggcccttgggcactgggagggctgcctggctgatgaccaggcttgtgggggcaaagtttggcaggaagtgcagcgaataggcctgactcccctgggccctgttcttggtgagccgaagggtcctgtggttggagagggattttgtggggttcaaggaacccgtcaactcaacagccagatccaagcgactgcagatactgtagcattcgactctcatttctcagacggggaaactgagtccagagaaggcaaagtggctgaacacagcccaagaccaggtgtccgggtcctgggtcgacatggccggtgcaggcagccagcccagagcccatttccctggggcaaaggctgctctgagacagggaaatcccttgaagaaaaggctgacttttgcttcctgtggctcccagctcctggctggtcccggccagcttctcctgggactgtcttctcttaggcttaggcgaccttcttaagccaggggcctggctagtcatgtgctctgtggagcctggatcctagagaccaaggaggcgccagctttttcaactgcttggaggccggggccagggctgccgccgccagaaggtgacaaatgagtctgtgcctcagcccagggctgccggccagcggtgcctggacacaccgctccttctcacctgaagcctgagttcctgggacctggcatcttactcagagaccaggcaccatcgcccctgtcccacattccccttctcaaggccccaccctgaagccagctctgggcctggctccagacctcagcctgcacagccacaagcaaagcacacggaatgcgcaccccatcctggccacggccactcgggcaggtgctggagaccaggcccctgatccggcgtcccttctgccgagcccgagaggccacagctgaagatcttgaggctgaggcctgagccccctcccatgtggtgtcctggcagagcccctgggccttggcctgggtgaggatgggagggaggaggggaggctggggtctgggccattccaggccagcccatttttgtcctttttgggcttgtggtcccctctgggggctgcagctgcctgcggcgagggtggtgggagggactccccacggcgatgggcccccagcttgccaggcctgaaggggcgagtcagggagctttcttggagctgcctgggggaggggggcatgggtctgcatggcagggtctgcacgtgaggcccaaagccacggagcctgcgggactggggctggactccccgagctagacagagggggtgcaggcctcagagatgtggacatgggaacagcagccgggccgccggaggcccggccccacccagcacctttcatttccttctctggaaccatccattagtctgagaacaaagaaaactgccttttgccgcacactaatttctccttgttagaggcccttttcctatctgggagaggagcgctctcttgttctggctttcaaagaggagatgggggaggggtggggaggagttggggacaggcccgggagacactaatgagaaacatgggttagggggtgggaggggggggtcccaggcctcagactccaaggcaggccagtgtggccaggaagatgtggcggaagttggcagagacgaggttgtacaggatggggttgatggtggagctgacgtagaagagtgcgttggtcaccatgtagaagtagtggtagaagtcatagaggaacctgcggggagagagaggcgctcagatcccagagagaactcttgagggccccaaggcagggtgacagccggggccacagcggctgagggacgtggtggctcagacgctaattaaaacaccccttgagaatggttgtttggggacatttcataacaagctccagggtctggcttctcctgagcagctgcaagttctcgtcgtgctcccgcccagcctgggctgctgctgctttttttttttttttgagacggagtctcgctctgtctcccaggctggagtacagtggcgcgatctcggctcactgcaagctccacctcccgggttcacaccattctcctgcctcagcctcccgagtagctgggactacagggacccccccaccacgcccggctaattttttgtatttttggtagagacggggtttcaccgtgttagccaggatggtctcgatctcctgacctcgtgatccacccacctcagcctcccaaagtgctgggattacaggcgtgagccaccgtgtcccacccagcctgggcttctttaggtggagcgtgggctctgcttgtccatccctgcctctccttgcagctgcctgcattgcccttcgcagctctgtgcatccaagggtccagggcttggctggtcccggcctaaccaaacagccagggcagtaaccccctccacacctccccagcagccacacaccttgccctcagcttgttgcctccccccacagtgatctcactccctcaccaggcagctcaattactaccagtcagccctgagtttcagaagcttttgcaggggccacactctgttccccgtgccttctcctcctcattggtcgtaggtgcgccctccctggtggttgtcactggaaggaaccttttattctgggatctggcagccccactgcacagaaaagggttcacaagtgggccccaagctgccatctcaggatggccagctggcaaggctggcctctggctggtgcctggggccttggattttgggaaggctctgccatttttgggtgagaagggctccctgcccctgaactgttggtgcaaacagtaggggttttgccaggcagtgggtgcccctgtgatcggcccccatatcgtcctgtgaggctcctctgggagggggccctggaagctgcatctggtcttccgctgaccccactccatgtgtcttttccctttgctgactttgctgtataagcaaagctttgtcagtattggtgctcttgctgcgataagtcacagccctgagtataactccaggctgagccctgtgggtccaacctgggtggccttggggctctgacagctgccatatgaggaggtgacacccccaccatgtccccagcagagccagggatgtctctctttcaccttcgggaaactgcctgggccatctctcttaggaccaactttctttctctgcaccagtctggcctgaatagcccctgccttgaacctgtccctccatggccttctcccggccccagtcacagcacaaccctgcccagggggtcgccgggggactcaccacacccctgccctgagtggatcccctcagcagtgcctgccacacccaccatctgttttgggagcacttacttgtccagcacccaacttcctggttcccggtactcacggagtccactgctcatccgagatgtagcagaacatgaggcgccgcacgtggtagggcagccagcagaccacaaaggcgatgaccactgcacctgaggcacagagacgtgggctcagagacccactgcacctgaggcacacagatgtgggctcagagacccactgcacctgaggcacagagacgtgggctcagagacccactgcacctgaggcacagagacgtgggctcagagacccactgcacctgaggcacagaggcgtgggctcagagacccactgcacctgaggcacagaggcgtgggctcagtgggggagacatgggctcagagaccagacacaagctcagagagggagagacgtgggcttggggagggagcataagctcagagacaggacacaggctcagagacaggacacaggctcagagagggagagacatgggctgagggaggtagacactggctcagagacatgggcttagagacacagagatatggcctcagagaaggagacacgtggtctgagggagatgcagggagacatcccatgttcatggattggaagatttaatattgttaaggtgtcagtactacccaaagcactctacagattcaatgcaatccgtatcaaatttcaagaatgcttttggcagaaatagaaaaatctgtgctaaaattcatatgaaatctcaaaggatcccggacagccaaaacaatcttgtaagaaaataaagttggaggtcttacacttcttgatttcaaaacttactacaaagttacagtgtggtgctggcataaagatagacacgtagaccaagggaatagactagaaatctcagaaacgaacccttacctttatggtcaagtgatcttcaccaagaccattcagtggggaaaggacagtctattcaacaaagggtgttaggaaaacgggacatccacttgtatgaaggtggatcctcccctcacaccatatacaaaaatggacttgaagtggattaaagacctgaacataagaactaaaaccataaaactcctaggagaaaacataattactttacaacattgattttggcaatgatttcttgggtatgacaccaaaagcacaggccacaaaagaaaaaagtagataaattgaacaacataaacactgaatttctgtgtatcaaaggatgccatcaggagagtggaagtcagctcacaaaaaaggagaaaatatttgcaaatcacatctgataatgagttaaccttgagagtataactcctaaaactcaacatgaaaacaaacaatccaattcacaaatgggcaaaggactcagacatttctccaaagaagatacaaatggtcaacaagcacatgaaagatgttattaatcattaatcttaaatcactggagaaatgcaaatcaaaaccacaacgagatgccacctcaaatctattaggatggctactattaaaacaacaggcacacactgggaccaggacacaccttggatgttggcaagccagccgtcctgagctggggctggtcctcagggttccgataggatgggcgttgccctgctgtgggcttcgccagccctgagagctccgtgtccaaagccctggctggttcccatgagcagggaaggctgagcccagagccaggctctcttagggtaatgtgcttggctatgggcctctcctgtgactggccacaccctcaaacaagccctgaaaatgggccagcaccagggaggagctcaagccaaatgcttcaggcaaaccaaactgaagacctgggtctcaggcatgaaagggcttcattctctccagttcccatcacactctccaagccctgtgttgttggcagcgtctgccctgcccctgccccgccttcttgccaagcacctcccaccacagggcctttgctccagccatcccctcgcctgcagctctgttgcccagatgggctcctggtccttgggacttgcaggatgccacctgctctgagagcccctcccagctgccagatgtagtcaggggtggtggtggtggtatttttttcttcatgctcatcactggctgaaggtgcctggtgcctgtgtttgtgtccttggtggagcccctgttcccccagagtgcagggatgcccctgcctctgctgcctccatgcctgtgagcaagaataggcgagacccagggtgggcactcagccaactgctgagcaaatgaataagtgagcacgtgagcaagtggacagatggacagagagatggatagatggagggagggaggaatggaacaagggagggaaggagggatggaaggaggg

SEQ ID NO: 4727 - DNA, 2534 bp, Homo sapiens
gcgttcttttcgaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 4728 - DNA, 2173 bp, Homo sapiens
gccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagaagactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaagggtgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccatgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagcccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgt

SEQ ID NO: 4729 - DNA, 2156 bp, Homo sapiens
atatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgatgaactgcaacagtatctttttgtcaatgttccacataatgcaaatgccatacgttgtgtgaatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccagtgctgaagatgctgcaagcaccaaatcatagctcataaaatcaggtcctgagatagttacccataaagaggaatcctttgagtgtatgccattggtgagccgatgagcatggaccatagaagggctcaatgtagaagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactatta

SEQ ID NO: 4730 - DNA, 5163 bp, Homo sapiens
aggctggctgctctaagttgatctggtgccttggtcactcgtggcttctttcttctatgccagctctgtcttctctacacttcctctggaggagtaggccttgacacaattacaagaagtcagggaccctgaacagagggaccagctgaagtcacagcagaagaacataaattgtgaagatttcatggacatttattagttccccaaattaatacttttataatttcttatgcctgtctttactgcaatctctgaacataaattgtgaagatttcatggacatttatcacttccccaatcaatactcttataatttcctatgcctgtctttaatctcttaatcccatcatcttcctaaactgaggatgtatgtcgcctcaggaccctgtgatgattgcattatctgcacaagttgtttgtaaagcgtgtgtgtttgaacaatatgaaatctgggcaccttgaaaggaacaggataacagtgattttcagagaacaagggagataaccataaggtctgactgcctgcaggaccgggcagaacagagtcgtatttctcttcttacagaaagcgaataggagaaatattgcgaattcttttctcagcaaggaatagccctgggaaaggaaagcattcccagggggaggtctctaaaatggctgctctgggagtgtctgtcttatgtggttgaagataagggatgaaatacaccctggtctcctgcagcgccctcaggcttgctaggattaggaaattccagcctggcgaattctaatcagaccagttgtctgctctcgaaccctatttcctgctaagatgtttatcaagacaatgcgtgcccagtgggacatggaacctcatcagtaattctaatttcaccctggccctgtgatctcgctctgcccttctgcgcttgtaatcttttattgcctcttgaagcatgtgatctgtgtgatttactccctgttcatacccccttccccttttcaaatccctaataaaaacttgttggttttgcggctcaaggggcatcacggaacctgccgacatgtgatgtcacccctggaggcccagatgtagaatttctctctttgtactctttctctttatttctcagactggccgacacttagggaaaatagaaaagaacctacattgaaatattgggggctggttcccccaatactttggttttgtttttctttttgttttattttctgtatgcgaaagcttcaagtattgatccaacatgttttctaatataagcatttagtgctataaatttccctcacagctcttgggtattggtataccacacatttttatatgctgtattttcatttgattctgggtagatacttttgttattctttgtttgtttgtttctatttcccatgagatgagacttcttctttgacccatggattatttagaagggagttgtttagtttctaagtgtttggaaattttcctgttacctttttcctgttgatttctaatttgattctattttggttagaaagcatattctgtatgatttcagtttttttaatgtcacaggacataattccaaaagtccctgtggacctttctcttctgtttttgtctcccttctctctgttggtcagggtagtttctctttccaggttcactggttctctcctctctcctttccactctgttgtagagcctgtctactgagctatttatttcaattctttcattttgtttgaaattttatttgagatggaatctgactctgtcacccaggctggagtgcagtggcatgatctctgctcactgcagcctccacctcccaggctcaagtgattctcctgcctcagcctcctgagtagctgggattgtaggtgcctaccaccacacctggctaatttttatatttttagtagagacaaggcttcattatgttggctaggctggtctcaaactcctgacctcaggtgatctgcccaccttggcctctcaaattgctgggattacaggcgcaattattccatgtttttattcttttcttttcttttttttttttttttagacagagtctcgcactgtcacccaggctggaatgcagtggcgcggtctcggctcactgcaagctctgcctcccgggttcacaccattctcctgcctcagcctcctgagcagccaggactacaggcactggccaccacgcccggctaatttttttgtatttttagtagagacagggtttcactgtattagccagaatggtctcgatctcctgaacttgtgatccccccgcctcggcctctgaaagtactgggattacaggcatgagccactgtgcccggcctcatgtttttattcttaaaatttttatttgatttttctgtgtgtcttctattttacttctatttttctaccttttcttttgattcaagcatttatgtaattgctcactggggccttttcatgggatgtgctttaaaaatctctttttagagagccctgggtggtggggtgagcatggaagtctgcctccctgccccctccttagctgaaggtggtggggatggagccacatttttttcctgtggtgttttcctagagttgggtggttactgtctaaaagttttctggcttgttaggctgatcctttagtggggcttttttttttttcctctatttccattaccatttccaggttgattcttcttcagctccaactatagaatacatgagatgacaaaaccacccaagtcccaggggccttagccagcctgcttttctctacctttcatattcatcttatgtttgttttaaatataacttccagcattgttatctacacttaataggagaagcagagaaaggtgtttactccattttgtctggaagtggaagtccattgtttttattttttaaagtattttattttacttagcaatcagcagtacatagtagtttgacaaagcagaaagtgcatgcatttccctttcagtgttaactgtgaacacctggctgtctctcttcatgaatatttatggagataagtgttgggcattgtagtaaggcgaaaagagagatgaaaagatgaatggatgaagagacagaaagaaaactggcattgtttagtaataaataggtttaataacaaaaaaattaatgttactcaaatttaaaaagaaaaagtaactagagaactaaagaaattgctgttcttcaagagaactatattgaacaagaggaaatccttgttttgtaatatttctctatgagtgaaagaaagaaggtaagacagttatgagagactcagtatgtttgtgtccacatgattagacattcaaccttgcttacatttcttctccctctcttttgtcctctatggactgttttttaaattgttgtaaaattatttttactttgtcaagatttacttatttaaatttttgttccggacccatatttattcctgtaactgtttttctcaatttaacatttaaattctcattataccatgtgttctacattgatcaattaaatggttccaaccaccctcttacaaggacaaaaaagaaaaaaatatgtctggtcttaacaacaatgtagtaagccaagaaagaaaaataaaatgtataaagattggggtaaaaaaacagccctcattaccattcattctgtagtaattttattccctagttcttcattgtgatcctcccttttttcttgggtaggggggtggatttaagtatcaagtagttaaaatgttctcctctcaacctgtatcttgaataatgagaagaaaaatgttcttctctttgtctttgcacgtttgagaatccctactaaatttattagctccataatacatttttgttctcagagtaattcatagcttttcatctctctttttaaaaaaatcatgttgggtggtgtgtatttcattaaattcatgtccttattgaattactctatagcacaagcatttttagaagatttcttgtattccttggatcttagttttcccagaatgtgttcttccttggatgtttttcataccatgttctttctctcctgtattggtgttatttctgtgcataatgataatgacaggatcctttttaaaaaatattattgatcctaacgtggctggttttagccagacctctaattggctgtgattagtacagatgggttcttgtagacactcctccaaaaatatttgtgacatctgtcttctaagctgcatctaatgcatttgatgttgcattctctgttcctttttaatagcagaggccttggggtaggggatgggagaacctgtctaagaaaacctttagctctttgttgtaggcctgaagactgttctttcccctctcaactttgaataaatactcctggggtctcattctcccaactctacatattgcctcaaaaattggcaagcccctggcagcccctcccagtgtctgcagaagagtagtgtataagggcttctgctcttgatggtgtatttccttgatttttcctctcaagctgcctactctacctgcatctccccatcttttaacagtgcctattaaatgatggcccatcaatattgttactgtaattcctaaactgattttcaaagcattcttatttttttctatcagagataaataaatcatttaggaagagattcatttgaacattcttgtttataagccaaagggtttccaaagaggaatagtttgaagattgacaaaaatggggataatttgtgagagtgaatgcctggagagtatcagggaacatctagaacatacaataagaggatacatggaagggcaacttttcctttgagacaggaagggaaagacatatggatgaaatgagtgaaattatacagagttgggatttcctcttgatggcttcttcttcaggtaaccacagagtctgagcactatcaaaaattcttcctgggccaggcatggactcctagtggattgcctgagctcaggagttcaagaccagcctgggtaacatggtgaaaccccatctctactaaaaatacaaaaaaattagccaggcctggtggcatgtgcctgtaatcccatctacttgggaggctgaggcacaagaaccacttgaacctgggcggcggaggctgcagtgaactgagatcgtgccactgcactcta

SEQ ID NO: 4731 - DNA, 1290 bp, Homo sapiens
gaattgcatttctctggtgattagtgcagttcagcaccttttcagattcctgttggccatttgtatgtcgtattttgggaaatgtctgttcaagtcctttgatcattttaaaactctggttatttgttttcttcctactgagttgtttgagtttcttatctacactttagatcataacaaccccttctcagatacatggtttgcaaatgtattctctcactctgtaagttctctcttcactgtattgtttcctttactgtgtggaagggtttcagtttgatgtaatcctattttgcttttgttgcctgagcttttggagtcatatccaaaatttttgcccagaccaatgtcatgaagctttttccctatgctttcttctagtagtgttacagtttcaggtcttatgtttgtctttaatccacttttatttgatttttgtatatggtgtgaaatgaacatctaatttcattcttctgtatttgaatatccagtttttccagcaccatttattgagtaggctgtcctttccccagtgtgtgttcttgggacctttgttgaaaatcagttgactgtaaatacatagatttatttctgggttctttattttgttcctttagtctatgtgtctgttttttggtggtaccatgctgttttggttactacagctttgtagtatattttggagacagacagtatgatacctctagccttgttctttttgctgcagattgctttggctatttggggtcttttgtggttccataggaatttcagagttgttttttcaatttttgtgaagaattttattagtattttgatagagattgctttgaatctgtaggtcattttgggtagtatgagcattttaatattaattcttccaaaccgtggacacagcatatctttccatgttttgtgtgtgtcctcttcagtttctttcgtcagtgtttcaacagtgttttccatgtacagatctttcatttccttgattaaatttattcctaagtattttttattcatttattttattttattttattttattttatttatttatttatttttgaggtggagtctcactctgtagcccaagctggagtggcgtgatctcgactcactgcaacctccgcctcctgggatcaagtgattctcgtgcctcagcctcctgagtagccgggactacaggtcacagaattttccacactccttgacagaggtgcttaacccttatccatcagcattctcagacagcacctccggttagggacagtatctgaccgtccgacatcc

SEQ ID NO: 4732 - DNA, 2062 bp, Homo sapiens
agggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagggaaagaatggacattgacggcagagagcaagtttagcctggagaggaggaattgagtgagcaaagggggtagtctggggtgcgatgcacagaaaggcccgtccagggtaaccttcacgtctccgtatccgttgctgtcgactttccagagcctttgttcccagtgacgtccctattgcaatggagggacacacttcactttccccagccccccacctcgagaatttctctcaccctcccaccctgcggggccgcagagcttgctcctcacggcaggagttggagccctgacgcttgccttcacctagtttttgtttggtttggtttggcgttgatgggacaaagtcagccaaactactttgccatcagcagagaaggttcatctatgtgaagaatatttaggaggcctaaatattcaaggaaaggaactttgacttgacctctaggaatcactttcatctgcctcccagaaagaggaagccaaatggccagccaacacagaccacgtctagctctgagaacttcctctttaaaagcgatctcttaattcagtgttgcagaaattcctggatcgatctatttccctaggaaataataagtaataggaaagcatattcattcttaattctttaattcacagtgaacaagagcaaatgccatgtggtaaactgcatgttatttaataagagtggtaaagttagacaaactgatcgattatgtggtagttattcttaaagcatatttattgtccattctgcattacctaatggaacaaatgactcctttaatataaagaaattacctgaaaagcatgtatttaagataatgtcaattccgcatgtttcttttggctgaaaagagaaaaagaactagaaaaagcaacagattgaattcctctgaatgagtcagaagagtgggagatgtgtaaaaatcaggacgagggtgacagcgggataccagagtcctacctgcatcagtcccatggcctcagcccatgtgatccccacctcccttggataccagatttcaagtgaatgagatgctgctttatccaatctactgactttggaaaatccagctgaaatgaggaaagataatcgtgcatgtctggcaaccaggtaatttctttcctatctttcatgtcacagtattttgaggacacaaattcctaaatactcagaaaaaaatggttttatcttaattgatttataaattatgttagggtagttgttaaacagaattttgtcaaagaagcagtacactgtaacactttcaggctcccattggtttaaaatttgataagtgtatttctttgctgacaagtcaaactgttcaaatgttatggaggactaaaaaggcctgggattcacaggctcattttttgttttaactgaatcatgaaaatacacaacttttttttttccaggaaagacagatgttatttaccaccaatgaatttttatcatatttaaatgaacttgaaaatgtcattcaactcaaatccctcaatcaacttacttcagcccattctgaaacttcatattgcagcaaaccagccatgtgaaagaaataaattcaattttgactttcaaaaaaaataaatgctgcataagttacccttgtggaccttagctattaaggtggacaatgactttattttctttacgtaagttttatattttattatgacattcattttttctacatgaagacacaaataaaaattataccaactacataaactatttt

SEQ ID NO: 4733 - DNA, 3123 bp, Homo sapiens
agagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtca

SEQ ID NO: 4734 - DNA, 17357 bp, Homo sapiens
ggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttt

SEQ ID NO: 4735 - DNA, 9361 bp, Homo sapiens
gtttcttcgggcagggttcagcagcttctgtcaccagttaggtttcgtgagcttccttcccgtgtagtcttgatttcatcacttgactcacttcagcgcagctagtggtttccgtttctgtacgcgggcgctctggtaggggcgcctcacgtccaaaggaggagtcttcttccaaagaagagcctttggtatttggcagagcctcgccaatttggggcgcacctccccttcctgggatgctctcagaaggcaaaccaattcccagaagagagggaaaaacagccacaacagagagaacctttgctgtccctgtttggaaagagattgggatttcctggagagggcttgcttctactgcaggtttgtttaaaagctcaacatctattctggaagagaacaacgcagactccaggaagatggtgggttttgctgtttttaagacaaaaaaaaattgttaaacagtatttgttccatttatgacacaactttctgtttcagccttccttctgctgctgcaacaaacattgacacacccaaaaccaggacttaaaatggcctttatacctttctatgaactcatttctttggccctatcccaaagatatctagggatataaatagaaaactagctaaaaactttttggtgtcgtgtttaatcacatggtggtaggttttactatgaagtttagttgtggccttcctcctacattttgacatgctcttatggtgcttattcactgttttattagtgctatgcgtgacctaaaaataaggtttaaaatacagtttagtatagtatcaacaagtgtatctttagtatttgactactctaagacattggttttagcatccatagtgctattttatactaggacatctatgagttagggtttaagactttagtaaactaggtagttctttgcttgttttacatgtcatggttattttgcgagcaccaaggaacctccatgtatttgcaacattttaatatcagtacctacaagcaattgccaagctccctttccctccaaaaacaaacaaacaaaaaaatagttcaggagatacttgtgtgtattgatatactaacttggcagtgtttttccttaggtccaggtccagaactgaaaatactaactactgaaattctcttctccttctccttcttcttcgttgtgccactttgtcgtttacccctaaccagaggttaatgttagtctttggaaaatttgtaaggtatcctaaatgtataaccaagaaacctgtacccttttgcacgcaccacccatctctgaatgaagagccaaagattgtcagagttttgatgtcccaccaggcgaagagcaacacttttcactgacaatcaggacagagcagatggatatagaataacaatctggaatccaaggactgagatgcattgacagcaagactagtaacgtcaaataacaactgaaaagagaagctagggtagacctattaaaagagagagccagcaaacaggaccaaaatgctggatgaggagtctaaaaagaacagaagaaacaaaaaagatcaggagttactaaaatttgactgtcagttttacaatggagacagacaatttaaagaaggaagcagtttttctgagtgtggcattacttgtgcacgttgagtgtcatatatatagagagagagaaagagagagagtgagagagagtgagagagagagagagagagatatcttggggatgagacctgtctaaacacaaaattcatttatgtttcatatacaccttatacacatagccttaaggtaattttataaaacattgtaaataattttatgcatgaaacaaagtttgtgtaaagtacttatgtgtggaattttcaacttgtggtgtcatgttggtgctcaaaaagttttgaattttggaacatttcagattttggatctgtggattagggatgctccacctgtactattttacacaacgttgcttgtactatttcaaagcattctgaaagcaaagtcttaatattaataaaaaattttctatgtgacaataaaattaaaatgctgcaggcccaagaaaaaaatattatcatattgaaatatttaatgccccaaatctaatcagatgcaggtttttgaaagtaccatcctattcaaaattatgaaataaagaatttgtttcataaagagaaattagcatttcatcataaataaaatccaggaaccttagtgtagacatgcttcagaaataagctaattttaatagtatatgtttgacatataatgacagttaagatagaaaactgggcagattttacacaggaaggaaacaaacattctctctctctctctctcacacacacacacgtacttattacacacacacacacacacacacacacacacacacgactagccacaaaatgctcatttgcatggatttgaaacaatactcactccttaatactttctgttaacatttaaattaatgccaagaccagcacctggcacttagtaggtacttaataaatatgtgttaaatgaataaattgacccatcaagtaccataaaaaaaatgcctagtgtcttgagcaatttacaggtctaaagaatggttttacccaacagtaatgacaaataatccaaggcagataagaacactagactggtaatctgaattgcaaagttctaagaacaatagctaccagctttcacatacctacatttcaaaagacactacgcaaaacaacttacactcctacaaattactttacatctggcttaaatattctcttccacaaaacaaaatagtggtacaagatgatctacaggcttctttacattctgattcatataaactctatgccaagagaattgggcaaataaataaataaataaatgaaaccttctggatatagcaataataattaatgggacagcaaagatgaagaaactgaaattatttagctgagatcgaaattttaattcataaaaaatagttgtaatatataatgtaacaagtaaatgtgtaaagttactaagcctaactttaaactattttagtttgttaattgtttaattgttggttacacaactttgctttgaaacatactctagaaacagttttgcctcatgagggaactagagcttttagtgaggatctcaaagtcagactgagagatttggctcaaagactgaacagactggaataatttcttctcaaagcagtaaaagtgttgaaatgctattgattcaagcagagaatagaggtggtatcacagtgaagagccacaaacacgtgggtattttttaaataatgatccaacataattctacattgtgtttaaaatatagcaagttaaaacagggaaaatataaataggttattttagtatgaacttttttggacattgttttatatgattcttccccctgtagaatctcagaacaatcatctcagattttcaaagtggttcacatactatgaggggttgacttagattacaacaaaactatgtcttgctaatcttgtattcttagtacttggcacatagtaggcactcaataaatatttgatgaaatgtattgaatagagtgcattgtttcaagcttttaagcattagcataagagcaaaaagaaatgtcatgctgagtcagaataatattcaatctaactggctctaaattctgacagtggcaccaaagaatattttgtggaaaactatggtgatagtcttgcatgatgttgacctcagtgatgtactcgagtatccctcactcactcttttcctaaattgatttctctttttctgtaacatgtttctttaaattgaaaagaaattaatattcattacagagaaatcagaaaatacacataactgcaaagaaactagctttgaaatactcagaattccttataccaagatgaatcagtgctatcagaccctttctatcatgtatctttgcagattttttttattgaaaaagttggcaggaggcacggcatggaatggggaacatagagggatacagagacaggtttgtaaaataaaaactagatcattctggggacttgttttgtagccagagttttctacttgacatataattaaatgtcaataaatttattttacagtattattttaatggctgcctgatatccctttgtaaggatttaatctgtcaattactgttggacaatgaagattgctcccaaattttgctattgcaaccagtgctataatgatcatactcttcatctgttgaaacatttattacgattttcttctaattgacttttattttgtttttgttttatatagagatgggggtttcactatgttgcctaggctgcaattgaactcctgaactcaagcaatcctcctgtctcggcctcccaaagtgctgggattacacgcatgagccaccaggccagggatatttttgtcttttgagacagggtcttgttctgttgtccaggctggatcacagtggtgcaatcatggctcactgcagcctcaacctcccaggctcaagtgatccttccacctcagcctcctgaatatctcggactacaggcatgtttcatcatgtctggcttttattttattttattttattttttggagagatgaggtcttactatgttgcctaggctgttctcgaactcctagactcaagcaatcctccttcttcagcctactgtagtgctgggcttataggcaggaaccaccatgcccagccctgacttttattaagccacattgtgtcaattatccagatcctaaactatgacaatgtcattagaggcatcatatcacaaaaacaagaggtagaatacctattaacaatttacaattttctattggtaagaaaaataataagaatattaattctagctaccagaccttcatacaaagaacgttctattcaatgaacaccttataattttagaaatatggaaatagaatacgtcacttattttaaaaaaaaactcagatctcttattttcctctgatcataccacagtcagtttcccacctgtgaaagtctttgtatcttctaatatgattttcttccccctctccaaatcccctccagcccaactgaagaccctagtctcccatggagtcttgatatggtttggcggtgtccccacccaaatctcaccttgaattataataatccccacatgtcaaggattggaccaggtggagataattgaatcatggtggtggttttcctcatactgctcttgtggtagtgaatacgtctcatgagatctgatggttttataaattggagttcccctacacaagttcttcttacctgccaccatgtaagacgtgactttgctcctcattcgccttctgctataattgtgaggcctccccagccatgtggaactgtgagtcaattaaacctttttcctttataagttacccagtcttgggtatgtctttattagcagcataagaacaagactaatacaagcctcctggatcagttcaaatcaccttgatatttcttaattccaatgcattggcataaagtaaatttccttcctcccttggccctcacctctctcttgactccaataagggagagttgtggagagatggtacctgggtttgatataatttgttgccagataagttataataatttgttaaggaattcaagccgtagaggatgaggatgctcttttagcatattaggtttgaggtaacaggccaaaaggaatagcatttggttattaaggtaaaaagagaaataatttttatgcatgttagaaggggaattttgaaggaaattacactttttctgtatatttatatattttactttttatttaccaggagaaaaggcatttgctgcccaaggtagaatcccatcaccatactcctttcctacatccaatcacaaaatcagaatatgccaattctctattcccaagtaagtcaacagaccctaagattacattccctttctcccctctgcaaagcttcagggacaggagtccctgacaggcagctgacatttggggttgcatacaaaaagtcaagtcattgcaagagaaggaagtttgtttctattggaagagttagtgtacaacatataaaaacggagtgaggatggggatattgtagtagggagggggttaaagggcttagaaaatgatttttttaaaggtggacaggggaagagtagaaggcaaaaaaatgtcatccatgtgggacatcttctgaacgcccaaggagaatctttggggatacattccccccaagatttaaagaagtggcttcactcctgagaatgtacagggagcggagaagctaaaccaggagcaacatccaatttctttgtctctccttctcttctcactgcaaactctgtacaggtttggcataactatctaaactttctagtaaaaatcatagccttcatgaagatccattgtgtatttgattcacagaaagttggtattgaattgtaaaacacggctacaaatttctccctctccaacaggcgtgtcattttggaatgtgtcttgctgctcttctcatcaaaggtaaagtcctcttcttcaccttttaacctagagtagctgtgcaactttctttgaccaatcaaatatggtggaagtgatgttgcgtgacttccagatataagtcttaaagagatttttcactttctgctttcactctcttggaatgttgccctgagatcaccacaccatgaagaagtctggggcgaaaggccatgtggagtgagaggctcagcttcccagatgatctcactgagcacagcccccagccacctgccagctcaatgcaacctggtgatggacccaagcaaataccagcagaagaatcacctggtcaacccacagaatcatgagaaatactaatttgttgttgtcttaagccagtaagttttgagagagtgttttaactgtttcacctaagtttggtctcttaacatgaacataagcacttttttgcatttgtacatcctttgtactcttcctgttcataccgagaaagcttttgcaatgcaaaagctcaaatgtattggaattttagaagtttaagccttgaaggactctgtacaaaaccatgccaaaaaccatatattttgaagaatatgttctcagtctgagccagttttctatttccacctcaaatcttgattggtgcagactggagaaaggagaagagagtcaggggtaagaccgtgggtcggaggtggatatcgacaatgtacctgagtaaaagccctgtagcctctcaccatgttggaataccatatggcacaactacatggaccgccatttacatagagtaggatgtttagtactgcgtcttgacctttgaaaccagactggtgagaggactcaccaacaaaagtgaagctagggtcataggccctaccttggagattggtaagaccccagagttattccttgcccaatgttaagtaagaacagaaaacatttctaaagagggtcctgaggcagacaggtcttaagcagtcccacagccctcatgtgccctagaaagatgcagagcgcccagaagcggtttttcagtgcaggtgagaatggtttagatccacatgtttttgtaaattagtttttattggaagagaggcaaacccatacatttacctgttgtctatggctgctttgacactacaatagcagagttgggtagttgtgacagagatcatatggtacacaaagcctaaaacatttactatctggtcctttatttttaaaaagtccttatattagatgaaacacaaagaactggtaaaacttaagccttgtgtaataatacaaaacaaaaatataccatgtagaccataatcaaagggcccattgtcttcagccgctgacattgggaccagggtgtagtgtcagaacatgaaagcctggatacctacaatggcctaattttctcatacaaatgcatcctaccactcccatcccataccttatgctagataggatccatggaattagctgcatctccagtgaaacaggaaaagtccctgattttactgagatttagctattgtcacatggtgtaacagggatttaagagaaaaaataacctcaggtatagacataggaaaataatgttagattaagtttcttatacacctggttctgtcttcagaaactggcacccactataaagccttccatagtgataattatcgcacaaaatcgatacaaaggaaatacctgctgaatgttctgcctcagtaggttttcctttggtcttttaccttagaaaactgcatgatagcatttttctattattttgacatttcatgtaggaagcatgttattcacaacttatgttttataaaatctttttctgatgatgatgatgatgacacttgttaatttccatctccttccttcactgtaagtttttctattccctgagacaactatttctctcacttgtcctaaaccccaaggatacaagagatgcataggaaaatatctatgaagtgtgtgggaggagacaacagggcagggttccagaggtctgtggtttattgcacgtaaaacactggaaagtgctttggatgataaggaagtagcttgttgtcctttgcaatggcctgacattcttacactgagaaaatcttactccccactttgagctgggatgtgggagctgggaggacatttactgagtattaactctgtgccaggaattattcctacattatctcatttagtctccggaaaaccctacgtaacaggtgagaagacctcagtgacaagctcaaagatgcatagctaaagagctgaaatgtaaaagcaggtctgccagactcaaaaacccatgctctataaactacatcatagaagttgtaaaataattttaccttgaatccaagggtgaataatttgtcatggttagcttgccctttggcattcataaacaatttctactgtcccagtttttgttccattcatataggagtaacatgtggaagtattaagcaatagaaggctttgttttcatgtataaatttttacgatattttcaaatataataaagccaaaattgttaatttcacttcatgtagagattccttcaaatataagatgctatgaaacagtgtcataccaaaaagcaaacacactgatttctataatcaaaacattgaggaacacaggaaactctagataactcagaggaaaaagggagtacaaaatcgggttgacacaatgcttcatttaagaataggaacattgtttgttcatttgggtactttataactttaagtataatgaggtttctttaaaaaattgtaacaattttggtataattgtataataac

SEQ ID NO: 4736 - DNA, 639 bp, Homo sapiens
ttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggttcgttgcgggaaatacagtctggttttgccccccgtatgaattgagggaaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaa

SEQ ID NO: 4737 - DNA, 510 bp, Homo sapiens
tttgttgcactcaatgaacaaatctttgttgtttattttaaaattcaagacaatttttttgcaaatgctgattcaaaacgtaccaatccccatctatcatgcctatgccaatacaatctgtcacaaaaaagtttgcttctcattgtcacatagctatggggactggtggccttctaaaatcactgtccagctgctgcaagtgtgagaagcggtaagctagaggagacagacggcgttgccattaaaaacaattcaacttcattttaatgttgctatgtaagttcacaataaaatccctggaagttcaaattggaaagagcagtttggggtcatgggctcaacaatataaaggcagattcagtgaggggtaagggtagtggctctgggggcagactgacctagatttgaatgccagttgtaccagactcaagacaccttgggtaagtggttttatgaagtacctcagttcttcatcagtagaaagagtgctaacacctccataagactttt

SEQ ID NO: 4738 - DNA, 2662 bp, Homo sapiens
tggcacaggagggctgcacataccagttcctgtcccgaatccgggtcaggcccagtttctcctggatctcgtggggtttcatggcatcgggcaggtcctgcttgttggcgaagatgaggattatggcgtccctcatctcccggtcattgataatgcggtgcagctcctggcgagcctcatcgatgcggtcgcggtcggcgcagtccactacgaagatgagaccttgggtcccagtgtagtaatgccgccagagcggccggatcttgtcctggccgcccacatcccatacgttgaacttgacatttttgtaagtcaccgtctccacgttgaaacccacagtgggaatggtggtcaccgactggcccagcttcaacttgtacaggattgttgtcttgccggccgcgtccaggcccaacatgaggatccgcatttccttgttcccgaagattttggatagcaccttccccatcgcgtcggaggagccggggccgggggcattcaggtgtcccgggtcccctcagccaacaacgccgccgccgccgcgaaaccgaaacgaagcctctcggccgcgagagcgcctttgcggcctgcgtgggagttgcctcctaagggcagaggcccaggccccccgctcactcgggcatcaccgaccgcacaacttgatttctccagtcgccgccgccacccgggccctgagactgcgctgggagccgccgccctgctgaggcgcggcccggcccggaactgcccttccccccgcaggcgccgcgcgagcgccgccgcggttcccgctcctccgccttcctctcaccgcgagggagactgcagccctccggcccgcccgccggcctgcgagcactgggctccccaccgacccaggacacccgagaggcagcgcggctccggggccccgtcaggtcatggatcctcgcgggaactcggtgcgctgcctgcagagaaacagagagggaggggagttactgccagagctccacaaaggagcgaagaccgaggtggcccgcctttccagctcggcccaaggggttacctccagccgccgccccgagcgcgggctccctccggcctccaactcctcctcccagttctgccgccgccgctgccggaaaaggcgccgaggaaaccgcctcacttcccctcccgaccacgcaggcgcagcagaggccgaccgttcggacaagagcgacctctgtaaggagagcggcccgcgcgcctagcgtcatgggcgccacgcgccggaggggcggggctacggcgcctcggagggctcgcagatgcggccggcccagagccctcgaacctcggactctgactcgcgcctacccgtggctcttctagcgtctccttccctgcttttctcttttgcgctctgccctcccctgcccacccgaaccaagggagcagatctactggggggccctacagggtggggcccacgggcagcccgctctctccacgaaccgagctgcctccaggcctgttcccagacctcggtgcccgccagatgctctgcgaattccctccgcccgccccagccttcccgcaccctccgcgctccctgaacgtcccagggaagctctgttcgcttttgttttttttttttttccctttttcgcaaccccttcttggcttcctttatcccttgaattttgtatgtttcctgaaagacacgtgggaggccagtgtctcgtgtggaatctgccagtcagtgcagcgctttcccggagttgagtttactctgcagctcttttgaatgtttgagccctgtctgcctataggtctcgtcaagaccagcccatgtttcttaaaaactgcagtattatgaagagttcctgtgccttgccgcgttttcacctttttagaatgcgacatctgttcatctttaaaatatcattttatctcatactgttagtagtagcttcttaactactacccattcttaactttaagaagcatagaatttagaatatagaacgaccgcttgtatggcctggatctgggcacttaaccttactaagtttatctcgtgtaaactgaccttgctaactcacgtgaggcttaaataatacaatgtggaagacttcagggcacatttttggttttttggtttttgtttgtttcttgagacggggtctcactctgtcgcccaggctggagtccagttgcacaatctcggctcactgcagcctcctcatcctgggttcaagcagttctgccttagcctccggagcagctggaattaggtcgcccaccaccacgcccggctaatttttgtatttttagtagagacggggtttcaccatgttggccaggctggtctcgaagtcctgacctcaggtgatccacccgcctcggccccccaaaatgctgggattacaggcgtgagccactgcgccctgccaaggacacatttttgtatcaaatggttaatgataaaattagacttaaaataacgtgaaaccttcaaatatcaaggggagaaaaacaggaaatgggtatctttgtttaaaaagcaagatgctataaacagcatatggtaacatactgtttttattaaacaaatttaaaatattagataatggtagataggttatatgataaccttataaacgtcatttcagtcggaaataaacttattaaacat

SEQ ID NO: 4739 - DNA, 1242 bp, Homo sapiens
agctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 4740 - DNA, 3696 bp, Homo sapiens
atcaagggtgaagcatggtggctagcggagcccgcatcctgacaggtgtgctggcgtggccctctacctgccccgccgcggcggcctgcggccaggagaagtaggctggcgacatctggcgggccgcgggccgagggaggggaggcggggcggggcggtgtctccctcacgtgaccccaacagcgcccagcgcgtcgcgctgcgccccaacctcggggtcggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacagggtttctattgcctgggctggagtgtagtggcatgatcatggctcactatagccttgacttcctgggctcaagcgatccttccgcctcagcctcctgagtagctgggactacagagacggggtttcgctcttgtgaccaggctggaatgcaatggcgtgatctcggctcaccgcaacctccgacctctgggttcaagtgattctcctgcctccgcctcccaagtagctgggattacaggcatgcgccaccacgcctggctaattttgtatttttagtagagatggggtttctccatgttggtcaggctggtctcaaactcctaacctcaggtgatctgcccacctcggcctcccaaagtgctgggattataggcgtgagccaccgcgccggctgccttaaatctatttatctgacgttcccaactaggaaattttttgtccaaatgagtatatgtgattttaaagtagaaatcgaaggtaaaataggatttatctcagttcctatctcccttcaatctattcttcatattgtcaataatttttttttttttttttgagacgtggtctctgtcgccaggctggagtgcagtggtgaaatcttggctcactgcaccctctgcctcctgtgttcaggcgactctcctgcctcagcctccggagtagctgggattgcaggcatccgccatcacacccggctaaatttcgtattttttcagtagagacagttttgcgccaggctggtctcaaactcctgaccttaagtgatccacctgcctcagcctcccaaagtgctgggattacaggcgtgagccgccgtgcccggccatcagtaattttttaaaatgtcacttcaataaatgcttttcctctgccataaagaccaaacatcttgctgtggcctacaggagacaggatgatccagcccttgcctcccttactctcatctctagctaaaactgcgctgctgtctctgcactccagccactggcacttcctgattacttggggcacgctgtactcatcttgctcccagcctctgcccatgcaggtgccctctgccctcagcactgcctttctctacttcatttatagactgctgtccttcagatctcggttgaagtgtcacttccttggggaagctggcttacactctcaggactcggttaggttcccccgtcaggctcttctatgtcaccatgtttctatttttcacagcacttaacctgttttaattacgttgcaaatagtttttgtttgggtctagagaagcatgtattcactagtacattttatttgtgttctctaattattttttctgcagctaaattagaaatttgtagttttccccctaaaaatgcaatgatgttttctctgattttcttgtcacctttcttccaaaaaatccatgtgttcaaagtgcttgcttgcagtttgccccataataaatggttgtttaatccaaatatctgagtagcaaactgagctgatccttctggagaaagtatggttgaatagccgagaccactgagtagtcgcagagaagaccacacatcctgaactcctcagtctggtgtgaggggaggacaatagataactggatgtgtagtgttcccaaacatcactgatcccaaaccattgcttctgcctgccactgccacaaatacagtacgactgccaccccttcatactcagctttaatcctcagcatttcttctggtcctttatgtgcagatgttactcaaagtctacatggaatgccaaaatttccacaggccttgatttttttcacggtgattaagatcagaagtagaacccatcaatactataacactgcactgactttctgatttcaaaagcaactctactctctacaacccacgcaaagtttttccttaccatttggaacccttcaggagttacactgaagccttgataagactgtttcagccaggagtggtggctcacgcctgtaatcccagcactttgggaggctaaggcaggaggattgcttgagtctgggcaacatggcaagactggctctatttttttaaaataacatttttaaaagtatgattaaaagactgtctttctattggctttgctcccccgatggtgagtgtctctaggagtcattatcaataacatcagtgagaatttctttgctggtcacatgaacaccaaattcaatcttcatatcaaccggtgtacagttctgggagcaaccgggatttctccgggatttcaaaaacagcctatgtggcatgactcatgatatccacttcagttttataccaagtgcagcaaagccaaattttgctgcaattagctgttgcctagaccactgtgggtcatgattggcatcatccttgaaaaacatctccactttaggtgggcaaaactcacatccttccttgacaccaggatttctttcgagtgaagaaccagttggtattcttctgcaaaccattcagttggaattatttcacactggggcacaatgaaagctgtctcctcacattttctggtgaaagcagttttaatacctgcttcctgtaacaacagaaaaatgcaactggtaattttatttgagattgcagcttttccttccaggtgattctgactgcatttcctgctgtaatctggtccttagattgcaggacttttcctggcctatctaacaagcaattcatagacctcttttgttttaccctcacatagttttttagcaatgttcagtacctcagctctcactattatcctgagtgggatgaaagttgcacccatgctgagaggcagaaatctctgttgtgaatatttgatacctcttgctttatttatttatttatttatttattgacacagattctcactctgtcacctaggctggagtgcattggcgcaatcttggcccactgcagcctcagcctcccaggctcaagcgatcctcccatctcagcattgccagtagctgggaccacaggtgtgtgccaccattcccagctaaattttgtattttttgtagagacagggtttcaccatgttgcctaggctggtctcaaacttctgagctcaagtgatccacccacctcagcctcccaaagtgctgggattacaggcatgagccaccatgcctggccctgttgcctctttaaaaagccagtcctggcagggcacagtggctcacgcctgcaatctcagcattttgggtggccaaggcaggaggatctattgagtccaggagtttgagagttcaagtccagcctaggcaatatagtaagaccttgtctc

SEQ ID NO: 4741 - DNA, 384 bp, Homo sapiens
gttcacgcccatggccaggttgcggtcgcagcggtaggtgtcgaagccctcagaccgcagggtgagctgcaccaaagagacgtgggacgagtccatgctctgcaggtttacaccgctggagctaatatcccagcaggcctcgttgatgaggtccttgagtgcctccaacaccttcttgaggatggagccctggaccaggcgcgcctcgaacatggtggcggagtggcaacaacgccgctacaggcaggcgggaaggaggaaagtctagctggtttcggcttcaggagcctcagagcgagcgggcgaacgtcgcgacgaccggctgagacctagaaagacaacgaccactctgctacgcctgcaaccgtttaatgccgccgcgtc

SEQ ID NO: 4742 - DNA, 418 bp, Homo sapiens
tgctgggattaaagcaatgagatggtgccagaccccccaccactatcctcaccctccacttgtcttcttaaaactgtgaaaaagcttttaacatggccctcctgtctccagggctgctctgaagcctgactgagaggaggcacctggcagagacaggggctgagggagggagcgagggatagccaggagaggagcgagggtgctccacagcgacctcagcaggtggcctggtcttgcccactccagggctcccatccttcctttgggctccgctctaacactggtggctctggagggagggtgggacccatcctttttcaaaacctttcctgaagaccacaggggagctagccttgcaggctagggagcaagagtggcaacaggccaaggcgagcccttaccaattgggaatcccact

SEQ ID NO: 4743 - DNA, 272 bp, Homo sapiens
attctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggct

SEQ ID NO: 4744 - DNA, 4371 bp, Homo sapiens
gtcgcccaggctggagtacaatggcatgatctcagctcactgcaacctctgcctcccgggttcaagccattcttgtgactcagcctcctgagtggccatcatgcctggctaatttttgtatttttagtagagacggggtttcaccatgttggccaggctggtctcaaactcctgacctcaggtgatccacccgcctcggcctcccaaagtgctgggattgcaggcgtgagccaccgcacccggcccctgagggaatgcttgaaattgctttcatgtaaaagcacctacacccaggccccccccacccacgaacagcttcgtggacagtttactcagactgagtcgaaggtaattttaaggtagtttcgggatattacccaagtatggcccagctggaaggtggacatcggggggagggctcagaaacaccaaagtccaaccttctccacctcacagatggagaaactgagcccgagagagagaagaggagtcagctgagcctcccccagataagacaatcgccaaatattctgggaccttgctgggggcagacagccctccctgcccagcaatgggcctttgggatgtggcacaagctcccgggaaaccaggagtgacaagggcgcctgtccctgaggagtggagagcgcggagttggtgctgagtcagccctgatgtggcagaggaggagcaggcccccgcagaaccagggctcttcagtgtctccaggtccttggtgaagtggaactggaccaggcgcgagttccggaacagcggcactagggtggtctgcggggaagcgaggggacccccagctctggcttctcccaccacggcctcccggctcccagcccgctgagtcccccgggcccaggaccaaactgagactcccctgtcctccctacctcaggaaacgtcatctccaccgctcaaccagcccaaccctggagtgctgtggaagccgctctcagatcccttggcagccccccaggtgcaggtcgtggctgcccctgccccgctcagtccctgcacagccaccagctggctgcctgggaccccttgaagccaagcctgaggagctacccaccacacctgcttcagcaccctcagctccgctccctcacagccagctcaggccacctggggaggcgctcttgcccccagccccgccctctggaagagctactgcgtgcaggctccagcacccggccccagcccctcaccagcagctgctgcgggatgagctgcatgtacagcttccttggccactgctcggtcctcctgtggggcacaaagggacgagggtcaggaagccccagctcccctggatgctgcctccaccccccagcccagcactcacaggatctccccctggttcacgtagacgtgggatggcagccacctcttggaccgactgttgggctcaggcctgggcttttgggggagaggcaaagaggagccctcagggctggagacccccaatgccagtgtcccctcccagccacagtccgtgaggatctgggggtcccaagtccctgggctgccgagtgctcacctcctgccactccatgacaccactccatgccagaaacttgttgttgacgatctggactgggcctgagttgacaccaccaggtcccactgcctgttggaagggaacggggtgggaagaggggcccaggctcctgggaaacctgtctgtctgtcctggggcctgccatccctccctccgagccttggcctgttagccccagctgggtccattctctagtcccaggggaacaggccctgcccctcatctgctcacagccccccatggctccccagtggcctgagacaggtcccggccctcacctggtgcacaggacctgcagagtctgcctcaactggcaaggcatgaccaggacacgtggttaccaggcagggccttccagccgcaggacgatcccaacccctgcccagctccccgctccgctggcttccctgccgccgcgccaagacccaccctccagccctgcagagccgcccagtggccgcttttccatggagccctggtgggaacccgcccggcatcctccgggctcccctgcagctccttgctccagccatcgcatcacactccgcccacaccaagtctggctgcccaaccagggcagtggggtctaatccccctctgtccccagaggggctgtgcttggctggcacacctgcttgcgggtggtgatgacctgccggatggcactgacgaagccgctctggtcgtaggggatgaggcccatgaagatcttcttcttggacgagtacaggagcatgagcacgcgcacctcacagggggagatgtgggggaacagcatgcagcccgcctgcgggggccgcgggtcaggaccctgtggtcactgcccggggccactgtgcccccaccaccctggaccgccccacctgtaggggatgaagggagatcatcggtggacagaggcccccacagtcaaggccatggccataggtgaggggcctctgagagcccgtgcagcgcccatcggcatcccccgaccctgccatggctgaggtcagagtggcacccggcacccaggctgcggtgagaatgccaagaaggcactacctcccacccacatcaccccctgccgccagccctcctgactgcctgatggggtgacttggcctgggggttaagagcacaggcagcgccccaccgttctgctgcctcctagctgtgtgacctaacaccagccacctcctgcttctgggcctccatcatctgtaaaaccgggtaatagtgcacacagttggtgccacataaaggctcaacagataaagtgctggtgcctcttgaggatggcgcatgggagaactaagcctgacagatgtgcctggctgtggtgtctagatgaagtggtgtgaccgtcccaaaaccccatgtcccctccccacaccgggccacccccacagtgctgtcccctccacgctgccggcctaacttctcaaccttggtgtccagcccagggatcacccgctcagggccctgtccctggcctccctggagccatgcacagtcagcctcccagggccatgcctggggggtgagtatggatgtccactttccctacagactgggtactcggggcccagatatggcaggccctcaacaaacggtgctgggtgaagggggaacgggtcacttaagagacctcatgccaggcacaagccctggtctgcccctggtctcctgagggagaagggaggccctagcggaacccagggcgctcaacggcagctgggacgggtagaggcagactgtcccaacagggaacagggactgggaatgtcccagagccaggtcctctgggcagacaactcgctcccaccccacccctgcctcctctccagcacctgccatctttcacagcccaagccccctttctgacctgccctgcgccagaatctcagtcacctgaacagcctcaccagctgggttcacccagcactcactaggtactaaagtcaccatctcaagcgctttacacaaattccctccctccagcctcccggtggccctaggaagcacggctcccctgtcctccctacctcagaaaatgtcatctctacccctcaaccagcccaaccctggagtgctgcggaagccgctctcagatcccttggcagccccccgggtccaggtcatggccgcgcctgccccactcagtccctgcacagccactggctggatacctgggtccccttggagccaggcctgaggacctactcaccgcgcctgcttcagcaccctcagctctgctccctcacggccagctcaggccactcggggaggttagcccattttacagaccagaataccaagccccaacgtgccactccctcctggctggctcttgtgcctagcacacccatttaccaggtccctgccatacgctatgtgtccccgacaggctcctgggccccaacagggctggccccagtccctccctgcactcacgcccccagggccacctcgaagctgggcacagatgcagaaactggaggcctctcaggctgagttccttcaccctgtgctctacggagggtgcctggagtcagtcatttccagatggggtccgagaggccacgagggctaccctcggccccaggggagaccccccgacccccgcctggactgtgtgagcagagcgctgcctccagctgtacttgtcaccacagtgctacaagggagcccgccccactcacgaagccgttgcccatgatgcggcagagccccttgagcgagtcgcagtctctgttggtgaagtggaactgtgccaactgggagttccggaacagggggcccagggtggtctg

SEQ ID NO: 4745 - DNA, 893 bp, Homo sapiens
ctctcgctctgttgaccaggctggagtgcagtggcgctaccacagctcactgcagccttgacctcccaggctcaagcaatcctccacctcagccttgcaagcagatgggactataggacagtggcatactatcacatctatcaaagaaaatgtgaaaagtgcctgaaatgtgctactgatcaaccaatagcagtgaaaactcacatatggtacacattccatttggatcacaaaagcaaaggtgagtaatgtcaccatcattcactgaggtggagttgaatgacagcttacccttcctccaggtccattttcacagcccaattcatcacatactctgttggctaaactaactgctgagattcttcggggttgggtacagacaatgttacatttacttgcttcccactcatttagaagcaaatcttccaatagaaaatgtggtacctgagtacttttaccactccctgtttcacctgccacaaccactacccgatgccttttaagagtttcaacaattgagtcccgatgtttaaatacaggtagctgttgtctttcctttagaagtttctgatacttaggtgtgctttgcaactttctaaagaggtttctaacaggttccaaatcttccacatttgctgattccaaggacagtgcagaaaaatcctcatccgaaactaaattttcccaagattcctcgggatcttcagagttttctctcttattttcagaatgctgttgttgctgctgttgctgctgtttcagtttattcagaagtttggcaataaaaagatcacgtggtttattggtttccattttatttaattcttcccttttcttttctgcatcactccactccagccaaacatctcggtaagtgggaggaagtaactgat

SEQ ID NO: 4746 - DNA, 790 bp, Homo sapiens
acacgcacgcttcgcccccaggaatgacctcatcgctccggagctccactcacagaccccacctaccacagggaacgggggcgggtgccagcgtccgggcaagcgcacaagagtggcctctggccggaggcgagggcgggaaggtgcgggaagtgcgcgtgcgcggagcctgggtcagcctgggcccgggtccgcttgcagcgggtggagtacttgcggagccggcaatccaggctcccctcccagcccccgcgcagaattagcctctctgtgccgccgggaaatcggcaattagaacgctccttgcgcgcggcacccaggcagccctcgagaatgcctgcactgtggcctgcccatcctcgcccttcccatacgccctcggccccgcgctcaccacgttcgtgtcccgctccaccgcgggttcccagcccaggtcccggggcccgcaacagtccaggcagacgagcgcgcggcagcggtagtggcaggtgaacttgcaatctgcagagaggcctggcggtgaggcggaggagctccaggtcggggaaatgtcccggagattgaagggaagccccagggagagggccgctgctcgccaggctccgcaggcccgacctatctcagtgggttacctcacactgctacgcggactctaatgttggccacctgggcgtctggaaaccggccggaaggccacaggcagagaggcctgctcaacagttggatctctatcgcctagcacagaacttcccctttcctcattggcaattaaaaaaacaacaacaaaaaa

SEQ ID NO: 4747 - DNA, 946 bp, Homo sapiens
ccctaactgtgagttgatgctcccgtaaagagctcagggctgtgagccttatcaccacatgggttgcaacacagcagaatatcctgtgtgaccaaagccaaaggctaaacctggctgcattttattggatgggtgatggaagtgggtgggagtactatggtaaaggagggatatatgggtgggagccaccaacaaaagtcccccatccccctcccccaacagaaaggagagagacaaccctttcccctcaggtgatctggaattccagggcctctgccagctttgcaggaggtgcacagaagctggatgcttttggtctggtggccatgagctagactctgttgcctttggttgcttttcactccacagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcagtgagaagtatatgtgggaggggagaggaatggggggtggggcagggttggtgatgagttctccatgtcccctgtgtttttctgcttctaatacaaagatttgtaatttgtttttgctttttggtagagacagggtctcgctaggttgcccaggctgctctcaaactcctggcctcaagtgaacctcctgccttgccctctcaacgtgctgggagccactgtgcccaatcaacacacagtaaaggggaagctcatttccagtatttgtgcaaagaaaaagacatcctttaagaagctatcgtagcaaaccaaaaaatacaaaattgtgacccagaggatgtacagtgacttctggctttctagggtaagcaattaaggatggtttctgtctctacagagctgggttccagggcg

SEQ ID NO: 4748 - DNA, 1602 bp, Homo sapiens
gtggtgctgctgctgctgctggttgaggatctgcagctggaggaagagctgctgctgctgcaggatcttggcgtaggatgagtccatggggggtgcccccctgtcctgcttctggtccggggggatgtactggtggtacttgagcttcttcacctttggcttcagctccttggccttcttgctgcgctgtgacttctcactggcagacttgggttggctttgctgagggcacaggagacagggtgccatccgtacaccccgtgaaaagcagaaatgtgcccagaaatgtgccaggaaaggggctggagtgacaaagagggctatgcctgacccccgacttaaaagcttctagctcaagcaaagacatcaccatgaccccaagcagggtgaacacaaggaggtaaaacccagctgactgatggagctcgggctgcgccagaccaggcaccttccaaagacggggccacacaagcctctccagaatgctgcttgctcttctcttgctctttttggggctggggggaattctgccaggtaggaactgtcgtgtctaaggagaatgatcttaacagagtagtaccatgctgactagtggttctttgatttctaacaatttatagcaattgtcttttaatccactgataggaaagaaagtaaaattaagaactgtatttattggaaaacagttcctattccttttgggtgggggtgtgagggaggcagggtctcactctgttgcccaggctagagtgcagtggcacaatctcagctcccaggctaagcgatcctcttgcctcagcctcctaagctgtgactacaggcacttgctaccacatccagctaatttctgtattttttgtagagattagatttcgccatgttgtccaggctggtctcaaactcctgagctcaagcaatccactcaccttggcctcccaaagtgctgaaattacaggcatgagccactacacccagcccagttgcattcctaaatactagttttgacataacttagaggtaggtgtgtgtgtgtgtgtatattaaagctgctttcatagtcacaacatcagtcttgctctgtcatccaggctggagtgcagtggcatgaacacagctcactgcaaccttgaccttctgggtttaaggctcaagccatcctcctgtctcagcctactaagttgctaaggccacaagcatgtgatatcatgcctggctaatttttaaaaactttttggagagatgggggtctatcttgccccagctggtttcaaactcctgggctcaagagaccttcctgccttggcctcaccatgtgctgggactgcaaatgtgagccactgtgcctggcctaaaactccactttctaatacagtagcaactagccaaatgtgactatttaattagaatagccacatgtgcctatttaaatctaaattaattaaaattaaataaaaattaaaattcagtttttcaactcaagtatgttcaacagcacatgcggctaatggttagtcttatagaaatagttctatcttcacttaacatactattggacagggctggtctagcacctagttcttttgaattcataacttggagaaa

SEQ ID NO: 4749 - DNA, 1627 bp, Homo sapiens
atgcaatacagcatccatcccgcgcttaacggcaccacctagactgctactgagtgtgggaaccagcaagaccatccaagtttggaacttcaaatagccaggatttcatgactgagccaccaagaccctctcagagcatcagtcccaaggagatggccagagtcgctgaacaaatcatcagggtgtccttttacaccttgttgctaccagcacttgtcaagaagagcagtgagtcaattgcttgaatggaggtaccaaaggatattttaaaactgtgtctactaactcctgtcttgagctgaaccgcaggccaggtcttccttcactgccactgaagcttaaaggctcccagataacatggaacagtggctctcactgatcagctaactaatcagggctgtggacaccaagaatgccaactttgattcttcaaggaaaatcagcagctgaccacacaccacccttcctggtcctccccgagatgccaagaacatccaaagtctgcagttttgagatgttacccttcggatgcatacctcaatctgcctgaaaatcatggaattctggagatggaagggacctcagagattttctggttctctctgttctggttgtaagtgttcttaccacacaccactcccaaccatggggagcctttccaccactgaagagagctggggttactaaagccacaatcagcttctctgcaacttctaaccatttggctaagatcagtttttctgaaaccacaaagaaaaaaaatctacgaacaagtactagcgtaccaatgttcacagtagcattattcacaagtcataaggtggaagcaacccaaatgtccatcaacagatgaataggtaaacaacatgcggaatatacatccaatggaatcctcttcagcctcaacaaggaaggaaattccagtgcatgctataacatagatggacctcaaggacactgtgctaagttaattaagctagacacaaaaggacaaatgctgtatgactccacttgtatgaggtctcttgagtagtcagaaagcagaatggtggctgccaggagctgggggggggggcaggaagaatggggagttattgtttaatgggaacagagtttctgtttgggatgatgataaagttctagaaattgatagctgtgatggtcacacaacattgtgaatataattaatgccacaggactgtatatttaaaaatgattaaaatggcagattttatgttatgataaaaaaatacaaaaagataaatctactctcccttcaggggaagacagccattcacctaaatctttttcaggctaacagtctccagttttttctaacaatctttaggtggtatgatttccaggcccctgcagcttcctggccaccctcctctggctacacttaatgcctctttgaaaacctggtacccagaactgaatggtggactgcgctcagcttctccttccaggtcccgccctgaggcacccggcttaacccccaagtcaaacgctgcacagagcaggcctgctgcctgcccactctggctaccaggccaaaggcccaggtctggaagaataaaaagatgccaccaccctactaccttgctgctgctccatccccagacag

SEQ ID NO: 4750 - DNA, 678 bp, Homo sapiens
agcagatcctggtcctcgacccgcccatagacctcaaattcaaaggccccttcacagatgtagtcactacaaatcttaaattgcgaaatccatcggatagaaaagtgtgtttcaaagtgaagactaccgtgcctcaccggtactgtgtgaggcccaacagtggaattattgacccagggtcaactgtgactgtttcagtaatgctacagccctttgactatgatccgaatgaaaagagtaaacacaagtttatggtacaatttttgctccactaaacacttcagatatggaagctgtgtggaatgaggcaaaacctcatgaattaatggattccaaatggagatccccaatgaaaatgataaattgaatgacatggaacccagcaaagctgtcccactgaatgcatctaagcaagacgggcccacgccacaaccacacagtgcttcacttcatgatactgaaacaaggaaactaacagaagagtgtaaaagacttcagggagaaatgatgaagctatcagaagcaaatcaacacctgagagatgaaggtttaaggctcagaaaggtagcatattcggataaacctggatcaacctcaactgcatccttcagagatgtcaccagtcttcttccttcacttcttgttgtaattgcagccattttcactggattccttttc

SEQ ID NO: 4751 - DNA, 257 bp, Homo sapiens
gccgccgacccaacaaataccgccgggcgcctgaggagctgcgtctccgctggagggcagcggagacagccgaaaggggcccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctgtaaaaggaa

SEQ ID NO: 4752 - DNA, 693 bp, Homo sapiens
aaattatacagccatgtttatgaagtctacatttcccttgtcttggatatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattggagcccacaagagggcatttttccccactgggacaatagacctctccactagctccctgctgtttgatgctttgtctggagcaagggaagcagaacttgtgcgaagggacggacgggcactgcacaaaatgggtgtcctccagccgctcgtggcagagggtgcagcacagcggggcactggttgccagagaggagtccgggaggctggcagggtgcactggctccagtcctcctgtgttgcctgctccctggccccccacctctctggggcccagccttctttggttcatagaggacggagagggcggactgttgctattcctcctggtagtggagtgaacctggttggcatcttttgaggcatgactgccccctgcattgtctgctactaagatcagggctgccatgggggactgggcatgcggggcaggtcacacaggtagcacgactgccgccgggacgcggccgccaccgccacc

SEQ ID NO: 4753 - DNA, 703 bp, Homo sapiens
atttctgcggcgggatgagccccaggataacctccgcgagcaagccacatcgtcctccttctgggctttcaggcgcttggggctgctgggccctccagaacgcgacgcagacctctgagctggccggctggagggggccacatcacagggctcccggaggcagctgcgcttgcggggacacccttccgacgtgctgctccagttgtgcttgaccttgccccgctcggacgccatgggcacctgcaaggtacagggggcctggattccaacaccacccttcctggcgaccccacctcagattcccgccaccccgggcccaggaggacggcaagacataagggcagagccaggggctagcctcactgacctttccctcttctttccactgcccatcacagttctcaaggtttcagagatgccaaaccgtgttggagaagtcaaagcgatccaaaattgactaaaggctgccgtcggtttccaagcccacaacgtgcttctgagatcaggaagccttcactttgcccagcgctacttcggagatgcctaagcgcttccggggctacgaagcgctttgatcagtttgcaatataaagccctttagaactgtcaagcgcttcagaagaccacatggcgcttcaagatccacacatggctgccggatccgcggccccggggccgggcgcttagcccgtaggccagggcc

SEQ ID NO: 4754 - DNA, 3171 bp, Homo sapiens
agatgaaaaccgggcgggatggcagccccggggccagggatgcgggagccgccgggaagacccgcgcgccgctcgactcagagggactcacaccttcccccgacaaaggtcattaagttgtgagtacacttgcacgcacctgtttctcttctcgcccccctgtttctccctgggtcccgctgggctgccaagccgtgcgcgggctgtgccgtgacagcgtccgcagagcccgcggcagggaagggcgcaggagcggctgcggctcaccctcccgccttcccccgggcaggaggtgctgagggacgcgaaaccaactaccgcgagcggcccgcccctgcccgggagaaccgcggccggcgagcacctcctcgcacttcctccttcagccacgggcagacccgccggagtccgaacaatgaagcggcgcggggaaactgtgaaaatggaaacttacctctcacatttttttttcagaggcggccccactgtcgaccaagtgcccaaggcattgtgggagtcatgattccaagatgcccgcgacggaaaatggaacttgtcagctccttgtcatgggagcattgtgggcgccacaactcattcagctgcagtgaaaagactgttgcatgtcgctgtgcagcctcttatcgccgaggtctggcttccgctgctgctgcgcggcccctcccccgcccgcccagccccaccaggaagcccagggcggactcgtcgagctcctaatgcacgcggcggcgagaaaaacgctcttcaactttccgccggcgccctcccgcgcttccccgggccacagggtcgcctgtcaaccggacagagcccgcaagagcgggtcatgggcggtcgcccagcggcgccgagagcaggaggaagccggagcccgcgcgggcgccgtggatcccctcggcctcccgttggtatcttccatctcatgcgttcagcattgtaacctcgcggcgggcgtgcagaccggacgccctcccgcttcttctaccgactgctaggcacaccagtgggttcattttgaaagaggcccttgcaccgggctttgcaaggaagccggcaaggttagattgaaggttagaagccaattagactagaatcctgcgatctggtgagactgccgccttaaaatgcaccaaacagtttttgaacctggagggctaacaggcgggaaaaacatctgcaagactgccaccgtgtatttttctcaagtaacaggctatccacagttttggaattccttagtgaaactgtcacacaggcacaaacacatgtcagctttccttctagtttgtaaataatatttgtaatttacaggccactgtattcccaactttgcaccatgtgatttagagaaagcaaagctccctctttaaaaataatatgttacttctgaaataccgggatattccacggcaagtaagccatattgtcgccagagcaaataaaccgcagccccatatcataattcactgggtgctataagatgtaacttggctttgctttgaatggaaagaatcctgaacgtctgtgatgtgatgaagttttggagactgggggcaggatttcctttgaatgtaaggaattcggataacttgttcaaggatgattctagtgaaaaacgtttgtcccatgtttgttgggacaaaaatgctggatatggtacaacattcttcctgcaggttcggttttgttgaagagagtgaggccagctcgaggtgaaggaaaaacatcagaaaggtgctaaagtgcagaaatatcttccagaggcactaatagccgactttagttcttgacctttagctagatccacaaagcactgagttaaaattgtacactgatcccttccagaacaaattaattaattaaatggtgcctcttcccagcgttaatcgtttaaaaggactcaagtacccacacagtttaagcaaactaaaagaacactgacactttctcagagaacagggatgggaactttctatctgcccattagtatctaccccaagctacgaagacttccattcctcttattaagcattcagcaactacatttagtgcctactatgccagtgatgcaagaatggataagacagtccctacactcaaggataacgcctctagtaggtaatggaagctggagagttggcccttgaccaaagccttgcagctaacaagaggacaagcctcctgccccacagtgtttcacagccagtaccccaagctcctgaattcatctgtctaatgtgtaatatatttataaacactctacctgggatgtatgcgtaccttctactatggactgttgttaaagacaagtaaatatgcaatcgtggtctttcaataaactaaacggatataaaaataaatatagaatacagccagaagatcaaaattgacatattatctatttatgcttataatatgtaattacatgtaatattgtaaaacactttctaccatttcataaaattctgtgttgttatttagcccagaattcccttgcaatcttttaaaaatagtatctaatagggcttttaatataaatgtcgtagtgaaactgttttatgtactgtaacccaaacatttctacgtagtaacactgttccatatagaaaacaaatatgaaaaaatatggccattgtcttatttatttctaaaggtaaaccaatctttgacaatgccaatagcagtgtcaatgttcctaaatgttggctgtatctatctacttactcattgtattcttgaggttcctttcctttggtttctatgatattccacatccctctcttttcattccattgtgtgagttctctctgtggatcttttgttagctcctcttattccttcttgcctatctgagtttcctgaaattaccttcaaatcatgtctcgaaagatgttctaaagagacctttgaataagaacaacatttgtcccattaataaatggtgggagtttcatatatctgtttctttttctcttctttcctctttgccttgtccaaaagagtgggaactgagcagtacagtcataaattaattttaatatattaacttaggcatcagtacactggctattgttccttaatacatttaacacatagtcattgactgctgattatgtgccaagggctgtgcttggcactggggataaagaa

SEQ ID NO: 4755 - DNA, 769 bp, Homo sapiens
acttacgctgcgcagcggaaaaggcggcgtgggctagggcaaagagaccgatgcccaccagccccttccacagcgacggcgccatgatgccgaaggagcagcagcccagcaaaagaagcgaaggacggcggagctgtttcttcttccaccggcgggtgtccgcgcgccgcagaaagatgacgtcactgaagtcctgagcgcaaagtgtctcagtggtggaaaagccagagggctgtgagaaaacggaaacaggaatgccgggaagaagcagaaagctacacggaaaaaggtccgcgagaacccacgaacctgcgctatggaggcctctctaggagggccggagcccaacggagtcataaacgaagaggcgaaagcgggagctacggggaagcgaagaggaagggcgccggcaaatgggggcagggccagtggcgagaacagggcctttcctgtgcttcagctccctggaaactggcactgcagaaggaggcaagggtgttaaaacgaggaggcagtgtcaggacaaaatcccaggatctggaaccccaaatacttggctcgcgggaagtgctcagtaaaccattttaaggtcctggagaaagattcgcgcaaaaagaggtgtagcgcggggggagtgttttgtcgtgaaaagaaccagcttacattaaggaagaaatgaaagaggaaattttaaaatgctaataacgcagccttcttgccttgtctctatctctgatccggttcctccagtgacccctgactgagtggc

SEQ ID NO: 4756 - DNA, 488 bp, Homo sapiens
gccgcagtatccaagctagtggcggtcccagtgctatcctcgctgtgagtggagcaccggtcatccacagagtcaggaaaggtgaggcctggaagctggacacctgcgaggcccacatctgcctcgtgggataccgacagcaccttgatgctggcctctaatgcctctttctccttcagcaggcttttataggcacggaccacatccttgagccgtgcctggtactggagaagctgcttcttctgggtctctatagtctccagcaagtccttcttgctcgggccgcccccgaaattcatcccaaacttctccatggagggtctgaacggattgccccacgtcagctttccagcagaacgggagagggccgtgaagacgcaggcgggggcttaaagaaacagcgagcgggctgtccggcggcgggccgcacacctactccacctagttatcccggacctaatgcggaacggccggacggactggcgaaa

SEQ ID NO: 4757 - DNA, 505 bp, Homo sapiens
cttatggccaaagatggaactgtacttgggtggtatctgagcaccctgttggctttgacattctagggcccttcccttggcaccactctcttatttaaaaggaataggatgtggacttaggagggttatttctctgcaaactatcctctctttcttatgacagctatttctgaatgtgcacatttgaggctaagcaaatcccttcctgggaggcgtgaaagacctttatttctctgcagaggagtattatggaaagtcagttgatgctgaggaggtggtagagacctagctaactcatctgcagcggctttgagcaaggcttttagaatcataaggtggctggggtcctgtgtcctacaccacaggccagctagttcatttcaggagactttcttttctatctattattactatcttcttctagactgtagttcactaccagagattatccacttagctgcactcagtttgcacctggcctgtatcaccacttagctctcactcc

SEQ ID NO: 4758 - DNA, 2741 bp, Homo sapiens
acaaaactttgaattttttatttgtgaaattaaaaatatggtattatatatatataaacttctattcctctataaatatagatgattttgtgatagtgaacagaataaatgtataccaaattcaaagaccaatatcattttagcgtatgacagacatagataaatttaggtcctaagtaccggcattttgataaattcttaaagtttaaaacaatacaatcaggaggattgcttttctcctcttcttcacagagaactaaagtgaatatttttaaatggctttgaaagatttacatttgacacatttctgtaaatccaaaagaggagcacacaggatttaatgcagtagacctgcacacattttccctttagcatgcatgcccatattttgtttatttcaggcgctatctccccgtcaattattccaccttctttacctcctgaaatcttaccaggttattattggtggtgtgaattgttcccccctcagaatgtgctgctgaataataatcgtaataaaatgttgaaagtgtacaacttttacattttaaagtttctgatatatgtctagttatttgattaaaaataagaaaatagcacttcattttgaggaagtccatgacactgaaatatccttcaagttttcaatttctgtttacgttttgctgtcttgttaaggaaagcaaacatcaactccttaacaaagctttccaggtgacctcaacatttccattttacagaccggtaaaatctaagcgcaggctgtctcattctcaaaggcaaggttgccaggcatccgtatgcaattagaattaacattttataacccatatcttcagtctcttccaacccacacaaagcttcatgcttcttcccaaatctcagtaaccacatctttccatgacgctggccaaacccataccaggttttagacactagagaatgaaatgagctcacccctcaaaaattagacttcaaaaagtttggcattggttatctcactcaccctgtaaccaactaaggtgggagaagggagtgtctgggcgttgaaggtgaccgtggagggaggctgagactgccagcgcccacacccgtgggcccccatgaagttggaggaaagttctggacagttaaaaatccagcttcaggaagtcgaagggacgggccttcgcaatccaccgccgagcaagggaggaattgtaatgtatgggggccctcctccagatttggaaggtttgtggagttctgtaccttaagagcccctacctcaagccaggaaagaaagggaggggacagaaggagggggagggggcaaaaggaggaggcgggaagtgaccctggcagcgcagccctagtcgcaccccgcagtgctgaactcgccccggagctggcgcccagccgtcccgagcacccgtggtagggagaggcgcgcgaggacgaccaggagcgctgtgcggttgcacaccagttttagctcctttgcaatactccgaaaagggcaagaaggaaaagcctcaaatggttaaaccgccctaaataattaaaaacttttgaaaaagaaaaacgcgtgatcggtcgtcatttaaatacaaatatacttacaaaaatcttacacaggctatttacaatcataaaagcgaacagtcctggtaccagagtgtgagggcaagaggtctgtccatcctccctctggcagtcgggccctcgtgtccttttgcctcagggacggaagcttttgcaggagctgagttgttcaaaggagcctgcgaaagagagttgtctagtgaggaaacctcgagatgtcaggattggcacgaactccacggcgctggctttgggggatcgctgcgccccggccgaggcctgggcatgggctgagccccgggtctcagactgtagtctccccttgtttgctgttggtgagcctcgtgtagaacttcctccaggagttgagggtcttgccggaccagatccagaagcccgacgtgatgcccacgatcagcgtcataaggtacttaatcatgaagaccgtgaagtccgggctcatgggcgggtgcggcggggcgcctccgcccgcctggaggtgagggcaggggatagcgtagctcttgcagctctgggccacccagctgcgttcccactggtcccggaaggcctgctcgtagaagtagcaggcgatgacgatggtggcccgggacttcttaggcgcctcctcctcagccatactttctcggctcctctcttggcgccgctccgctggggctgccaggggcacggccggcggcggctccccctgcggccagggagacctctgcgcgggtgccctccgtcgagcccaagccgctttcggcccgctcccccggctcctgttctgcgtaccgcagccgccgccgccgcggaaacttgcgattcatgaagcgcgggcggcggggagaacccgggtggctagggcgcgccggggtcgtgtcccgccttcctggccctcggctcgctggctcccggctggcggcgccgcgctagtggccgcggccccgtagagagcgcaactctccgcagcccagcgggctcggctcccccctgcgcctccgcctccttctccgccgccgccgcctgaccatttgtgtcaatccctcaactcgctccctctcctctgcctcgcgcgccctcggaccggtttccaggcgccccgtagtctgtctttcaccaggagggaggagccttgaaaccgacgcagaactgga

SEQ ID NO: 4759 - DNA, 6328 bp, Homo sapiens
ctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctcttcccgagctcaagcaatccatctcccaaagtgagccaccatgcccagcccttaaagagatctttggagattttttatgatgtaggatgaatgctttgcctcaagcagtaagtcccaacacatgacaaggttggacagtttccccatttacttgggaaacacggaagtgagcagtataaagttcacacggagggtctgctttggctttgagctatcttccttaatcctttctgagctgccttctcccgtgtcaaaatattgatcctaaagtgatccaggccttgtatatgcagatgctgcaactcatgaaaatagatgaaacccattattagagcaagtactaattcttaggccaactggcctgttccatcacaccccaccacattctaccttctggggcgtgctcctaccacacctgctagagtgccttttctacctagctgccagacttgcaccaagttaggactcaaatatggcaggtcctacaaatactccagagaaccctgatttacatacctacctgtcaactgagaaaccttgaactcaggctttagtgtgtgaattatcccaagctgctcatcccagttttggataatcccaaactgtcctatgtggataactacctggacaaaggattcctgtgaaggaaaccaatttgaaccttgtttaaaagttgttcccttggtcttcaaactcaaatggtcaaatgaatgcagcagtgttgtagaaacattcatgatctccaaaaacagtcattattaaaatcttacaaatcatatttccaaaaaggtttcacaatttttaaaaaggagtctctcatctccctcacatcatgcaacctggcttgtcctttggcctggctacatcatggcagggatctctgaagacactgtgtccaggggctgccagtgacagtccatcagagcgtcatacagctcctcactctgttccatgaactccttgttggcctcagtcacatccagctgtggcatggggtctggaaagcaagcaaggatggggtcagggaagtctagggacagctgcaagggacctggttcagttcccttctcccagaactctgttctatggtaaggtccctatcctgccagtttctttcaggaagtgaaagcactgccttgcagggttctggggaagatgaaaatagaataatgtatctagagaatgggaaaatggcagctgttagcctgcatctattaaaagctacacctgtgtctctagccatcatgtatcctagattttctggtctggtcctcacttcaaatttgggtttagaaggtctgatcaaagttattaagtccagagcatcatctcaagaactgacaataagtgcatagtggaagaacttcagtcaaatataggagctgaaaggccaagtcctgtatgtatgtatgtgtgtgtgtatgtactttagagaaagggtcttgctctgtcacacaggctagagtacagtggcacacttacagctcacagcagccttgaactcttaggttaaagtgatcctcccgccttagcctcccaaagtactgagattacaggcatgagtccctgtccctggtggtaaaatactattaaaaattttttctgcacagtggctcatgcccataatcccagcacttcagcaggtcgaggcgggcagatcaccagaagtcgggagttcaagaccagcctgaccaacatggagaaatcccatctctactaaaaatacaaaatgagccgggcatggtggcacatgcctataatcccaactactcgggaggctgaggcaggagaattgcttgaacccaggaggtggaggttgcggtgagccgagatggcaccactgcattccagcctgggcaacaagagcaaaaccccgtctcggccgggcgcggtggctcacgcctgtaatcccagcactttgggaggccaaggcaggcagatcacaaggtcaagagatcgagaccatcctggccaacatggtgaaaccccgtctccactaaaaatagaaaaattagctgggcgtggtggcaggcacctgtagtcccagctactcgggaggctgaggcaggagaatcgcttgaacccgggaggcggaggttgcagtgagccgagatcacgccattgcactccagcctgggcaacagagcaagatgccatctcaaaaaaaaaaaaaaaattagctgggcatggtgacctgtgtctgtagtgccagctactagggaggctgaggcaggaggatcacttgagcctaggaggtcgaggctgcagtgaggcatgttcacatcactgatctcaagtctgggcaacaaagtgagactctgtctcaaaaaaaaaaaaaaactgggcactgtggctcatgcctgtaaacccagcactttgggaggccgaggtgggcagatcacaaggtcaagggattgagaccatcctgggcaacatggtgaaaccctgtctctactcaaatacaaaaaattagccgggtatggcagtgcacgcctgtagtcccagctactcgggaggctgaggcaggagaatcacctgaacccgggaggcagaggttgcagtgaacagagatggcaccactgcactccagcctggcgacagagcaaagactctatctcaaaaaaaaaaaaaaaaaaaaaagccaggcgcagtggctcaagcctgtaatcccagcactttgggaggccaaggtgggcggaccacctgaggtcagaagtttgagaccagcctgaccaacatagaaaccccatctttatggggttagaaaaatagaaatagaaaattagctgggcatgcgagattgcgccactgcactccagcctgggcgacagagcaagactccgtctcaaaaaaagaaaaaaagaaaattagctgggcatgatggcgcatgcctgtaatcccagctactcgggaggctgaggcagaagaatcacttgaacccgggaggcggaggttgcagtgagctgagatcgcgccactgcactccagcctgggcaacaagagtgagacaccgtctcaaaaaaaaaaaaaacaaaaaaaaacattgggcctggcgcagtggttcacacctgtaatcccagcattgggaggcagaggcgggcggatcatgaggtcaaaagatagagaccatcatggccaacatggtgaaaccccatctttactaaaaatacaaaaattagctgggcgtggtggcgcgcatctgtagtcccagctattcaggaggatgaggcaggggaatcgcttgaacctgtgaggcagaggttacagtgggtcgagatcgtgccactgaactccagcctggtgacagagcaagactctcaagaaaaagaaaacaaaaaaaggattaaaaagagattggaaaattctaaggacttatctacagatattatgaggctaattatctctagaaagaaggcaatgtctcccagggggaaacaactagagacttgaatataaaaagaccggactgtcctgactttgccccacactgtgtgaccctcagcagatcacttgggctttccgagccactagtttcccatctgtgaaatggagctcctgtgtccttcccagcccaccccacaaggtcactacagttggcatcacatgagaggacacaagaaagtgctttaaaatgttatgaactagacaagtttgttcatgccctaaaagggatctgtttcctttaacgaacattttcttgacagaaaacattttccctatgactttctcttgaagacgaatcctcaaaacagatttcaaactttgagtctttttgtacctcaaaaaaagttttggccaggagcagtggctcatgcctataatgccagcactttggaaggccgagatgggcagatcacttgaacctaggagttcaagaccagcctgggcaacatggtgaaaccctgcctctacaaaaaaatagaaaaaaatagccagttatggtggggcacaactgtagtcacagctcactgaagcctcaacctcctgggcccaagcaatcctcctgcctcagcctcccccaagtagctggaaccacaggccaccatgcttggctttcagtttttctttcctttttcttctgtgaaattcagtgaaaattataaatacttggccgggcacagtggctcatgcctgtaatcaaagcactttgggaggctgaggcgggaggattacttgaggtaaggagttcgaaaccagcctggccaacatgctgaaaccctgtctctactaaaaatacaaaaattagccgagcgtggtggtgcatgcctgtaatcccagctactcaggaggctgaggcaggagaatcacttgaacctgggaggcagaggttgcaatgagctgagattggagactgcaccactgcactccagcctgggtgacagagcaagactccgtctcccaaaaaaaaaaaaaaaaaaagagatggggtctcgttatgttgcccaggctggtctcaaagttctaggctcaagccatcctccaacccacgttggccttccaaagaccttacaggctttagccaccgtgcctagacagtaaatactgttgtttttttttttgagacggagtttcactctcgtcacccaggatggactgcaatggagcattcttggctcaccgaaacctccatctcccgggttcaagtgagtctcctgcttcagcctcccaaggagctggaattacaggcatgggccaccatgcctggataatttttttttttttttgagacagagtcttgcactgttgcccaggctggagtacagtggtatgatctcgactcactgcaacttccgcctcccgggttcaagtgattctcctgcctcagcctcctgaggaggtgagattataggcgcgcaacaccacgcctggctaatttttttatttttagtaccggcagaatttcaccatgttggccaggctggtctagaacttccgaccttaggtgatcctcc

SEQ ID NO: 4760 - DNA, 6056 bp, Homo sapiens
accagatgcagggatcccagggacaggctgagtggaggaggccagaccagaacatagaagacaagtgagtggggctgggctgtgggggaggggtggggtggcagggaacaggcagaccatcccttctacccacaggatcctgctgctgcagacagaagtggaaaaggcctagcggcatttggaccaaatgacccaacagcctgttggcccagagcccagcctggggatcccccaagtgggtgcatggcaggccctgcgcactggccctgctgtacctttgactctgccccacactttattctctggtcctcattattgaagcattatctagagaaggaaggcagcgcaggggcttagtccagccaagagagggatcctcttccaacatttgggaataccctgggatcattcagtgacttccctcctggttcagatgggaaaactgagaccagagagcagaggagagcttgttcagagtcataacttgagttggggccaggaccctgccacaacatgccctgaggcatcaacggtctgccaagaccaccccagtgtggtctggaagctggaaggagaccccaggattctggaccaagtgtatctacaggagatgctggtgccaggcctgcagatccaagagcagagctgggatggaggcagggcccaggagcttcgggacccagagtctccatgccagcagctgagacccctgcccaggctcaggacacagtccgtctgcaggagcagttgctgatactcactgaggtgaacaagagactcagaagagctgggccagagccaccagcaactaggggcctgcttggagcagctgcagcatctgcagggagagcagatggtgttggggggccattgcaggccctggaggcagagcacacctggctacttcaggagaaggtggggctgctagcagcactgggtgtggccccgggccaagagtcctggtaggtggctgcttgggcccatcctcagagtgtccaagccaggctggggtgggggctctgttctcactgtaggtgagatggccctctcagcaggcggtgggccagtctctgtcaccagctggctgagggggaatggcccagagccctaaacccggaatcacacgaccagagccagtctcccttccccaggtatcagcgctcctggttgtcacattctggctcttttatggggtgggaaatctttcagcttcaagaagtcctgtctcgcctacatatggccaagcccctcctgctggcccaggggcaggtgggaggtgggggtgagatgaccttagctgctgggtgcaagtcagggtccttgggagtagaagtgcccagtacaaaggggttctgtgtgtgcagggagccatgaaagaggcatctctgccccactccccctcctagttcataagacaataatcactgaaagggagtggggtgggggtgatctggggtccatgctgtacctggactgcaccatttcttccagtacactccaggtcctggaggtaccagtgcccctcaggaaagagctagaggcacaagaatcacatcccaggcttcatgaggagatggctgaatattggaaggcacgctggcaccggctggcagttgccctgaaatttaaagaggaggaactgcagagactccagaggcagagtgggacctggcctccccaggtgggcactgtctcccaccttcttctccaccccctcaaccccgttctccccattgtcttccccactgcccagtctttcccatacaaaccaattagtctcttacccctccttaggatgcccccatcttgatcctatacttccttcccattttctgcctcttcctcatcatgccccatcattctccatccatgttttcagcatgcatttattgagcatctgctacatgcctggccctcttctgtgtgcagaagcaatgtcaaatcagatcactccttgtcctcaacagcttatggtttgggggcacccggtaattgagtaagcaattatttatttattattgattgatttataatcgattgattgattgcatcagggtctctgtcacccagactgaggtgcagtggtgcaatcataactcactgcagcttcaaactcctggactcaagcgatcctcctgcctcaggtagctgggactgcaggcacgcatcaccatgcctggctaagtttttttttttttttttttttttgtagagatgggggtctcactacattgcccagggtggtcttgaacttctgaccctcaagcagttctcccaccttggcctcccaaagttctgagactacaggcatgaaccactgtgcctattttgcaagtaataatttaatgtgccagatgagggaagaggcacagtgggagctggttaaggggtggcagataggagagtccctcccagagaaggggtttctgagcctctgaaccctcacacaaggatagacaggcattttccaggaggagagaggaaatgaagggcatttcagcaagaggaaactgcacatacatatacccagagagacaggggaggagtgttgtaaatagcccctgatccacttgagaaggagagtgggtgagggggttactatggacatgggacaggggccagatctagggtttagatgtcccagctcctgtccacctgacttcacctccagcttggtggctgccttctcctggtcagcatcccttagtctcctgggcaagtgtatgtgtgcatggacagacagacacacagacatgcatgcacacacacacccccaggatacacatcagacatctgcagacacccccagatatgcacacacacagacacagagagagatacagacaccaacgaggtgcctgggagccatagggaagtagtattctaaggaccccatgtgggatccacgctctgccacaaggcacctgactgaagctgatctgctgatctcgatggaaggaaaaggagagaaagcttagctggctttgggcctcataaaggttgagttggtctaaatcagtgtatctcaaatgggtacacaactgtgctcatagggggctgttccttaagtctgcagtgtagtctgccactatatatttgtacagaggaaaatctcagttttttgttttgttgttttttttttttgtttgtttgtttttgtctatttctcaaaccagacccttgagggtcagaagatatatcctcagcgcctggatgggctatattctttggtcaagtctgaggacttgcagtgggcaatgtcagtgagaaggtagtggagtgacagagggctgggccctcggcagatttgtctcctagcaggaagaggtgctaggtgagccggatgcacttaacctgcacgtgatgcataagccagtgccactttgggccccacatgcagggccttccagcccctcagagactgtccaggccatttttactccctccctggacccctagaaggccaacccaggactcaccttctacaggcaggtggggaccctgggctctgggcctatccagcaaggatggcctaaaatgcagaccctgggtcctgggcaggggtcctgtgcagagtggctgatgaaccagactagcagtgcacttccagcagggcgaggctcttggagatggggcagcagctggatagggtctggacaaagccatattgcatcaacgtccggctggccagggggttcacgggctcagcacccagcgctcccagggcctctggcatgctccacctccagtcccatccccagcctcaagctcctccacccaaccctctctgggtgtctacctcagtctgtcttccatccaaggattcagtagtctgcactgtccccagattagtggctaagattgtgggtttaaatcttggctccacaatatactagctgtgtgaccttgggcagttcctctgcctctctgggccttatctgtaaaagtgaaaataacagttatcctccctgaatgagtgcctaagaggatgacatttgacaagcacgtgaaaacacatggcattcagtcatgaagcattagccactatgattgcacagttcctgctgctgcaggtgtggtcactttgaggagaaagttctcctcgaagtcagggtccttttggggccagagagctgccacatggggctggatcccacttaccctctgtgagtttgctagggctgtgataacaaagtgctgaagacggtagcttcaatggcaggcattcattgtctcttggttctgaaggctgaagttcaggtcagggtgtcggcagggttggttcctcctgaggcctgtgagggagggtctgttctaggccttgtccccagcttctggtgctttgccagcaggctttgacattcctccaggatgtccgcgtggtgtctccctctgtgtgtgcccgtgtccacatttcccctttgtatagtcaccttggatgaaagcccagcctattgacttcattttagtctgattacctctgtaatgattctgtctcattaggaggtactggggatgtcaatatatctttttgttgttgttgctggggatacagttcaacccagaacgcctccaatttgcttcctgctatcttcctggctgggtggtttggtttgggtgtgacttgggacttcagggccccagatgctccctcttgcttttcccatcatgtaaccgcaggacccttacacagctgcacaggccagagtgcacgcaggaggagctgccgtgagtctgggcgggcaccatccagtgagcccccaggcccctagtccacatgccagccagggagggcaggccagggcccaggaggagatccgctcccctctgcaggctggacctgcccaaacccaagagccagggtgaaggtttctgcaggcatgagaggatgggggagcagggcccctagatggggatgcagctggcccctccccagtcagccacaggagcaggatgcaggctctggagagggagaatgaccagatggctgctgggatccagaggcaaaaggtgggcaggagctgggctgcctggggtggtgtgaggtggccccacctacagtcagggcccccaaagaacccctcctaagtaccctagagccctccccaagcctgaagtcaggggccttgtgcaataaagtggaggcccgggctgtgccacagccacagctcttctcatggggcctcagcttcctgattgtttaatgggtcccaagctccccaccctggccctgagtaccggggagctcaggcccaggggtgtggggcctccagggctactatggcccatctgtccgtgaacagaaagggccttgccctccagcttgagctgggtgcctgtggacagaagcaggactttggccaccactggcaccagaaccctcagcaccagctgctaggggtgagggtcgggtgcccccaggtcaaggtggcctgagcctgcccacccaaggacagggacataagaatctggacaatcctgccagcctgaagggagggcagccaccctggagcagcccaagtgctcctgagtccttgccacctcccctctgcccacagggcagaccgcagcagagaccccaggccagcccccggagtctgcaaatgaaaggtgggtcccacctcacccctgccccacccagcccactgtggcttctcctgggtactacacaggcatttacctgagtgggcaccagccaagacccacccacacacctccagccccacagcctgtgggtggggccgctgggaatcctcactggccagtaaagcgacgggttccacaaacactgatgggactgtggcagtcccagctctgccacaaactggccagtggccttggccaagcccctcactactctggggctcaggttccatctgtacattgggtgtggtgctggggggactctggggagctctgacactcagtgatcctatgaccctgttcagtttactcactgggtcactgtccctgcgtcggtctccccagctgtatagaactgggcctgtgccacatttgagttacccagtggccttggtggagctaatgatgcacag

SEQ ID NO: 4761 - DNA, 545 bp, Homo sapiens
acttccggcggggcctcccagctggaagaggcggtggcggcgggtcggggcgaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 4762 - DNA, 2229 bp, Homo sapiens
aggagcggtccccgaggccggccagggacccagcctcctccgccactaccaacccgcgttccccacgcgcgccgccgccagttggccccgcgcgttctccaggtggaggccaggaggcagagaaccgcgggcccgggggccacccgtcactttcaagtcgccccgccagaagcccagggcgaggaaaaggagagagacaaaagagcgctgcggggggagtccccacaccccccgcggccccgcacacggcccggctcttactcgtagtggcggaagatctcgttggtgactttacagtagaaaacttcctcgtcgggccgcaggtccgcgggcggcttctgtctcacaaacggctttcggtgtagcagcggcatctcccgtccgcccgcgggctcgcctggaccctcggccgcccgcgccggccccgcttccctatcaaaattggagggaaaggaaagccggtaaggtggggagccctcggcggcagcgtgggccggtccgcgcgctgggagaagctcggctgccttttgtgtgactgacgcgccgcggccgctaccggagccgagttcgttcctgccgctgcccgggtgtcgagcgagcggagccgccgccgcccctgccccccgagcgcgccctacctcctctcgtcctgccgccgcctcacaatggggcaggacgccccgccgcggggggcagtgcgggagcggcggcggccccctcccccagcgccggctcctcgcccgccgccgccgccaggctcacaacgtgctcggcgcgcagctggccggccggccagcccaacgccgccagagcgctcgccgcgggcggaccccggagctgctccgctttgttcccggctcgcctccacttccccgccggcgccggccggctcccgagcgaccctcacctgcgatcacgccgactgccacttgtccaccttctccactacaaaggcaacgaggggagaccccgtcctcccaggggaccgcctctctccggccccgccgcgcccctggctgccgcttctcccgctgccactgcccgactccgcgcggggaattgcgtcccaccgccacttccccgcctctcggagctcctgggaagtttctgatctactttcggctctgaaggaggaagagctgttgggaggagcttttcactcctcgcttctacctttttattggctactcgatgacttttacagcctgtcactgatacaggaagagacagcggagagcctgggagaactacattattaattaatggagcaacccctcgtgaagattcagaagcatcctccatgtttgagattatcagccaaaagatctagggaaagcgctgggggttcataaacacatggctaacaaagtaaagccttcaagtctggcacagactcttgactacacgatgggaaaagggattccaattacgatttaacttgtattttaaagatgagaaaagaaatgaataagaaaatttgttgctatttttcttcttccaaattagaatctatatctctaaaaatactttgcatgtttagtaaacatccatcttgaacagaagataccttgacatcagttctatttaatacttatggcaattaagagatttagaaagcagaggaaaagaccaaaaaaaaagtatgtgttacaaagtgtcatcatgcttgtaggaccccagcattcttgaaactaacgcacctttaaaaagtaatatttacactgctgtaaatatttgcaaagtatcaatgtttaattcacttagaattttaaggattatggatttactagcgaaaattcccctaaagcaactttcccatatcagtaacttttatttagggaaacaagtttaatgtacataatacatgtgaccttggaattcaatagaattttcgaaactagaagtaactcagaacgttcactagatgtgttttaaagtcttttttgatactgtccttaacatttgcttatttgcaaattaatatgtaagaatgagtctaaaagtaagttttaggaatggttattcgacaaagatgttattcctattaccaatactgcgaaatgataattacagaaacaatgtgggatccgttttataacttcaaatttaagttcctttgtactttggagcagaaaatgtaagaaatcgaaatcaagagttagtattttttatctttcaggctggctttaactgttcatacacctagcaaaataaacatttgtgaaaggc

SEQ ID NO: 4763 - DNA, 3057 bp, Homo sapiens
cgcacagacgagttttcgccatgttggccaggctggtctcgaactcctggcctcaagtgatccacccgcctcggcctcccaaagtcctgggattacaggcatgagccacctcgtccagcccttattgtcattttttaaaaataaaaattcatctatttctaaccatatattccattccccaataatcctaggtaagaatttagtgtcttcgaaacgtgtagaaatcttaacatgggagcagtgtgaaaagaatggcaagacggagagaggctgcttcagaaggccccagcagagctggcgacctgcagacagacaaaggtggtgcagctgggaggcagaccccgggctccacctaggatagaggatgtgtgatgtggctctgtgtgtctttacagaggatgggaccactgtaaagacaactgctaaatgatgagacagcccaaggggctcccacatcccaacagggacctggtgctggtggctgacacatgcacatcacaccatgaacatgaagccacacggacagcagttatagaagacccagttttacccagaaaaggatttctgtgcacaatgcagttgcattttcagaggcaagaccgtgagagagagccaactgagactcacggtgacggcggcttccagatctgcatgtgtcacacgaaaatgaggtcacagaggtgccgctgtcaagtagtttaatcatagtccctaccgtgtgtacctaaagaagagaactgtccttccctggacaaaccacccaccaggtcgagactccgatccggacgctccctgcacattaccagggtctgtcaccacccgctttgcttctcagttctgtgtgacaccaacgcccagggcccacaggggacgattatcattaaccagtttgtcctttctttgaccacataactctttgttttcaatgttacttatgaatattgagaaaaactgagccgaatatctggtgtatgtggttattataacttaatcaaaagctgtcacattcattcctggcagtcacttctgctgaagctgtaacttcccaacagggaggcacaatgtttttccctatggtagtagttttcaaccttttaaaaagcattaaaatgccttctaggctgaggcaggagaatcgctggaacccggaaggcaaaggtttcaagggattccctgccttggcctcccaagtagctgggattacaggtgcctgctaccatgcccagctaatttttgcatttttagtagagatagagtttccccatgttggccaagctggtctcaaactactaacctcaaatgatccacccgccttggcctcccaaagtggtgggattacaggcatgagctacagcaaccgggcacaggtatactctttttttttttttttctttttgagacagagtcttgggggggaaaaagtgtactttgaaaagaaaatcaaaagttggtcgagtttagcattctgccttctcagaaccttagagttgtggggttggaggccaaggccttcctctgaagactctgaggcagcctcagctgcccacccagtgaattcactcattttatctaagactccatctgaagagggggctgcctccatgcacaaagtgagtctaggaaccactgcactggataatttaaaactcaaactgttttggtagatcacccgtggccaacgcaccctgggatgaattccatcaaacctgcagagctatcaggggacacaccagatacacagcctgcacatggcctatagaatcaggtgtccaaagtgagaaaggaagcgtggaaggaggaaaccagcaggcgtgcagaggagcagctgctttcatccccagcagcgacacttccagcccgcgggcctgacggggacacctgcccacgaaccccctgcaggggacacgagttctccttcctctccgagtccatctttaagatggtaacagagctctgaatcgtcaccattttatcatcagatgatttcatgtcaacatggacctagaaatactgtctcaagagaaacttcctccagaacttcattcaagaggatcacaatctgcaccctggctcctacagcctagataaaggacttgtccttctatacgaagcatgcagatacgacagcaaccaagagaagagtacagtacacagttctgacaggatgcgggcgacagggaggcctgcgggccaggatttcagtttagactactgcccaactggggttgagtgggcaaagcagatgctgattggttgtcttggcacagagaaaaaccaaagcaagaaagctgccagatagacagtcaaagagaatgttctccctcaaattttgctactaacattttttataaaatatttatttagaatgctagctcctaccaaattgctatagctatagaaaatcctaaagaataaaaggatttacattgtaagaaagcccaaaactacaatttggcagaacatctgtagaattataactaatcaaactgtactacggcaacttcaaaaaaccaactgtgcccctagatgagtcaaatgccgccttcaattctccctgacaaaagtaaaataccaaagacatcagcttatgtatcaaaaaaaaaaaaaaaaatccatgtgctaaaaaattcactggagaaaaaatgtccagaaggccacatggtctttggcaaccactggataaacagcagtggttaggaatttccaggggcaaaccagtaaaacccagagggggccctgtgcagcctctcaggcacatggcgggctggcaaccaggaagagccagccccaaagatctggacgccctctcaggggaaatgcaggacgctcaggactgaggcaggacatcaagagagcagccatgtaagctcttgtttctgacctgttttctaaaaacaaattccacttaaacagcatctccctttaaagcatttcaactcattctaacaaaatctagagcagcctggtcagtgaagttaggagcactggagttagcaatgaaatgggtgagttaaagaagcaagttagttatctgccacactgatcccaatattaaaa

SEQ ID NO: 4764 - DNA, 1033 bp, Homo sapiens
gttcatggcaggattcggttaggaggaacagcacagcatgctgggctctggatttaaagctgagcacttaagagtgaatttgagattagtcataaatcgccttgaactattggaggaaaaaaaaaaaaaacagaactggcccagaaagcaaggaaggagattgctgactatctggctgctgggaaagatgaacgagctcggatccgtgtggagcacattatccgggaagactacttcgtggaggccatggagatcctggagctgtactgtgatctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaagtaatatggcaagctatgtaggaccaaccagattggaactgtgaatgacaggctaatgcacaatctgagtgtggaagccccatccaaaatcctggtggagagatacctgattgaaattgcgaagaattacaatgtaccctatgaacctgactctgtggtcatggcagaagctccttctggggtagagacagatcttattgatgttggattcacagatgatgtgaagaaaggaggccctggaagaggagggggtggtgggttcacagcaccagttggtggacctgatggaatggtgccaatgcccatgcctatgcccatgctatctgcaaatactcctttctcatatccactgccaaagggaccatcagatttcaatggactgccaatggggacttaccaggcctttcccaatatttatccatctcagataccagcaactcccccatcatatgaatctgtagatgacattaatgctgataagaatatctcttctgcacagattgttggtcctggacccaagccagaagcctctgcaaagcttccttcctgacctgcggataactatgacaactttgtcctaccagagttgccatctgtgccag

SEQ ID NO: 4765 - DNA, 2543 bp, Homo sapiens; identical to SEQ ID NO: 3547

SEQ ID NO: 4766 - DNA, 754 bp, Homo sapiens
cgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgt

SEQ ID NO: 4767 - DNA, 4452 bp, Homo sapiens
aaaatacacaaattagctgggtgtggtgacacacacatatagtcccagctaattagggggctgaggtgggaagatcacttgagctccaggaggtggaggctgcagtgagccaagttggtgtcactgtactctagcctgggtggcaaagtgagaccctgtctcaatcaatcaatcaatcaatcaatcaatatctcatgctgtaattgtcttctgatgttttcatccacccagccccacctctgcagccttaattactggagtaggtccatgatttcagtgtagggttaatgtattctgcagatcatctttgatttgacctgcttttttgcttcctttttatctctgaacaaaggagatcatcattctctttaatctgccttctgtgtaaatctctaccagactggaagctccctgaaagcagaaactgtctgcttccccagaacttagcactgtgctttcatgtatgtgggataaatttttactttgttagtgcaactttgtttgtacacgttatccttgatattacatacatttgttgatgggggcaatttatatttgttgtgagtaaaatacttttttgttggattaagaagaactatactcttcccagcactttgggaggccaaggaggacggattacctgaggttagtagcttgagaccagcctgaccaacatggagaaaccccatctctattaaaactacaaaaaaattagctgtgcgttgtggcacatgcctgtaatcccagctagtcaggaggctgaggcaggagaaccgcttgaacccctgaggcagaggttgcggttgagccgagatcgcgccattgcactccagcctgggcaacaagagttaaactccatttcaaaaaaacaaaaacaaaaacaaaaacaaaaaaacaaaagaagaactactctgtagtgagagctagaatcctcatgttgtttatttaaaatttttggccaagtacagtggctcatgcctgtaatcccagcactttgggaggctgaggccagaggatcacttgaagccaggagttcagttacagcttgggcagcaaagtgagaccttgtctctacaaaaaaattttttttaaattagccaggtgtggtggtatgcccctgtagtcccagctactcaggaaaccgaagcaggagaatcgcttgaacacaggagtttgagggtgctatgagctatgattgtgccactgcactccagcctgggcaacagggcaaggccctgtcttaataaaataaaataaaattcttaatatgtttatatatttgaaaaactatttgtgtagagacacatgtctgtaaatacacatagatatattaactttttaagctttaattgaagcctttctcttcacaggttttatatatttgactgcagatgactaacagattgaattttaagagtgcgaaacactctggtgctatagggaaggaacttcataaatagcccctcctgtaagggaccagtctttaatttaaaacagtccagcccaggaatcttgcaagaattttgtaattatttgaggagagatgtagatataccctggagttctttgactttaagttattctagagtcatcccagagatggcctagaagacttgaatgtaccccaaaggattctgaatccctttgggaaatttagactatgattttcagtaagaattaaaagccccaggataagcgtggtggttcacacctgtaatcccagcaatttgtgaggccaaggcgggaggatcgcttgagctcaggagttcgagaccagcctaggcaacatagtgagaccccacccatctcaatttaaaaaaagagagaaaaaggccaggtgtagtggctcacgcctgtaatcccagcactttgggaggccaaggcgggtggatcacctgaggtcaggagttcaagaccagcctgatcaatatggtgaaaccccatctctactaaaaatacaaaaattagccagtcctgatggcatgtgcctgtggtcccagcgacttgggaggctgagacaggagaattgcttgaacccgggacgtggaggttgcagtgagccgagattgggccactgcattccagcctgggtgagagagcgagactctgtctcaaaaaaaaaaaagagagagagagagagagagagagaaagccccaaacataccttgggcctttacaacctacttggtcccagaatcgtcttattgtaaacccaaagccaggtcttctggttcgaaccagtcaaaatgggtaatctaaaaaagttaaatagatgattcaaaatcgtgttggtggttttttctttttaaatcccctttccaagtaaaaggaatcttttttttttttttaagttttgaagcctcatagccataaatattttggcaccagcatctattggcacctaagtcattggctgtatcatattcccatgggacccttgttcctagaggaatgcaggaatgatcttggagtgggaaggacagaaacaggtgcttgcaaaatcagatatttctgaaattctctgttattctatttctactgtctttccccactttactataaatttgatctgttataaaatggctgtgtttagatagatacccgtgatgtttaggaaacaaatgatatagagactcccatttaaatgaatcttatctttataagaaacagccaaactgttttccagactggctataccatcttacattcccaccaggaatgtatgagtgatccagtttctctgcatgctcgccagcatttggtgttgtcactatttcttatttcaaccattctgtttatccttttcagtgaaatatctgttcatatcttttgcccatttgccaattgaggcaggaggatcacttgagcccaggagttcgaggctgcagtgagatatgatcactaaatgtttgcttaatgagccatatctttaaatatcttttttaaagtttttaaaagtcagtccagtggtttatgtgattatgtgggattttttaaatctttccaggcaaaatgtgtatagcattttgaacatatttacactgtactgagcccaagagttctcatattctttctttgctcattatagagtatggtactaatactgtataatagtaaattttcaaagatacctttatttagaatgttagagtatacagatatatactttgtacatagttatcataatgtttctaacctttttatttaaagcaggctgatttgtgtaaaggtttcagaatgattttgttaataagttattagaaactttcctatttgtacaagatggtaaatgtagattccaatttgtatgcctcagtaaattcataatcttatttctctgatgtgagccactgtgcctggccttctgtgatgctcttaatgaattttgcagttttattaaattgtcattgagaacctcataaatcattgttaagatctatacaaaaaatcaaggatccacagtaatagaatatttttcatctgcatatgaatttttcccttccctttttgtctacttttagatttaaaaaaaattaccaggacattcttattaaatactattacctgttttggtttctgcacattaagaaagtcacagagaagccagacacagtggcatgctcttctattcccagctactcaggaggctgaggctggagaatcacttgagcccaggagtttgaggatatcctgggcaacatggtgaaacttggcaaaaacaaaaacaaggccgggcatggtggctcacacgtgtagtcccagcactttgggaggccacggctggcggatcacgaggtcaggagatcgagaccatcctggctaacatggtgaaaccctgtctctactaaaaatacaaaaaattagccaggcgtggtggcgggtgcctgtactcccagctactcgggaggctgaggcaagagaatggcatgaacccaggaggcggagcttgcagtgagctgagatcgcgccactgcactcctgcctgggtgacagagtgagactccatctcaaaaaaaaaaaacaaaaacaacaacaacaacaacaaaaaacaaccagagaaatagcacttgttaactacaattgtgactctaggtaaacttgggccttaatatggttagacaagaagggttttaggtaacttgcctttttagatcctatttaggcttattagtctatattctacattcttgcacgatggaaattactagagaagtgggataattctttgttgtggggaaaataaaatttgttgtgaaaatatactgtattttaaaatatttagaaagattataaataactggagaaaagataatttcatatactaatatgatggaattagcctagcagatgttaaaaatcctttctgaaaattataatctaaaattatttgggaaattacaatggaactgaataatctgtacgttggtatattaaagccatttttatattgtg

SEQ ID NO: 4768 - DNA, 6246 bp, Homo sapiens
actaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggttagtataaatgtggaagggagaagtatgcactcaccagactaaagtttacagttttcacataggttgtgctgttctgtgtcccataagggcctgcgagaacccagacattctgaatcggtgacgcctgctggaggcagcaacacctgttgcattaattttagaacacacacacacggagttggtaattcttaagcttcctgaatctgctggcggtcatttggtgtcagaagcagagcaaagccatcttggtcatctccctccttttagcttaaaccgaagcatgatgggggagataggccgaaagttatacagcttgttaataacagagccgagagtgaaagcgcgatttcttcatttttagcccggaattatttgttgtacaccatactgtttctttgcattgctagacaattcgtctttttttacgaggttgacggggagttgcaaggaggagtgaaaagggtggtaatgtacatctacatacagtataaatccatgaaaggcaaaatccgtgtgtgttaggagttagaactgtgtcagtcatctacatcttccatagtttgtagatggagatgagtctgtcacgtcgctctgtcatttcccttttagcaacagatgtgtagtaacaatatgtgaagaaggaactttcattgcctgttacatacatttacacagagcggcctggggttcactgagcaagctatgtgctcaccctagaaaactgattctgtagagtgcactgcagtcaaacctcagctgttttaagtaatcttacatttggtgcttgtgtggcttaagtgtcttgtgcattattgcagtcatctctctcatgttatgaaatggaaatgtgttgtaggaaagtggcaagcctgtgaagaaagtaagtgagcctgaggcccagaaaaccatacattagcaaatactgaaaaactgttcacatcacatagggggtatctgaagtactgaggagctcatttaaccggatgttcattgtggggaagccatgaatagcctccctctcctgggttcaagcgattttcctgcctcagcctcccgagtagctgtgattacaggtccatgccaccatgctcggctaatttttgtatttttagtagagacaggggtctcaccatgttggccaggctgatctcgaactcctgacctcaggtgatcctcccaccttggcctcccaaagtgctgggattacaggtgtgagccaccgtgcctggctcctatataaacaattttcaaacttgttggtctcaagagccacttaacagttattgaagactccaaagagcttttgttcatatgaaaatagttttgacttcactaacccccagaagggctttcagaagcccccacagaaaccaacttttaagaactactttatgcagatgtttcaaagacattttagattatgtagaggaatgattgctgttgtgattgtgacataagcagaagtatcaacttaaaaatgcaacaacaagcacagtagcttgtatttccagtagctgtataattccaggcacagagaacacaaacagatgtccatttttaattcttttcttgttttttttgagacaggacctcactgtcacccaggctggagtgcagtggtgcaatcacagctcactggcagcctcgacctcctgagctcaagagctcctccacctcagcctcctgagtagctggggccacaggtgtgtgctaccaccctggctaattaaaaaaaaaaatgttttgtagagacagtgtctctctgtgttgctcagactgaccagcctggggcaacagggcaaaaccccatctctacaaaactgcacccagctattttgtattatttttatctcgttgctttttttttttttctttttctttctttcttttttttttttagtggtttcaggcagtggttcagaccagctgctagagaatcatgggctaagaagagaagactaccaatttagtagatttggacatggacaagccacaggcagtttctcttctcactctcttggccagtcatctcttgctcaccttcccctgccagtagccagtagcatgtgacagcctctatattccatctcccttttctccctcttccagaactaagatgagttttcaatggataactgtacagaaacatacccactgctgagtttataataaataggtaaatggtgtttaaaatgccttctgtaggaatccttggtagatagttatatgtggttgttttttgggaagttggcttgaggttctttgaagggctgggaacgtgtatttcttttgcgtgtgcctgtgtgtgtcaaaattttatatgttcatcagtgctctacacgttcagagaaacgtttccaataacgaaccatagaatgatccctggagcataggatcccactgtttgaaaattctagccatcgatcactttataagaaaaggatgaaatttcaaacaaggagtttgtttatctgatttccaccctacagataatatataaatttggccaaagttgtttggggaagaggggctgttgttaggtactgagctataatactttgttgctttgtatcacttttaaaagtgacttttaaagatacttgacatttgaaaaggaatcacctttgatctttctaagtccctaatttgacattacctttatagcatataatttattccataaagtcttagatcctgaaactagtggaaagccaaatactcatgttgtgctataaatataggattgacagttaagcttactcagtagtcaagggggcggctttcactcaccagcctccagggcatatgaaccaaatttatgattcagaacatttaaaatatacattttgaagatctttgggctctcttaagtatagtctaactataataaatattaaacatgtcaaaggtctcttgcagtgttgggaagagcattctaaaccacatacatctttcccatccccagattgttctgtgtcccctcccactcttcccagattagaagtcaccatggagcactattagtaatgggactctgtatcagatctttaaggtgtattgggacagaagaaaggttgatattttggggttgtttgttttttttgagacggagttttcactcttgttgcccaggctggagtgctatggcgtgatcttggctcactacaatctccgcctccctggttcaagcaattctcctgcctcagcctcctgagtagctgggattacatgcgcccaccaccatgcccggctaatttttgtatttttagtagagacggggtttcatcatgttggctaggctggtctcgaactcctgacctcaggtgatctgcctgtcttggcctcccaaaatgttgggattacaggtgtgagccaccatgcccagcaggttcatatttttaatgtttccttctactccccaagcacacacaaatttgaaagctgctttgctttctaataaagaggcttttcctttgattttggaagataatttgatgtctcttttctctttgcaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagaggtgagtgtggcacttaacctctcctgggagggggaggaataaggcagtgtttccaagaggtgattttggagctatacaggcattaggtagacaaggaaggggaggtccattctgggtgcctaggactctgtggctgatttataaatcgtaaatggtacaaaaaacagtgttgagtatcttttacctttctccagagtactgttcttacttttggatagtgcttcttgttttttccttccctctccctgtccctgtcacctttaaattaaatgaatgtttggaaggaagtaggagggtaagaatctttctgggtggcagaataatagatgggtctaccaagagcgatgtatatacccagtaaagccatctctaaaactgtgtttctgcattgttacagtgcatagttgggaaatctcagttttgttggctgtgtactttcccagtgaatggattatattcctttctgcgagccagtctgtttgaatttaagggcatctcttaaattcctttcaagcaagagacctaacatttatacttaggaatgagagtagtagagacagcaagattagaatccaagttcatataccaaaacatttttatttgctatgtctgagtgactacatgttgtttgaatcaactgcaggctaatttgtaacatttcaaataaatgatagtttaattcctccaggatttgagtaaggtgaaaatagagctaaaaaccatgattctgtcacagtctgggaaaatgaaaaagcaatcaattagtgagttgggcttaattttttttttttttttttctggaactggtgatagcagaaaacaagcagtaaagtagtcagacatgatatacttgacaagaaccaccacctgttcagtagcaactctaaaataagtactaacttaggggcagttgttgtgcccaggtcatagtcatactccttccaggagacttcctgatgacagaaaagatgctgaccagctggggtcttctttccaaataacttttctcttgcatttagattaattaaccattggttacagtgaaacaagcatatgtacagagttaatctcctatagcttgaagttatacatgatctttatttgagtatcttgacttgttaaaggacagtgttttaaaagctggatttggttatgttcttctggagactaagaaaatagagtccttgaaatcaagctgactctgcttttagcctcctaaatgaaaaggtagatagaacaggtcttgtttgcaaaataaattcaagacctacttatctaccaacagcaattacacgctttccattgtcttcctatagaaaataggagtagtacacttatagatgagaaaactggagaaagacatagtgaacatgtgagaatcttgctctactaattgataggaaggtgactagaaattggcgaagttttcttggtaagttgaggagaggacttttcttatagtgcagtctggtagctgaaccgccttgcatcaagaccaatgtagtcttatttacagaatgccacatcacagtgaattgtgctgtggacagcttccagtgtgtgagttgtggaagatgatgattttaacagattttggaggatgagaagtattaagaagaaggccccactgtccatgcatttgctctgctttttacttttgaccaagtatacacttcagaaatatcttattggatgtatacaaagtgattgtgtgtcatttgaaccagcaggaagtaatttattaaacacacttttctaaataaaagtcatttaattttatcagaaatcagtgtcattttagattgcaagtctcaaaccaactttccaattctgacttgtaagggtgccttaaatcctgaatactgtactctgtattactaaacccatgttagtttacgccaagattctgtggtggttttacatattctttttcccctttgttaaggtggggaggccacagcttatgtgaatgactttctcaggagttataaagtgatacaggtaaagctaagaaaagaacagattttgataacttttgttttaactgtccagtgttagggattgtggctacagtggtctaatttttaaaaactcttttttttgctttgttttttaacagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttc

SEQ ID NO: 4769 - DNA, 1861 bp, Homo sapiens
gctaaaatgaatgactcttcctgctcacttaaacctgtgctcaaaatgacatatttgtcaggcaccctcttcatttaccttaaagaaggagagtttaatgtccatcttggttctgccctatgaatcatcttgtcaagaacaggtgttcttatgcagaaacaatgaaaaccttatactgaagtgtgaaccctggatttcttagtttcttctgagtcctagaagaagggttggaatagaataatacatttacaggatttaggttggttttctttctgtccagtctcatctgaatttcgtctgtctcttgtggtccagaagttccacagagcaacgcagctgcatgtggtgacaggtagagcagttaaagctgccaataggaactcgtccatattccacacacctggtatagtgttatgccctccatgggcacttacctgcaataagcagaagccactgccacattcccgtgtattgggaaaatggactactgtgtgcgaacaggccctttaccctaatggcagggaagatggattatctttggccagtggagctgccaatctagacatacacattcaactgaatacaattaaaagcagttctttaaatgcaaatataattactcatctttataatacaatagtattaactgcccatatgctcatagtatgatgagccctgtatagcacaaggtcaacaggtcctctccttgtccttacaatctaaagcagatgacactgacatggacaaacaagtgcacatgcatagttgcggcagttttagagaaatctagaaagctaggtagcaacactatgcataaatgttgtggtccaatgcattagtttgctttaacaaaaatctgggaggtattttttctctttattcaggaaggcttcatgaagcaggaagtggtcaaaggagggaaggttactggttaaattatgataggaagaactttccataactagttgcaaaattgagtgctgggtgggttgaggaatgggaaaaagggggagcaaggtgttttgtgtagatggaacaaagggcaaaggatagactgtaaggaaggccagataaagcttggagtagcatgagaacttgaggaatagtatgatatgggctgtgcagcaggcagagagaatcaccttagctgaaacatgggtgttaggagcagaccatgaggtggtagaaccatcatctatagtaaatcaggtactacgctataactattgataaggaaacagctgactgccactgaaagaataagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaaacaccagtctgaagcagtgcctcaggatctcagatgatttaggaagtgtgctgtaatgtcaaaaaaaaaaaaaagtattgtctttagtatatctatgtatagtctcgtgggaaaagcattggttgtggtatcaacagatattctggttccagatgtcttgtaagttaacctgcctccatttccctttctgtaaagcaaaataatgtttacacctaatctgtctctcagggataccatattaataaaaatcatgtctat

SEQ ID NO: 4770 - DNA, 13978 bp, Homo sapiens
gtttcctcgcatacattaccatcaatgcccggcctgtgagtgtgtgtcggggaggggggagagcggccgcgaaaggcgggcgggcgcgcaggcggcggcggcggcgggcggcgggcagccccggcacctgggcccggcgcgccctcggcgactctcatcagctcccagttactggcgccggcgctcccgggccatctccctccgtcgacaccacgctcactctcagccggggcagcggcgccaactacacggcggcaccgcgaaccggggggaggggggcaagacgacgcgtccggctcagccccgcggagagcgactgcctcctccgccttctcctcctcctgctccgccgcctcctcccctcctccccccgccgccgccgctgctgccgccgcctggtccttcttctcctcctcctcctcccgccgccgccgccgccgctggtgccgccgctgccgctccaccaactacatccgggcaactcggacgctgccgccttcgggaaacctcggcagtttccgccgggcccctcctctcccaccctcggccttcctccccgcaccgcgcgggtccggaacaccgccctcggcaaacctcggctggctccggcctttctcctcctctgaggcctggatcttctcttcgcgaccagtctgccctttccttcttttcctcactcgcgagtcggccaccgccgttcccgtttagggatagtctcgctcgggcgcctgctcgaggctgatctcaggggctccgggctgcgcagggagggagccgccttccggaagaggacggtggggcgcgagggaagccatcgcggactaaataagggaggctgcagcggctgcgcgtgcgcccagaggcgcagcgggagggggtgctctcgggcgagctctccggccgcggcccccgcccctgcgctgtcgggcggggaggtcggaaaccccctggcgagaccacgggcggacgcttcccgaagagctgcctgggctgcagccgcggaagctgcgttctggggagcggggagcgtgctccggcgccttcgggccgctgctggaagccggaaccgagcccgggccgctgcccctcaccggacgccgcgcgccaccggccctccgcggggcaggggctgctgcgagctcgccgggcgccctttagacgtaagtctcaccctgcgccccgaggcaggaaggagcgcgtgcagtcccggccagaaacggctaataggaagggctgaggggttctgtgttcaaggcagaaggccgtgcgtcagggcggccctcagcggagatgcgtgcacggagcggggagcgccgctcggggcagggaatgaaagcggcgcttgagactggaaatttagggagatgagttccttgggaacaacgctgaaccatctcactgccccaccctaccccttgttatttttttttgagacaggtctcgcgctgtcgtccagtctgagtgcagtgacgcgatcacggctcactgcagcctcgacctccggggcttacgggtcatcccacctcagccctctaagtagctggcaccacgggcatgcaccaccacacccggctaattttttaaaaaaagtttttccggagatagggtctcgctgtgttacccaggctggtctcgaacccctggcctgaagcgatcctcccgcctcggcctcccaaagtgctgggattacaggcgtgagccactgcgctcggcttttcacccctttctaacgttttccatccctttctaacgttttccatacccagcggtgccctgcccaccctctctttatctctcacttttccctcctctgtttcttcctcgctgaagtccattggtgaaagaaaattcatgtgaaagttctcagagtcgtccttgtctactccactaccaaatgttgaagttcttcaagaatcagtcctttggaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcaaaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaaaaaaaaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcgtggtggtgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacctttctcagatacctgtgcatcttatgggttttgtttttctctttgagacagtctcaccctgttgcccaggctggagtgcagtggcatggtctcagctcattgcagcctccgcctcctgggttcaggtggttctgcctcagccccttgatcggctgggattgcatgcatgtgccaccatgcccggctcatttttgtatttttagtggagatggagacagagtttcaccatgttggccgggctggtcttgggctcctgacctcaggtgatccgcaagcctgggcctcccggggtgctgggattacacgcgtgggcaactgcgcccagcccttgtgtaccttatgtgaggaagtcctgctcaatcaggatcggtcacgcaggccctgatcttgctactctggttccatgtcctatggaagaccaaagtttaccaagatagatttttcccttcatagtggcagatactgttaacccctgcaccatctataactcagaaatccccaccatttcttcccctgggcttcagaatagaattgcctggtttctctgatgatcagcacacttccttaaaacccaaatcagcaaggaatgaacaattttgtttggcatggatgaaattagcactgtttggctcggtaggccccagacaggcaggcaccttaattttttccttgcatattctagtcttcagaagcattgccttttgtcctactggtagtgacatagatcaataacagggcatctggggattttaatcctgaaaacagtgagtctgatactgcttgtgtttttcatcagtgtccaccccgagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacgtgccagcttaggctgggcgcggtggctcacgcctgtagtcccagcacttcgggaggctggggcaggcggatcacctgaggtcaggagttcgggaccggcctgaccaacgtggagaaattctgtccctactaaaaatgcaaaattggccgggtgtggtggtgcatgcctgtaatcccagctacttgggaggctgaggcaagagaattgcttgaacccagggaggcggaggttgcagtgagccgagatcacgccattgcattccagcttgggcaacaaaagcaaaactctgtctcaaaaaaaaaaaaaagtgccagcgtatgaggtaattagattggttctctccagaggtaacctgccaagaagagatgctatagatgttactcatatactgtaaaacattgtgaaatcagattactttaaaatgatgtattacaaagttttgcaaaaaagcagttgtgactgtggaagcccaaggcttatatcccagctctgtcttacactaaatatgggtagagtgtttccactctgtccataaaatgggagctaatattctccaacctgtgtgcctgacatgatggttaaaaggattaaacaaaacaatagtttgtaatttattctgtcagagcacactgctggtaaataaaagggagtaagttgactaaaactaaatttaaaaaaaaatcctaataaaacaagtttgtaatttataattgtatacaaataaaagatgttacaaaaaaaaaaaagacccacaccaagacacatcataattaaaccgtcaaaagtcaatgacaatcctgcaagcagcaagagagaagcaattcctcacgtacaaaggattctcaataagattaatagctgacttctcattagaaaccacagaggccaggaggcagaggcagtgggatgatatattcgaagtgctgaaagaaaaaactgtcaagaattctgtgtccagcaaaactatccttcaaaaaaaaaaaaaaaaagtgaaggagaaattaagacattcacagataagcaaaaacagaaagagtatctcactagtagtcctgccttacaagaaatactaaaaggatccttcagcctgaaatgaaaagacactagacagtgattcagatccacatgaggaaataaaaaacactgaaaaagatttaaatacataggtagatataaatgaaagcaataattatatctgtgtcaaagcacaatgtataaaggtgattcatgatgaggaaaagatgaagtataggagcaaaaattttgtgtactattgaaactaagttggtatttatttgaaatagattgttataaatgaaagttaattgtaatccctagagcaactactaagaaaataactaaaaattttggaaagggaataaaaatggtatgctagaaaatatctaatacaaaaaaggcataagggaggaattgaggaagacatagggaaaacaaatagcaaggggcaatgtccttcctactaattacattaaatgtgaatgccttaaattccatttaacagatggagagattggcagaatggagtcttttaaatgttctaactatatcctgtttacagaagactgactttagaaccaaagacacaaacatgttgaaagtgaaagggtgtcaccttagttttctttctttttttttttttttgagatggagtttcactctttttgcccaggctggaatgcaatggcgtgcttggctcaccacaacctccgcctcctgggtccaagcaattctcctgcctcagcctcctgagtagctgggattacaggcatgcgccaccacgcccagctaattttgtattttttagtagagatggggtttctccatgttggccaggctggtcttgaactcccaacctcaggtgatctgcccgcctcggcctcccaaagtgctggggttacaggctgagccaccgcgcccggccagcaccttagttttcttgtgctgccgtaacagaatacctgagactgggtaatttatatagagcagaaatttattttctcacagttttggaatctgagaaactcaaaattacgacattggcaggtttggttgtctggtaagagctgctttctgcttccaagatgacaccttattgctgcatcttctataggggaggaatgttacatcctcaacgtggcagaaggtaaaagggcaaaaaggaatgaaattcctcatcaggccctaagttaagggcacctaatctcattcatgaggggaggagccctcaagacttaaccacctcttactggctgggcgcagtggctcacgcctgtaatcccagcactttggaaggccgaggcgggtggatcacaaggtcaggagatagagaccatcctggtcctagtagagacacggtgaaacgcggtctttactaaaaatacaaaaacaagattagccggccgtgctggcgggcgcctgtagtcccagctacttgggaggctgagatgggagaatggcgtgaacctgggaggcggagcttgcagtaagccgagattgcgccactgcactccagcctgggcgacagagcaagactccgcctcaaaaaaaaaaaaaaaaaaaagacttaaccacctcttaaaagtcccacctcttaataccatcatgttggccattaagtttaaatatctgaattttggagggcacacattcaaaccatagcaagtggaaaaagacattccaagatatctcaggttcacatggaacattcttcagaataaaacatgttagtccacaagtctcagttttaaaagattgaattacaaagtgccttctctgactacaatggaataaaactgaaaataacacacccttaaacaaccaatggatcaaagaaagattaaatcacaagagaaatcagaaaatactttgagatgaataaaaacaaaaatgcagcaccctaaaacgtttggaatgcagcaaaagcagtgctcaaaggcaattttatagctgcacatgcctacattaaaaaatacctagaatcagcaacctaaccttccaccttcaggaactagaaaaagaagaggaaatcaaacccaaagctagcagaaggaaggaaatagtaaagactggagtagagataaatgaaatatacagtagaaaatagaatccacaaaaccaaaatttggttgtttgaaataataatgttcacaaacccttaaaaagactgagcaagacaaaaagattcaggttactaaaatcaggaataaagtggggacattactgccaatcttacagaaataaaaaggattgtaaggaaatactattaacaattatatgctaacaaattagataacctagataaaatggacaaattcctagcagcacacaaactaccaaaactaactcaagaaaaaactaaacctataacagtactagttaaaaaaaaaaaaagtaaaccagttaaaaacaaaaaacttccaagataggaaagatcaaaccatgtggctttactggtgacgtaaagtattttaagagtgccagtccttctcaaacacttaaagtaggggaagagggaatatcttaactcattatatgatgccggcgttaccctggtaccaaatccagacaaagacatcacaagaaaataaaactacagtccaatagttctaatgaatatagatgcaaagatcctcagccaaagtgaatcctgaagcacattacaaggatatccacaaacaaaactgttagagctaatacctcaatatcacaggatgcccaggatcaacatacaaaaattagttatatttctgtatccttgcaatgaacatttcaaagtgaaatgaagaaaactcatttacagtagtatcaaaaagaataaaatactaataaacaagatgtaagacttacacactgagaactacaaaacatagttgagagaaatttaaaaagacctaaataaataggcattttatgttcacgtattagaagactttgaaaatggcaatactcccccaattaaccaacagaatcagtgaaattcctatgaaaattccaactgccattaatgtagaaatgggcaggttgatcctaaaattcataagaaattgcaaggatgtggccaggcgcggtggttcaacgtctgtaattccagcactttgggaggctgaggcgggcggatcacgaggtcaggagatagataccattctgggtaacacggttaaaccccgtctctactaaaaataaaaaaaaaaaaagtgtagccgggcaggtggtgggcgcctgtagtcccagctactggggaggctgaggcagaagaatggcatgaacccaggaggcagagtttgcaatgagccgagatcgcgccactgcactccagactgggtgagagagctagactccatctcgaaagaaaaaagaaaatgaaaaaaagaaattgcaaggatgccaaaacagtcttggaaaagaacaaagttagaagacccacattttgtgatttcaaaatttaccacgaagctacagtaatcaaaagagtgtggtactgacataaggatagatatgtaggccaagaaaacagaattgagagcccagaagtaagcctatacatctgtggtcaattgatttttgacaaaggtgtcaagatagatcactggggaatagaatagtatttttaagaaatgctgaggatactgggtatccacatgtaatagaatggatttggacccttaccttacaccacatgcaaacattaagtcaaaataaatcaaatacctaaatataagaatgaaactatacaactattaaaagaaaatattggggtaagtctacatgacctgggatttcccagtggattcttagatatgataccaagaactcaagtagcaacatgaaaaatagatacaactgggcttgatcaaaatttaaaactttacatatcaaatgacactatcaagaaagagaaaagagaacccactgagtgagagaaaatatttgcaagtcgtatacctggtaaagctcaaataactcttacaagtcatcagttaaaagacgacccaagttaaaaatgggcaaaggacttgaatagacatttctccaagggagatattctaatggccaagtacatgaagagatgctttgcatcataaccttccaccttaagggaaatgcaaatcaaaaccacgatgagataccactttctatactcactagggtgctattattaaaagacaagtgttggcaaggatgtggagaaattggaaagctcataaattgctggcggaaatataaaatggtgcgttcattataaaatagtttgatggtttatcaaaattttaaacggaattaacatataacccagcagctctcctaaatatatactcaagaggatagaaaactaatcaaacaaaaacttctgcatgagtgtgtatagcagcactataatagccaataagtagaaacaacccaaatgttcatcaatagatgaatggacaaattgtggtatattcatataatgaaaaactactcagccataaaaagaaattaggtactagtatatgttgcaacatggatcaaccttgaaagaccttgctaactgaaagaaaaggccacatcttacatgattgtatttatgtgaaacatctagaagaggcacatccatagagacagaaaacattggtggatgctaggggttagggaaatgtagaagtggggagttgctgcttaatgggtttcttttttgagtgatgaaaatattcagatttaggtagtggtgatacttgcaaacattgtgaatgtactggaaggcactgaattgtacagtaaaatggttaaaatggtgagttttatgtcatgtgaattttaccccaataatacctcaataataattttttaaaagtagcccctctcttagtccattttgtgctgctctaacagaatacccgaaactttataaagaacaaacgttggccgggcactgtggctcacgtctgtaatcccagcactttgggaggccgaggtgggcagatcacgaggtcaggaattaagaccagcctagccaacatggtgaaaccccgtctctactaaaaataacaaaaactagctgggcgtggtagcacatgcctgtaatcccagctacttgggaggctgaggcaggagaattgcttaaacccgggaggtgggggttgcagtgagctgcgatcacgccattgcactccagcctgggcaacagagcaagagattcttgtctaaaaaaaaaaaaaaggaactatattggcccacatttctggcagttgagaagtcctagatgaaggggccacatctagtgagggccttcttactgcatcgtaacggtggaaggcatcacatgatgagagagagagcaagaaaaggtgcttttgttacaagcccattccattataatgaacccactcccatgataacaagctattcatgaggacagagccatcatgacctattctctaattaggccctacctcccgacactgttgcattgaagattaattttccaacacaagaactttgggggacacaatccatagcagtccctctcttcactaatttctttccatgaattcttccactcccctgacttttgtgtgtagttaccatctatacacagatgcttcactagaggcagtttgtatctccaacccacatcttttttttgagttccagatgtgaatatcctgctgtttacttacctaccacctccacacatagcttcaaatgcaactttgaaatataaaactgagttcattaccttttctcctaaatttgattatctgtgaatgctttctgtctcactaaagatagcttccagtcattgagagtttgctgtatgtttggactaaagtgttaatccattaatttacttaatcctcacaagaacctcagataatactattttccatttgcagtgagaaagttgaaaggtaaaataacttattgaaatcacacaccttttaaggaaaggctagccctcaacaaaggcagcctgacttttcagagcctatgttcttaatgccattgctataccatcctctaactttttctagagacctagaagtcatctttgtcacttctctcctttacatgctttatcaagttgatcatgaggtcctattgatttgacttcctaaataactctcactccatccagttcatttcatctgctaccaccagccttattcaagcaaccatcttttgtctatacaatggcctcttaactaacctcccatattcactgacaacaacctaataaaaatatttataaatataaatttgtatcttacaggtagggaatttatattcttctcttattatgcccaaggaatatttccaaatattaatcataagattgatcacctagaaaaccttagtgaatcatgaaaagtagaaatcttaagagctgcttttcagatgatagtgcaataaaacctaaagtcaacaaaggttgtttttgtttcttgatgattttaactgttggtttactatcagtctctccaacactcctgccttaattcttggtgattttaatatgcacatcaatgatctttccaatatcttgacctccagcttcttggacacctcttttcattccacttcagccactcctttggtcattccctagttagatctgcttattaccattaactgcaaactcaattatctcaacttcatgcatccacctttctggctgccacatcctgtctttccagctttcccctctagatccctagctcctcataattatttatctttgttggtaattctaatctattgattctatcactgtttcactgcccctcacccttattttcctcctcacttggcttaaattccatagccagtcattgattggatattccttttacccactgacaaaaccgtaaccctaatcattacttatctactccattcttgctcccatgtagctgaacatgactggaagaaaaatgcaagagtttcactttaaattcttgaagacaaacctcatgtgacctcaaaatgctgccagtcaatcaaattatattttctccaagtttattcacttgtagtcagcttgggctgctacaataaaatatcataaagtaggtagcttgtaaacaacagattgtcttccttctggttctggaggctgggaaattcatgatcaaggcaccagcagatttagtgtctgttgaagtccagctttgtggttcatggatggtgacttctcactgtgagaagatatggtggaaggaaagaggggtcctttcttgagcctcttttataaggacactaatctcaatcatgaggaccaccccccataacctaatcaccctccaaacgtgattaggccttccaataccatcaccttgtgggttaggatttcaacatacgaattttgaagggacacaaacattcagagcatagcacccccttttcctgaaatgattttatgtaatgattttatgtaattgtctcttctcgaatatccaacactctattcccagtcttaccctcgatgataactcttgttcctatttcctggagaaaatcagagcaatcagaagagatcccctgccactaaatctatccttctagcagcttgtgaactcatataattttctttccagcctgttaccatacatatatgcatgatgtccatgctctcatctaaaatcagcctctgcttgtgtactagatcagggttgacaaaatgcagcctgtggcccaaatcctgcattttgttttgtttttgtacagcccgtaagccaagaatagtttttacttttttttttttttttttttttttgagacagtcttactctgttacccaggctggagtgcagtggcacaatcttggctcactgcaacctccacctcccgggttcaagcgattcttctgcct

SEQ ID NO: 4771 - DNA, 15204 bp, Homo sapiens
acttgacgctgcagggcgggcggggtaaagaagggagcgagcccttctcaagcttggaaagtttccagactgctgggccagcctcctccccagagggaaactgaggtccgattgaggtttctccaagaccgcccactcctgctcctgtccccaaacccctttctgcctagggttcctggaagccaaggaaacagaacgaactgttccctgggtgggcgagccactgcagagtacaaagctttcaggccgcctgcctcattagcactaatggctgctcccttccgccctgtgtcgtcaggactgtctatgcctggtctcatcagcacaaggctggggtaaggactgcccttttgtggagatggcaggacatacaggaccctgctgcccctgccttccctcaccccactgcagagctgtttatcacacacgtgtccatctgggaaaggaatgcaggctgaatcagctttgagaggatcgcaaggccccagtgcacaaactgggttggcacaaggcagtggaaaaaagatgaagggggccagtaacagctgaagaagtcccaggagtcctcccatgtcctctcagcaacccaggctggagcctactccttggtgttggcaaaggaaaccgtctttgaaggtgagacctttttttttttttttttttgagacggagtctccctctgttgcccaggctggagtgcagtggcgcaatctcagctcgctgcaacctccccctcctgaattcaagcaatcctcctgcctcagcctcctgagtagctgggattacagatgtgcatcaccacgcccggctaattttttttgtatttttagtagagatggggtttcaccatgttggtcaggctggcctcgagcccctgacctcatgatcaggacttcctaaccgcgcccggcccaaaggtgaggcctcttacagctgtaataaagagaagagaaggctgggtgcagtggctcacgcctgtaatcccagcacttcaggaagccaagataggcagatggcttgaggtcaggagtttgagaccagcctggccaacatggtgaaaccctgtctctactaaaagtacaaaataattagccagtgtggtggcacatgcctatggtcccagcttttcaggaggctgaggcaggagaattgcttgagtccaggaggcagaggttgcagtgagccaatattacaccactgcattccagcctgggcgacagagcaagacaccatctcaaaaaaaaaaaaaaagagagagaagagaggagggtctgaagacttcctgctggctgagtgttatctgcctcaggctaccctgactttttcactgtttttcactttttttttttttttgagatagtctcactgtgtagcccaggctgatgtgcataacacagcagccttgaactccctggttcaagtaatctccctacctcagcctcctgagtagctgagactacaggcatgcactacctctcccagctcgctacttttcagaaagggtagacaaactacagtagctgcctggacaccatacttggaggagaaggggagggggaggctgcaccggattctgtcttctgaactatgttatcttccagtttcaacatcataaatagcacagcaatcttatatgatgggcctcctgatgtgatgcaaaaatcaccaaagtagtattcttgacaaaagtatttaccatgaatccaatcttgaagaagcaatcaggtaaatccagaatatactagaaaagtggcctggcctaaactcctaaaaagaaaatcaatgacatgaaaaacaaacaggctgagtgtggggcagaggatactcttctatattaaaagacactagagagacataaccaaatccaattcatgaaccttgcttcactcctggactaaaataagaatgctaaaatgggctgggcgtggtggctcacgcctgtaatcccagcactttgggaggctgaggtgggcgggtcacctgaggtcgggagtttgagaccagccttaccaacaaaccccatctctaccaaaaatacaaaattagctgggtatggtggcatatgcctgtaaacccagctactcgggaggctgaggcaggaaaattgcttgaatccgggaggcagaggttgcagtgagccgagatcgcaccattgcactccagcctgggaaacaagagcaaaattccgtctcaaaaaaaagaaaaaaacatggtaaaatggcattcttggaacaagtcagggtgatactgctgaattactgttggtgtggtgatggtgttttcattgtgtagagcaaggtttctcaacctctactgttaacattttggtgcagataattttccttttcttttttttttgaggcaggatcttgctctgttgtccaggctggagtgcagtggtgcaatcatggctcactgcaacctccccttcccaggctcaagtgatcctcccagctcagcttcccgagtagctgggaccacgggcccacgttgccacgcccggctaattttttgtattttttgtaaagatggcgtctcactttgttgcccaggccggtctcaaactcctggactcaagtgattctcccacctctgcctcccaaagtgttgggattaccagcaaccccaggcccacataattctttctggtgggaagtttaacagcagttctgttctctgcccactaggtgtcagtagcaccacacctctttagttgcaacaactaaaaaacgtcaaatgttctccaaataggtagtggtgatggttgaataacatcgtgaatatacaaaaaccattggactgtaccctttaaaatggttaaaatagtgaattttatatcatgtaaattttcccaataaaaaatgttattaggccgggtgcggtggctcacatctgtaatcccagcactttgggaggccaaagctggcagatcactcgaggtcaggagtttgagaccagcctggccaacatggtaaagccccgtctctactaaaaatacaaaaattagccgggcgtggtggcatgtgcttggaatcccagctacttgagaggctaaggcaggaaactcgcttgaacccaggaggcagatcttgcagtgagctgagatcacaccattgcactccagcctgggtgacaagaaagaaactacgtcaaaaaagaaaaagaaatgagtttcctcctccatacttgcagagccccagtgagtccctgctctgcaatgctcatacccattgtgctgttactgcaagtcaatgagaacgttggtggacttctctccacttcacagaagaatgaatggaggcccagaacaatggcatgaacctgtcgtttcttggccttttggctaagatcaagtgcaatggcatgaacctgaccatagtcgtagacaaacaagaggcagagacattgtcttagtttgagttcccacttcagaaaaccttgagacaaacattgtagcacaggaagtttattaagaggatacaagccaggcatggtggctcacgcctgtaatcccaacactttgggaggccagggtggacagattgcctgagcccaggagttcaaaaccagcctgggcaacatggggaaatcctgtctataaaaaatacaaaacttaggctgggcgcagtggctcacgcccgtaatcccagcactctgggaggctgacatggctggatcacttgaggtcaggagtttgagatcagcctggccaacacggtgaatgaaaccccatttctactaaaaatacaaaaattatccaggtgttgtggtgtgcacctgtaatcctagctacttgggaggctgaggcaggaggctcacttgaacctgggaggcagaggttgcagtgagctgagatcgtgccactgccactccagcctgggtgacagcgagactctgtctcaaaaaaaaaatagcctggcattgtggcatatacctgcagtcccagctattagggaggcttaggtgggaggattgcttaagcctaggaggtcaagactgcagtaagccagccgggggcggtgggtcaagcctataatcccagcactttgggaggccgaggcaggcggatcatgaggtcaggagatcaagaccatcctggctaacatggtgaaaccctgtctctgctaaaaatacaaaaaaattagccgggtgtggtggcgggcgcctgtagtcccagctactcaggaggctgaggcaggagaatggcttgaacccgggaggcagagcttacagtgagctgagattgcaccactgcactccagcctgggcgacagagcaagactccatctcaaaaaaaaaagactgcagtaagccgtgagcatgccactacactcagtctgggcgacagagcaagaccctgtctcaaaaataaataaggaaataaaagaggatacaaagaacaagcgtacaaaaatacagggagggaagacagccactataaagtgggtcataagcagggttccaccagggatgcctggtccccccggggtgtgggtggggaactctgggctgcagtgcagaatgcatgtctcagagaagttccacccaaggcaggaggaaggtgagtagatatacagcaaccctgtctcagtcccttggagggttgttgggggagagttaactcctagcacttctgaccaacttgtagagtgagctcagaaagccccagacacatcagaggcagataccagcagtggacaccaagagtctgttccacgtgtgtctaagcatacttatcccccaaaatgtggcgcccacaccaacagcatcagcctaaggtaggaacctgggaggatgttaagtctggctctgccccaacataatgaatcacaaactcctggggtagggctcagctgctagagtttgtttgtttatttgtttgtttgtttgtttgttttgaaatggagtctcactgtgtcgcccaggctggagtgcagtggctccatctcggctcactgcaacctccgcttcccaggttccagcgattctcctgcctcagcctcccgagtagctgggactacaggcacgagccaccatgcccggctaatttttgtgttttttagtagagacaagctttcactatattagccaggctggtctcgaacccctgacctcgtgatccgcccacctcggcctccccaagtgcagggattacagatgtgagccaccgcgcccggccaactgctagagttttaacagacctttcaggtggctctgatgtgactgagctttgagaatctctgccctaacccaccatttctaactccaaagcccaaggtctttctggtactagatgatggctgaggcctgcagccaattagtgggaagggctgctggggatgttagaggcagaggaataagcggcctgacactcagctccggggacaccaaataggtgctggcccttgtaacccagtgaggaggcagcgctcattcctttatcttaaaatatgtcctgagcacttactgcatgccagagcctggtgcaaatgcttagggcttactaggaacctgggggtggagggagcagggttgatgtgaaggctgggtattgaacacaaagaatttgggtcttttggggctcctgtggtctggtccactccttggagatacccaccaggagatgactcagccttcctagtccaggaaggcccccgcctctttttctgtgagcccagccatcaccttattgccttcagcatgtcctgaatggattttgtcactgttactggggcctgcaaagcacacagccctcgtggtccagctaagaccacctggccacaggccggcccacagccgtacttgcagggtgaaccaaagtcaaggaagggtccagagaagctgggtctgaatgccacccaccacttccccatgtcaggagatgacacttatgtggacaccccagggattcctatgattcctccaacccatcaccttttctagagcacccctcactcctctctccagagtctcccacctttccagcactggcttcccaagttccactctctgcagcctccatctgtggcctggaccccaggatccaaccccctaaactccttctaggcaaccatcttgggcaacttcacccaatgacaacctatgctcctcctgttattgacagccctgaaaaaatggagttcaaggtcataggccccattggacctgatatcttcaccaggctcctgagaacccaactgagcagccctgtcctcagattccagctcggacataacattgggggtcagaaaactgactcccaaggtacaaactggaacagccagggtgagtgccagcacacaggatggcttcctcatcataggccagagtctggccctgggttagcaagttcagggcagcctacaagaggaatgagctggaaagagctgtggccaacccagggaggccccaaatacaccaagtcccaggtcctcctgctcttgtcacctttctacagtggtaagacaagacacattgtctgaacagtcccagttcagaacttctgtcgtggagcctgtagtgctgcaaaggttgaagacagtggcttatacccagctcagttctttattttctctctttctctccttccttccttccttccttctctttctttctttctctttctttctttctttctctctttctctttctttctctttttttgagacagtctcgctctgtcacccgggctggagtgcagtggtgtgaactcagctcactgcaagctctgcctcccgggttcacgccatcctcctgcctcagcctcccgagtagctgggactacaggcgcacactaccacgccccgctaactttttgtatttttagtagagatggggtttcaccgtgttagccaggatggtctcaatctcctgaccttatgatctgcctgcctcggcctcccaaagtgctgggattacaggtgtgagccactgcacctggccttttttttttttttgacatggagtttcgctcttgttgcccaaactggagtacaataacacgatttcggctcactgcaaactctgcctcctggattcaagtgattctcctgcctcagcctcctgagtagctgggattacaggagcacaccaccatgtccagctaattttgtatttttagtagagatggggtttcaccatgttggtcaggctggtctcaaactcctgacctcaggtgatccacctgcttcggcctcccaaagtgctgggattacatttttttttttttttgtcatgtgtctgttgccaagggaataaggttggggggaggatcaggcaagggcgtgatttatatacatatatatgtgtatatatatatattttttaattttttaatttaaggacaggatcttgctatgttgcccaggctcttgaactcctgggctcaagcaatcctcttgcttcagcctttcaaagtgctgggattacaggcatgagccactgcacctggccaagctcagttctttctgggggtgggcttgggaagccttcctcagcagtgatccaaaggcctaggacagaggagagggggtgcagacaagaaggaacaaggcctcagcctcccattcttggcaaatctaaacctggcaaccaagatgatgatattctcatttcacagaaaagtctacttttctcagctggggagcaagtgtcaggagcactggggccagactccctccccaacctggccctgctcattttcccccgttgcctgaggaccctggggatggaggaagagcatcagaccaggggcagggtctattctgggccagcacgtggagcggaggcagagctggcctcaggcccttgcctgatcctccctccccttattcccttggcagcagacacatgacatagaaatcactggttccaccaaatactgcacagcccagatgctgctggcctgatcagggccaagctgagtcaccactttaggatacgattcttgctttttggactatgaatgcaccctcatcaccccatgctcaacccccaactgaagactgaggttacagcagatccgtggatatcacagggtgatgaggcactaggccacctgctgcctattccctggcacttcattcttctgataatggagtatgagagagaatgggacatgaggtggaccccgatcaggcatgtcatagacaggagggacacatactaccactgggcatggtgccctagataatgacccagagggaggttgtaggtctcgaccctggggtccaagctgatgaggaaaggcaagaaaaaaagaaggggccaggcatggtggctcatgcctgtaatcacagcactttgggaggccaaggtgggcagatcacttgaggtcaggagttggagaccagcctggccaacgtggtgaaaccctgtctcttataaaaatatatatatatattaaaaaattagccggggccagccacagtggctcactcctgtaatcacagcactttgggaggccaaggcgagtggatcacctgtggtcaggagttcaagaccagcctggccaacatggtgaaaccccgtctctactaaaaatatcaaaattagctgggcatggtggtggcacatgctggtaatcccagctactcaggaggctgaggcaggagaatcgcttaaacctgggaggcggaggttgcagtgagctgagatcatgccattgccctccagcctgggagacaagagtgaaactccatctcaaaaaaaaaaaaatagctgggtgtggtggtgcacacctgtagtcccagctacccgggaggctgaggcaggagaatcgcttgaacccaggaggcagaggttgcagtgagccaagatcacgccactgcactccagcctgggtgacagagcaagactccatctaaaaaaagaaaaaaaaagaaaaaaaaaaaggaaagaaagaagggaaagcaggtaggatgtcttgaacaaataggtggatataggctccagaactggtggttgttgggaaaagtgggaaaaccttctgcatggggttgcctgggtgagctgatttcctattaggtcctcattcctgctgccaccaagataaagtgatgggtggcatggagatttcagctgtgtccttggatgtcatgtgctctgcagtcctcatgatgataacaagagtccatccagtccatgcttcgatgctggcatgactaaaggaacagggatgttatcgaatgggagggccacgtggtgccctcgtgggcttccccaagcagctgaccagacctggaagcacctttgtctaaggccctacgagcagcctagttaatccttttccattcccccatcccactcacttgtatcccactctgcctttgccatactgaatcccatccttggaaagtcaggaaagccctaagatctctaggctccagcataaggcaggtccccagtataatgactgactcttgtcccttttcttcttcttcttcttctttttttttttttgagatggagtttcactcttgacgcccaggctggagtgcaatggcatgatctcggctcaccacaacctctgcctgtcgggttcaagtgattctcctgccttagcctcctgagtagctgggattacaggcgcccgccaccacgcccatttttgtatttttaatagagacggggtttcaccatgtgggtcaggctggaatgcaactcctgacctcaggtgatccgcctacctcggcctcccaaagtgtgggattacaggtgtaagccaccacgtccagcctactttcttcttttcacatgataggtatgaactggtaatggaataaaataggccgggcgcagtggctcacatctgtaatcccagcactttgggaggctgaggtgggtgaatcacctgaggtcagaagttcaagaccagcctagccaacatagcaaaaccaagtctctactaaaaatacaaaaattagccaaacatggtggcacgtgcctgtaatcccaggtattcagagactgaggcacaaaaatcgcttgaacccaggaggcagaggctgcagtgagccaagattgcaccactgcactccagcctgggggacagagtaagactctgtctcaaaaataaagcaaaataaaataaaataaaataaatcgtcattgtatgatgatacatttggtactccaaactatcaagttgtggccaggtgcagtgactcatgcctgtaatcccagcattttgggagaccagggtgggtggatcacctgaggtcaggagtttgaaaccagcctggccaacatggtgaaaccccttctctactaaaaatacaaaaattaggtgggcgtgatggtgtgcacctgtaatcccagctactcaggaggttgagacaggagaatggcttgaacctgggaggtgaaggttgcagtgagccgagatcacaccactgcactccagcctggcgacagagcaagactccatctcaaacaacaacaacaacaacaacaaaactatcaagttgtaacttcaaaactgaaatttatttatgtatttatttattttgagacggagtttcgctcttgtcacccaggctggagtgcaatggtgcgatctcagctcactgcaacctctgcctcccgggttcaagcgattctcctgcctcagcctcccaagtagctggaattacaggcccccgccaccatgcccaactaatttttgtgtttttagtagagatggggtttcaccatgctggccaggctggtctcaaactcctgacctcaggtgatccatctgcttcggcctcccaaagtgctgggattacaggcatgagccacgacacccggcccaaaactgcaatttatagtgcactgagcagcaaagaaaagtgacgagagcaccacttacgatctctgttccaacaactcgactctgctgttggaacccaaaagcagacacaggcaccatgtaacagatgaaccaggctacatttcaataaaactccatgtctgcacactgaaattagaattttagataactttaatgtgtcacaaaatagcctccattcgattttttttcattgtggttcacgcctgtaatcctggccctttgggaggccaaggcaagaagatgacttaaacccaggagttggagacgcagcctgggcaacatcaggagaccctatctctacaaaaaaaattttaaattagctgagtgtggtggtgcgcacctgtagtccctaccctttgggaggctgaggcaggaggatcatttgaggccaggagctcactgcactccagcctggacaacagagggagaccatatcttggaaaaagagagagagagagagaaaaagagagatggagggagaaggagagaaatgtaaaaactttagaaaaacttcagtgcttcttagttggtttaaaaaaaaaaatgccaggcatggtggctcatgactgtaatcccagtactttgggaggccgagcaggcggatcgcaagatcaagagattgagaccatcctggctaacacagtgaaaccctgtctctactaaaaatacaaaaaattagccgggcatggtagcgggcgcctatagtcccagctgctcaggaggctgaggcaggagaatggcttgaaccctggagccggagcttgcagtgagcccagattgcgccactgcactccagcctgggcgagagtgcaagactccgactcaaaaaaaaaaaaaaatccttgggaggctgaggctggaggatcccttgagcccaggaggttgaggctgcagtgagctgtgatcccactactgcactcagcctgcatgacagaatgaaaccctgtctcaatcaatcaatcaataaggccgggcacagtggctcacgcctgtaatcccagcactttgggagaccgaggcggatggatcatttgaggtcaggagttcaagaccagcttgacctacatagtgaaaccctgtctctactaaaatacaaaaattagccaggtgtggtggcagatgcctgtaatcccagctacttgggagactgaggcaggagaatcgcttgaacccaggaggcggaggttgcagtgagccaagatcacaccactgcactccagcctgggcgacagaacaagacaccctctgaaagaaagaaaagaaagaaagagaaggaaggaaggaaggaaggaagaaaggaaggaaggaaggaaggaaggaaccattcttgacttgtgggttatacaaaaacaggcagggttccactcctggcactaggtttgttcttgtgtttgttctctgttcagggttatgccacgcagagggtaggaggggaattagtccatggttatgtgtcctcacagatgaccactgagaaggccaccatgcctagtcgtcacgactctaggcccagcaacttgctgaagactctgcagtgctggggacccaggcatttttgtgaggctgtccacaccctatctgcctgtgaggactgggcagtccatctgggggtctggctgcctctcctgcgtgctgctgggaggctaggcctgactgtcattgctctacggccacatccccagccacgctcttctttttcttctttcagccagagggagccctgaattcatgcagaggagtttttctaccttccatctgcttctgcatatcatcttgtctacttaatgcccctccttccggatttatagaacagtatgcataatatgaccccaactgcattccaaaaaatagatgtagatgtaagcttagagatgcaaagaaactttttgagagaattcactatgcttctcgcgggtggtgacacagttcaaggaggttccatggggtgtaatgtttatctttctcttttgtccttctgatcattgaaatgatgctttgtgtgtgtgaacatgtattacttttataattaaaatagaaaaattaatttgaatgggacaaatgctcgaagtcaaagtcacctgttataactgctgtcactaacagggcaactgtttgaaaatgctgcagaaacatgagaaatgttcatgaagtgaccctgtggaggcttccggtcacaggatcatgtgagcgccacgatcaccccaggggtggagcagatgctaagtgttcaccacacccaattctcttcctggacacacaggaagatgacatttccagtgacatgccccacctctaggccctagtcttttttttatttaaaggtctgagtcttgttctgtcacccaggctggagtgcagtgctgtgatcatgactcactgcagcctcaacctcctgtgctcaaacaatcctcccacctcagcctccctaatagctgatgtcatataggcatgagccagtgtgcctggctcaggccctacccttaaaagcatcccacctgattcaccagcccccttctctctctcagtaaacttggaaaccacgcattccagatggtataatttacagcatgatggaaaaagccagctctccatgggaagctggccagtcttcattggagtacatttttattgcatgaagccaatgagacttgatattgtttaactctgtggtttccaaagtgcggtccttttgaagtatccataaagtctacactaggttcacggtaatattaagatgttatttgtcagctgggcacggtggctcacgcctataatctcagcactttgggaggccaaggcaaatggataatgaggtcaggagtttcagaccagcctggccaacatggtgaaacccagtctctactaaaaatacaaaaattacctgggtgtggtgatgcatgcctgtaatcccagctactcaggaggaggctgaggcaggagaattgcttgaatccgggaggcagagattgcagtgagctgaaatctcaccactgcactccagcctgggtgatggagcaagacactgtctcaaaaaaaaaaaaaaagatattatttgtctttcatgagtgtacagtgggattttccagaggctacatgacatgtgtttttttattttgttttttatactgacagaggggtcttgctatgttgcccagactggtcttccaactcctggcctcaagtgatcctcccgccttcacctcccaaagtgctgggattataggtgtgagccactgcgcctggctgtttgtgacatgtgatgttgaaacaggttgagtatagaagcagatatgggaattaaaccagaatattaaaccagacattgaagagatttgcaaaaaatacaaaacaataccactgttttcactttctttttggtttggaaaaatgtagttatttttcattaaaagtatgttgtgttggctgggcacagtggctcatgcctgtaatctcaacgctgggagactgaggtgggaggatcacttgagatcaggagttcgagaccagcctgaccaacataatgaaaccccatctctactaacaatataaaaattagctgggctggctgagcgcggtggctcacgcctgtaatcccagcactttgggaggccaaggcgggcggatcatgaggtcaggagatcgagaccatcctggctaacatggtgaaaccccatctctactaaaaatacaaaaaattagctgggcgaggtggcgggcgcctgtagtcccagctgctcaggaggctgaggcaggagaatggcgtgaacccagcgggcagagcctgcagtgagcagagatcgcgccactgcactccagcctgggcgacagcaagactccgtctcaaaaaaaaaaaaaaaaaataactgggcttggtggcatgcgcctataatcccagctacttgagaggctgaagcagaagaattgcttgcacctgggaggggcaggttgcagtgagccaagatcgcaccactgcactccagcctgggcaacagagcaagacaccttcaccttctcaaaaaaaaaaaaagttgtgttaacatgtaatggtttcatgatatcattttaaataaattaataaacatgtaaacattttctctgttttaatttctcacatggtaaatattaatggtgtgaaccaaaaagtgactgaggcatctcaatcaatttagaggtttatcttgccaaggttgaggacacgcccggggaaaaagagacacaagtcacagtacgatctgtgtcctgtgctttttccaaagaggaaagaggcagcaggaggggagggaggaaaggggaaaaaagcgggcaggagggtaggcagggcggcaagtggtgacattgttgtgaggctgtgattagcagctcagtgactctac

SEQ ID NO: 4772 - DNA, 6589 bp, Homo sapiens
gttaggctgcagctgctggatgtgtctcctgatccctgagacccactcctcccatgcatcctcagagtccctcaaaccccacatccagagccagacagggtaagcagccgtcgagagggggctctggagactgagacgggagtgggatcagcaactgaccagttgggaactgtgggcatcacctctcatctcgggtctcagtgtcctctgagccctcactccattcattcgtctcactcctgggccacacctaaaaatcacttccttggcccagacttccccatgatttcccagcctctaccttcactcctaaacttttatccacccacccaccccattcatcgatttattcactcatccatccacccatccacccacccactcatccatccacccatccagccattcactcatccatccatctatccatctacccatctatccatccatccatcatccatccacccacccatccatccacccatccagccattcactcatccatccatctatccatctacccatctatccatccatccatcatccatccacctgtccacccatttacgaaatccacccaccgacccacccatccatctctccatttactcatccatccatccatccacccatctgtccacccattacccagctacccatccatccatctacccatctatccactcactcatccacccatgtacccatccacccaccctcccacccatccactcatccattcatccactcacccatccacccattcatccattcatccgtcacccaccacccatctacccattcattcatccatccatccactcatccacccatccatccacccattcatccatccatccatcacccaccacccatctacccattcattcatccatccatccactcatccacccatccatccacccattcatccatccatccatccatccatcccacccatccatccatctatccatccacccatccatctattcattcactcatccatccatctatccgtctatccatctacccatctattcatccatccatcatccacctgcctgtccacccatttactcaatccacccatccatccatcgcttcatctactcatctatccatccacccatctgttcacccattatccatctactcatacatccatctacccatctatccactcactcgtccacccatctacccatccacccacccacacccccatccactcatccattcatccatccattcacccactcatccatccatccttcactcacccattcacccatttattcattcattcatccatcacctgccacccatctacccattcattcatccatccatccactcatccacccatccatccatgcattcacccacccattcatccatccattcatccatcccacccacccatccatctatccactcatccatccatccttcactcaccaatccacccacccatccattcacccatcacccttccacccatctacccattaattcatccatccactcattcacccatccatccacccattcatccacccatctatccatctatccactcatccacccactcatccattcatgtatcacccatccacccatctaaccatccatccatccatccatccactcatccctctttcaatccatccatctatccatccattcatccatccacccactcatccatctatccattgattcatccactcatccatcctgccactccatccatccactcatctatccctcaacttatccatccatctattcatctatccatccacccattcatccacccatccattcccttccatctttcctttttttttttttttaaagattcccagaccaagtatctctcccatagaagtcatccttgggtactaacactactattgtgtcccagagctggttccttctcgtgggttctcggtctcgctgacttcaagaatgaagccgcagaccttcgcagtaagtgttacagctcttaaaggtggtgtggacccaaagagtgagcagcagcaagatttattgtgaagagcgaaagaacaaagcttccacagcgtggaaggggacccgagcgggttgcccccattccatctttccaaccatccacccacatttaccaacttctactctgacctttagctattcactaaagaagcagaagaatcaaactcagcccctaaccttgtgaggctctccatcttgtagaggagacccacagaaaacagataaattatgaaccttcctagtaaggactattgaagaggccaaaacaataggtttgggggatttagggaaaggaaggccaaataggggtaggtcaaacacaatcgctgtctctgggcatgactttgcacccctgctcagctccccgccatcagcccatggaaacagatcttgctaaggtcaccagtgaccctctaactgccaatcccagagtcattcttctcactgtattcttgacctttcctttcctgacctttgacattggccattgctctgctgggttagggttagggttagggtgctgcactggccattcccacctctgtctgccagctaaggtggagtccccctaggcccctcagactcaacctgtcccaaaggactccatcaccaccttttcatcctctagcccaccggctccactgtctacccccatcaccttgacaaaaaactcaggtgtcatttttgacttcctgttctaattcccacactcatccagtcctgcccattccacatcagaaacaactcttgcccatcccttcctttccatccccacgcccgctgtcctggctcctcctttttctgagtttcctgacttccagcctcacactctagtccatcccccagtgttgatgactacagggatcacctctgagctccccagaccaggcctccccagacctggtcctgactgtatagtctctatttcctcctccccagcagccccttcagggttaggactactgaactcctattcgtctttcaaaaccccattaatattccctcctccaagaagatattccctcctggatctctgatgcctcagcctgggctcctacaggtcccagtcctgactacctgggggcctggaggtgtctacatggagctttgcttcccctagcttggcagctccttgaaggctgggcctaagaaactcctactcatccctcagggccccagctcctttgcccttcctacaggaagccttccctgccccctaggctgggcctaggtggagcgctcaccgcaggttggttttctgcacggagaagcagtactcgttgatgccagtggtgggcatgcggctgcggagcacgtcctgagctgtggggacgtagccctcctcggtgatgcgctccaggtgggacaggtagctgcagagcaaggagtcctgaggcccagccttgcagccagcctccctttgcttcccaggccctacgaaaggcccagcaaggaccctgctgggggaggagagctccctgggtggaggtggggtccctggagttggcagatggcccaggagcgtcccccacctgaggcaatggagccccaaggaaaagcagcttcacacgcagagcagggtgacccgagggatggcgtgacatgaggaatggcctcatcgaggagtggtgtcccccgggagagctgctatggcaggggtggcgctaccccaagaatgctggtagcctgggaacagtcttcccagacatcaagccaccttggacatccaccatcacacctagtacaggatcccactaggaatagggtcacccccagaacagggtctcccctggaacagagtcccccctaaaacagggtcactttaggaacagggtccccccaggaacagggtcactccaggaacagggtccccccagaatagggtcccctcagaaacagggtcactcccagaaaagggtcccttctaaaacaggggcactctaggaacaggttcccgccaggaatagggtcactccgggaacagggttctctaggaatagggttcccccaggaacaaggtccccccaggaacagggtccctccaagaacagggtcactctaggaatacagtccccccaggaacaggatcacccctaggaacagggtcactccaggaaaaggatcaacgccagaacaggatcccccaggaaatagggtctccctgggaacagagtcacccccgggaacagggtccccccagaaacagggtcacccctgaaacagggtcctcacgggaacagggactccaaggcccagggtcactccaggaacagggttctccaggaatagggttccccccaggatcagggttccccccaagaacagggtcactctaggaatacggttcccccaggaacagggtcacccctgaaacagggtcctcgcaggaacagggaaccccaggcacagggtcactctaggaacaggataccccctagaacagggtctccccaaggaactggattccctcaggaacagagtcactcctagaacagagtccccctatgaatagggtcattccaagaacaagatcaccgccagaacagagtcccaaggaacagggtccacccaggaacaaggtcattccatgaagggagttcccccaggaaaagggtcacccccagaacagggtcccccgggaattagggtccccctggaaggacctcatcctggagcaggaccacctcacagcccatctgcgcccacaatatctcctgctgcaggaagccagccagcctggcccctgccctcagcccctccccacgcgcccatcccccgcagaccccagactcactacacggctgaatcgagcaggtggaattcccgccgacgctcatagcaggcccggatgccggcatccctccacagccactgcatggccgcagcgtagcgcttctcaaacgtggtcactttataggggtcctggctcatgaccaggctagcgtggtgctggggagggaggacgggggcagttagggtagcctttctgagtggggctgccctccgcaggcatctctgcaagcccccacgtccctccctgaaacacgctctcttcccactgctctccttcttccccagagctcccgacccccccgcacacttctgatttgtcctccgtctgttcttgcatggatccccagagggaaaagcacagaccaccacatgaggggctgcagagggcacatgtgctcgggcgagcccaggctcagggggagcatggcacccagccccgctctttacactagctggctcccaggaagcacggcactcacagtccccccttccacagatgaagcgactaagacacagagcactgaagcaatctgcccctcagaagtcccccagaggcgcgtgaaccctgagctgccccccagactctgggtttccccttcttttccccaaacagccctagctccccccaggcactcgcgttgctcagacctttgtgatggactctgagtgttgtgtgtgcatttctctgtgtttgttcatgtacaagcgtgctcgtgtgtgtgtgtgtatagatgtacacatgtacatgggtgtgtctgggtgtgtgatttgtttgcatatttgtgtgtggggcacgcgcatgtatccttggctgcatttgtgggtgcgtgcataggtgtgcttgtgtgtgcatttgtatgtgtgcacacatgtgcgtgcatgtgcatggggggattgcatgcaggcatgtgtgtatccttgtgtgtttgtgtatgtgcatgtgtgtgtgtgcatgtgggaatttgcatgcatgcttgtgtgtgtttgtgtatgtgcatgtgtgtgtgtgcatgtgggaatttgcatgcattcttgtgtgtgtttgtgagtgtgtacacgtgcatgggcgtgtttgagtgtgtacatttgtgtgtgcacttatttgtgtgcatctgtgtgggggcatctgcatggatccttgtgtgcatttgtgtgtgtgcacacgtgtgcacgtgtgtgcattcatttgtgtatgtgtgtgggtgtgtgcatgtgggcatgcgtgtgtatctttgtgagcatgtacgtgtgtgtccttgtgtgcatgtctgtgcgtgtgcatacatgtgcgtgtgtgcatttatgcgtgtatacttgtgtgtgcacttgtatgtatgcacatatgtctggaggacatggccttgccccagggtctggggacccttccctgcctgccctgccctgccctgccctgccctgaagtctggggaacttggccctgctccggggtctggggaaccctgccctgggcccctgcctgccctgggcccctgcctgccctggcggctcaccttgctctcgggcctgctgaatggaatctgcagccgctccatggcctcgatcatggcccgcatggacacgaagatgttctggtagaccaggggccggaagcccttgcgctcctcctccgagtagccggcgccgtggatgatccgcatctgcttgatgaaggtgctcttcccgctctcgcctgggcctggggatggagcagcagaaccgctcagccctccacgggactcccacccccgacacccccaac

SEQ ID NO: 4773 - DNA, 618 bp, Homo sapiens
tgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatat

SEQ ID NO: 4774 - DNA, 1422 bp, Homo sapiens
gggccgggagggggatgcccacattgaatttatgcttttctgtttccttctgaaatgtaacaaaaaacttttacgtgaaggatttttaaaaaatctatggaacaccgctcacacctgtaatcccagcactttgggaggctgaggcaggaggatcacttgagcccaggggttcaagaacagggctgagcaaaggtgagaccccgcctctacaaacaatacaaaaattagctgggtgtgtgtcccggctactggggaggctgaggtgggaagatcacctgcacgggggaggccgaggctgcagtgggctgtgaccatgccactgcgctccagcctggacgatagagtgagaccttgtctcaaaagaagaaagagaaacctgagacaagttaacgtgggaaacccacagatactgcccagtcgagaccctggcgtagcagagggacccgagtctgtgcggggaggctccagccagaggggcgtcctctcgtctgccgtcacctggtctcggcctctgctggaaactctggttgaatcacggacaacatttatgaaaattgtagagaaaactggagactgtgaatgccgtttcacccttcaaggagggcttgctgctgctgttgacatgcagctggggtgccatagacgcctatatccagcaccagattcctatctcagttgaaggtctggcatctgggggtccccatggtggggcgcccattccagcttgtgcccctccagccccaggagactgctctgctcagaaaccatcagcaaatgcaccggggagggtggtgccttaagacagacagagtcacttctctgggctgccagaggcaccggaagccgggtgcctcaggccctggcagttccgtcactctccaacgcctcccccacagacttctttttgctaaatggtatcaagattttctcattgttgtcagcaagagagttggttttctaacatctcatcgaccatggctggaggtcaaatcgatgtttaaacttgctggaaataaacggctcctttcttgcatggctcgatgcgcaataaggttcctctgtgtcattttgtttacgatttttaggattgctttttaaagccggacacggcggctgatggctgtaatcccagcactttaggaggccgaggcaggaggatcacttgagataaggagttcaggaccagcatgggcaacacagcgagaccccatctctatagaaaacacaaaaatgaggctgggggtgctcatacacgcactgagggttgaccctggtgttcttgccttcttagattcttctggagctggagatgaactcggacctcaaggcccagctcagggagctgaatattacagcagtgagggaaactgaagttggtggtggtgagaaagttattatgggcaggtgcagcagctcacgcct

SEQ ID NO: 4775 - DNA, 5134 bp, Homo sapiens
ctgcgcctgcgcggtgaagcgccatagagctgagcactcctcccagattcctagagcggacagggcgatggcaggttcgccgggtgtgaggcttcacagcggtccggtgaccaagtcgaggatttttctggtggtctagtctcagagattacatctgtagtcagcacaatgattcccttccaagcccagtggtgcccagttgcctccaggtcccagacctttatgtggacaagaaaagcttacagaggaaatggtaattctccacttgcacactgaggtgtccagttgcagcccatggagatccagttcaattatgaatctcaggaacaccaccttctgtcagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggtgaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatgagatcttgttaaacatcacagaattcatacaggtgagaaaccctatgaatgtgatgaatgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattaaacaccagagaatccacactggggaaaaaccatataaatgcagtgagtgcaggaaggctttcagtcagtgctcagctcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccacactggatccggatacgtatggtggctcacgcctgtaatcccaacactttgggaggcagatgtggaagcatcatttgagcccaggagtttgaggctgcagtgagctatgattccaccattgcactccagtctgggcaacagagcaagaccctgtctatttaaaaaaaaaaaaaaaccaccaataccacatgggagaaaacattaattcagtttttgtaatgaaaggttaactcagagctcagacattactaaaattaagaaaaattctccagcctgaccaacatggtgaaaccctgtctctaccaaaaaataaaaaataattagctgggcatggtggcaggcgcctgtagtcccagctattcgggaggctgaggcatgagaatcacttgaacctgggaggtgggggttgcagggagccgagatctgccactgcattccagcctgggcaacagagtgagactctctcaaaaaaaaaaaaaaaagaaaaaaaaactctgaggaagagtcctgcgagttgtgggaaaaccttcaaagtgaaaaacatttttactgaatgtcagtataccacaatagaaacaaatttctatcttttctataaggttggaaaagctctagtcttattcagacataacctacaggaagagagttgtattattgtaagagatctaatgcagaacttatcagatattgtaaaaatcagtgtgggaggtattcagtcaaaagtcagaaggaaatgtattatcgttataatttcaaaccttaagaaagcctaaattaccaattgcatatcaaatttttttgataatgtaaggaaaacttaaatcccctccatatcctaattggcatttataataatatgacacttaaccctgacagctagagtcttactttatgctaatgctagatatctatttttaaattccacgtgtgtaaacatgctatactcttctgatattaaacttactaagtacataattccagtgcccccttttctcagaatttttttttgtttttaattttggggggtatagttttggttttcctagtgcacattagtttgtgcaagttcttgcaatgttcacagcaaatatagatttattttgctttgaataatgcagcccataaactttattggtttgaaagttcttcactaccatttaatcacagcttctaaacatgtgaaacaggatctttaaaaaaattttccatatgtcaaagtgtagagatgtttctagcagcatttatcttgtcatctatagattgaacaaaaagtggtagctgtgaaattgtgatttataataaatacatatttggtcttcatcccctggtacagagcttctaagacccttgaaatttcctgagtggtaagagtaattaggatgacaagcccctttaaccacacctgagtttatgttaatgggattacttttggaaagacagaaccacaggatgggggctagttgcctcgagaaccaaccatgtgattagagggttggaactttcagatcaaccccaccctaccttgacctctgagaggagagaggctggagactgaattcagtcaccagtggccagtgatttaatcattcatgcctacgtgatgtagccttcataaaaaactgaaggacaggattcagagagcttccaggttgaacttgttgaggtactaggagggtggtgtacctagggagggcatggaagctcagtgttcttcccacacaccttgccttatgcatctctttcatctggctgatccttagttgtgttcttttacaagaatctagtaaataaacttttcctacattctatgagtcattctagctaatgctgaaactcaaagaggggattgtaggaaccttggatttatagccagttggtcagaagcaccagtgaaaacatggacatgagattggtgtccaaaactgacacaattggtgtcagttgtagaactgagcccttaacctgaagcatctatgttgatctgattccaggtagatagcttcaaaatttaattacaggcacttagtgggtgtccacagaaaattggagaattgtttggtttggggaaacctcatacacatctggtgtcagaaatgttgtgagtatagagaagacaataagtttttcctatacagtagctaaagtacctacatcattaatttgtatagtatattctgtgtaaaaataagactttctgatatttttttcaagtggcaacatttatcagacttttttgatttctgacatacatactgaaaacaggcaacatacatgcaaagttttccactgaaaaatagaaatagtttgaaaaaataaaaaattcaaattgtctttctggtattaacaatttgataagttctgctactaaaagtactacaaagttgtttcctttgattatcccctataattgtctaattaatattttaatttagcagacattgttaaattctattccttaggagtgtaatgctaaggcaaggccttttgggaggttttgtagtacattaaaagaatatactatctcttccaatgaagtgtatattgtatagtgatagagactaatatgtacagaaaacacatggctcaatgtaatcataaaggtaggacatgcttgtaagaactcagaggagtcaaggttcaattctgattagaaagaaaagggagagctttgtggaactcctgaagtttgagccttgaaggatgggaatagaggcataaaggcagggagggaataatcaacaaaggcacaaaaggaagtgcaagaaatgtggagcatggtggttatcatttattcaataaatattcagtgtcaggca

SEQ ID NO: 4776 - DNA, 1865 bp, Homo sapiens
ctggctttggctgctgttaccgctgctaaagactggagccctgagtcagctgaacccaggctactgtgatctacatgccagggctcaacaaactccaagacaaacatagaacttcacaaaacagccctgtgtcccaagaccctcacatgtgtgaaaggcaataaactccttaatataacaaactccaggacactgcaatcgacttgggaagaactaactattttagtaaaagcaagagccaaatctgggcatcgcagaaaaagaatgagagaaagtgaagagtgagtctgtctcctggttgtctggaggtggcatactgccaatttggtagcctctgaacccagcatacagtatcaatctcctagcaaagaacttccttctgaaacctgttttccaatccctccaacagaagaaacaaagattataaagctgatcttccaaaacggtggtctcggggcaacctacatcacaagcccctggtgcagaaacctggatcccagcaaaaaagctcaatctactataatcaatttcgagtggggactaggaatctgcatttttaaccagctgccctggcaattctgacacacactaactttgggaagggagcagctccgttaaaaaccactgttgcccagcaagttaagtcacaatcattttccccctaagctggaattagaactctcaggatcacctaggggaggttgtaagcattctctgatagaccattcggattcttacactggttgacccagttcacacacagccaccagcctcacgtgcaggatggcttcgatagaaccaccctctgggggcggcctgccgattctacttttaagcacacatattcttcgctcgaaaagagggcgggggaggaggctacaatcaaactttcctggcccattctcttcgaagattccttcctattctggctaagaatcaagccccgctcctgcagaaggggcaaggaaagcggccgattcctgggtcgacgagaatctcccaagaactgtctcgacaggagaagcaggggcacccatgacctacaacccgcgaggcctggaggtagcaaaaggccgccttcgtcatttctctcccagcttggatgggagtgaggggttgagaaaatgcaggatgagaaatccaaatataactaacttctggccaactctctgcctgtatgactctaggtaccttggagccagtgccaggccctgagctcagagcgggcccccgaagaagctgcagagagaaacttcgctccagagacgcggccccagggtcgaaaggggctcggggcccgcagcccccggccggctgcgcccagcacagcaggccctggatcccgcggctcggcagggggactctcacctcggcccacccggccttccaaagggtccttgcggaagtggatcccgtgcacgtccacatgcgcctctccacccgcgttgaccgcccaaatgacgctctcgggcagcccggcccccgccgcgccggccacgccggccacgccgagcccgggtccccggatcgccggcggcagcagcagcagcagcagtcgcaggagcgccacagcggttccctcaaccgcccaggctcccagcatggcggccaccaccacgggggcagcccccgccgaccctcgtcctcggccggctgccaggccaccccggactcagaaaaacagcgccacgggccgctccgcctgagccgccggggacatgtcgctctcaggcctccttcttctcagccacggattcatgcctggcacaagccaaggcactcaaccgattgctactctgaaatgaaagtctcggccgggcacggtggctcacgcctgtaatcctagcactttggaaggccgaggt

SEQ ID NO: 4777 - DNA, 1812 bp, Homo sapiens
aagcgatgccaggggcaggtgagggtcggacgcgctcaggcccagccctcgccccttcaggtctgggggacacagtggagtcccagcctcaagaagtttccccaacctctcagaaacttgaagggcaatgccaggtaccgaaaaaccggcccccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccacagggtgaatgaggggtgggcacagcccggccgcggccccagcacacacgggcggacgcaggggcgggggagcgccagccccgcagtgtgttcggagcccagcggctctgagtcgccgccaccagcctggccgccttctgctccacgtctgttcacccgtcccctggaccggcaccgccacagagggtcagagtgttggcacctgtcttccgggtcagttcacccgtcccctggaccggcaccgccacagagggtcagagtgttggcacctgtcttccgggtcagttcacccgtcccctggaccggcaccggcacagagggtcagagtgttggcacctgtcttccggatctgttcacccctcccccggaccggcaccgccacagagggtcaggagtgttggcacctgtcttccgggtcagttcacccgtcccctggaccggcaccgccacagagggtcaggagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccgccacagagggtcagagtgttggcacctgtcttccggatctgttcacccctcgcctggaccggcaccggcacagagggtcagagtgttggcacctgtcttccggatctgttcacccctcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccggcacagagggtcagagtgttggcacctgtcttccgggtctgttcacccgtcccctggactggcaccagcacagagggtcgagtgttggcacctgtcttctgggtctccatccctccctttgtttgttgagtgactgcatgttctcatttccttatcatacaattctttgagaggtatcattagctgcgtcttattttattttcaccttcttttctgttacctgtatgtttgaattttcctataagtatttttgtttcatctttgcttttttaaattaaaaaatcagttttaaaattg

SEQ ID NO: 4778 - DNA, 1552 bp, Homo sapiens
gaggttgctgcagtttttccgcgatagtttggggcagttccgcgcgttgcaggcccttctgaatttcctggacctacgcattggatcctcaaagaactggtgatcgaattaggggaaaaggggcctcgtcggagagtagaggtttggaggggcaagggccgctgtttgcgttctcgtccgtggcaccttcttgggcttgggtctgtcctcgcttcccgggggcattggtacttggttgggtcgcgtctcacctggtttcagggtttccggggctctgagctcgcccactccgccccctgcaccccacgcgcgtggccacttcttctcgatataacgttggggtgttaatctccttgggtttcccgttactgttctttaaaatggggactttagggccatcctaatggaatcgttttgggaactggaagaggtaacacaaatgagagccttaaagcagtccctgtcacttggtgactggtggtctcttgttaatttcccacgaaggaccgggtggggtcagagctccagctgcaggggcctcggcccttctccctgatccctgcaggacgctggatgatcccggaagccttctgacctctttttaggagagcgagggttgcgtccactttcatgaagggaaaggagcatttaacttttatgggggacggcgacgcggtcaaggtgtttcacagctttctcgttccccaacccgacctttccagaagagctgcagggagggacttcttggcttctgagggcaaagctctacgtgagtggtccttggctctttgaccgagatgctcaccccaaccgagagtgtataggttgtgtcctcgggcatgggggtcgataataattaagtcttaattagtaacttcattctaagggctttatacaaataaatttacgccacaccgtggctctgtggagaagtattgcttttttctattttaaaaacgaaagtgagacacagagcgcataggcacccgactagtgagaggtggagctggggttggaacctaagcagtctgggtcagagcctgatttgatcttctcttgggatacgttgtcactgaggcagaggaactagttggacttaggtggggaaagcaagacttaggggcttgaaattttctgagtttctaaaaatgttgtcaactattttgtttcaatcattacaaatattttgtattcttatagaaccatgtcattgtacagcattctatttttctttattaagaacaaaatgggcctggcgcggtggcttacgcctgtaatcccagcactttgggaggtccaggcgggcggatcacgaggtcaggagttcgagaccagcctggccaacatggtgaaaccgcatctctactaaaaaataattacaaaaattagctgggcgtggtggtgggcgcctgtaatcccatctactcgggagggtgaggcaggagaatcgtttgaatctgggaggcggaggttgcagtgagcggagatctgccattgcactccagtctgggcgacagtgcgagactccgtctcaaaaaaaaaaaaaaaagaa

SEQ ID NO: 4779 - DNA, 3196 bp, Homo sapiens
gggcctgtgggggcgcagagggcggggcttcctgcggggaggggaggccgggcagtgggggcggcggcggtggcgctgctccgggagccggctctgctgcaggtgcgagatctgagccagcgagggcgcggcgtgggggaggcgcgagtcagctccttgacttgggtgggcccctctccgcctctccgctctacgcatgcgctcctacctgagccgagcctacaatccaaacctccctcgcccaactctgcccgccacagatgcccctgggctcccctccagaccctgccccgcatccccgccagcctgaagctcctgcgcacctgggctgggggagccggtcggcacccccggagtcggagcatcaccgccgctcggagttgccacagcgacggggaggatctcgatggagacagcatcccccggcccccgcagaatacggattaaccccttctcctccagctcctccaccttcagctccagggccgagggccgcgtcggggcagcgggaggcgctttctcaggctctgggggacgcctggagggccccatggcggtcgattcgctgaagcgctcctacgaaccccacgggaggggtcagtgcccaccagcaggctccttggcaccaagcctccatcttcttcccggggtggagggagatgtcaagcctagaagcctcagctggcctgttcttgggcgcctggcctaccacccgccccagcctcacccgcagggtctccaactccttgcgcgcctggcttagctgtttttccagttctgcaatcttggccatggattcgttctccgcgtcccgaagccgctctgtcagctgtagcaccagcacatgttcctccatgtgctccagcacagcgttcttggtctctgtgtcctccagcagcgcccccacatcaaaaatattgtccaggtacgcctggatctgcacctgcagcttgtcactctcgatggcaaaactgacactgagagagaggaagaggcctatccaaggtcacacggcaggcaacggcagagccaggatttaaacccaggtctacctgaccccagcactcatgctgctaaccactcagccatactctgccgtgggcaggcagttcagtctggggggcagtacagggcttacctccaagtacaggtccaggcccaagtgggtgaactcatattgcaggaagacacggaagttcatgttctccaccgaatgtaccacaatgttgatgaactgcatgcaggccacctgggagccagggacatggggagatctatgatcctctaggtggggttgctcaatgccttccacctccacttaccccaagcctccctccttctccacagttctcactccactaactcccagccttggcctgcccaacatttcacctccatgttccctcaatccagccccctgccaacatccacccttcccctactgaccactcagtccttacgctttgcgggggcagagcccattgcccagcacccaggaccctagctgctccctgcacccaagagggcctggcccaggcctcaggctgctgggctcctgagctcaccatgaagtcgatgttgctgtcctcattccggaaatattccatcagcttttcaaagcggtgctgctccccacacacctgggtaaggggaatggctctcactgaggcccagtgacacacgtcctaagctaccttctggctgccacacctgtgcttcaacaggctcctctccagttaattctaagttgagccacgtcactcttctgctcaaaacctccactccctctcaatctcccactctccctcactttttccactctggccacactggcatcctggcacattcccaccccagggcctttgcacttactgttccaactccctggagtgccctcactcccacaccaagtcccttgcttccttcacagctttgctgaaatctcacttgctcagtgaggccttccctgaccaccctgcaaccaattccccctccctctgcaacattgctggcttttttctcacagcatttatcatttcctaacatactatgtaatttgcttgtttattatatcgtttctgtctttccctatatggtttcctttgttcactgatgtgcccaagtgccctgttcctgacacatagtaggcactcaataaatattcattaaaggaatgaatgaatgaagatatcttgtcttatgcatcttatgcagccccacacatctacttcttgcaagcctgttagccagagtccgcaactcctggaggtatgaaccaaggctagtttggatctggcaaggctgagtcagaggttcagcaggtccctgtagttgtccctacccccacccaggtggtgcccttacctgaccctgtaccttccattcagaacttccccatcccagattgctgagccagtgatgtggctcaacttcaacttttgggcgttccccaaatgcccacccaatgtccccagctgcctccagcaaaggccacaactgccaacaacaagactccaagcaacaccatagggggaaatgcatgtttgggtgagggactccggtacctccttgaagttgtcaaaggctgcaaggatgatgtcatgtcctccccgcaccaagcacacggccgccagcagctccagcaccagagccttggttctggagagagaaggggcaggttgtcccttgagaacaggcaggacccgcggcaagggtgggcacaggcctggctaggaggagcatagtgggtgcagaatgagcctctgagacctggaggacagagtaagcaaggggctaagtaggagaagactctagatacggagaaaggtttggggcctggacctcacctggggttcttgttgttgaggctcagagcaatctcattgacacaggctgggtggttcatgacaaggctgaagccagactggggagagaggagaggtcagtgtctccaggaagggccccccaggacttcaggcacccacgccacgtggatctttaactgccctcgagtttaggaagttctttgtatccaaccgcaacttctgtggccaccaaaacctggccttgtttctattttttttttcaagatggagtttccctctgtcacccaggctggagcgcagtggcgccatctcagctcaccgcagtctctgcctcccgggttcaagtgattctcctgactcagcttcccatg

SEQ ID NO: 4780 - DNA, 311 bp, Homo sapiens
accgtgaaggggacatccccgacgctgcccacggagtagcagttgtctccagggttgacagctccggtgaggacctgatgcagatgcatctccggagcccgggctggacagaatgcgcgggaggtgcgacaagctccgcgcctgaccctcctcgggctgcgagagccgtttccctctgtgcctccctcggaaacccgccccgcggaggctctggcttaactcctcgcccccctttcgccttccctccgcctcgtccctgccatgggagctcctcgaccgccgccgccgcccgggtcgccgctcagctgcgg

SEQ ID NO: 4781 - DNA, 1335 bp, Homo sapiens
cctcaaactcctggattcaagtgatccccctgcctcagcctcctgagtaactgggactgtaaacatgacagccgcacttcacagttacactggggctggatgagtcaggacttttgctctcaaatctacaggtgggttaggagaaaactgacatgagctcagtcagagtttattgccaccttcctggtgccgtttcttctagccagctactgctctgggtttgaggagaaagggcctactcatttgcaatggctaagaagtgagatggtgctgccagagtgccgacccccgaatcctcaggggccctggcctctcctggcagcatccacccattctggttaccatgccagccctccagactatggctcatttgttcactagagggcttggtagcttggcagtttggggaaagcgggaggcacttcccaggggaagaccagagaagaccagcccccagccccacaaacttcctgcagcctgctggtgcagagggaactcttgccagtttactaccagatttcatgagatgttggcaggcctggggggcacctcagggagagtgcgttcccagccctttcattcatggtaaatgacacccctggggcatacagtgatgttaggtttttctctgaaacttctttgatcttttaaaaccagattcttagcatggattgagccagatctgttccttaccccctttttccaaagaggacggtgcacccacaattttaccataacatattgggatctcaggcctgaagatgacccattctttgtaaataagttggattttcctcataatatgtgtgggtttttttggtgggggaggagggggcagggttccgctctgtcatctgtcacccaggctggagtgcagtagtgcaatcagggctcactgcagctttgacttcccaggctcaagcaatccttgtgcctcagcctcctgatgctgggattataggcgtgagccaccgcgcctggccccgggcctttatttttatttttaaccttttgacaagacacgctttctattagagctgctttttgtctccctggttcgatttcctgatgtagaatcattgtgttgctgatttttcagttgaaaatgtttaaactgcttcctttgagaacaagtttgagttttagtaagctgtaaagctgttttatttgattcactgtgaataagacaagtacaaaaaaaaaagtgaaaacacagcacatttcaagtgtaatcccctttggaatttttccaaagtcttagtatatgtctttgtgacagaaaaacatagatgggacaggtaaatgaaatgttcctagttgcatagctgttaacca

SEQ ID NO: 4782 - DNA, 4279 bp, Homo sapiens
cgtgccttcggagagaggggttggaagcaatagagaagtagacttaaggggaaaccagcaaggggaaggagaggcccgggaacgcagcagggcgagttgttttgctccactcgtccaggaagccctagatgccgggggttcagggtcgaggctgcgttaaagtaacgttcttttctccccgggcgcgccctgtcttcctgggcattccttgcgctctccgttcgctttgcagagagatctgagcttcgctgtctcccggtcggacgctcgcagctgcgttcccgggctggggctccgtgccgtccagggccgggtctgggggccaggacctgctgggatgacgtgagttgaggaggctcagcggaaagcgacaggaaaggtgggtggaaaaggaaagggcccattagacgaatctgattcatcttctgtgactaagcacccgcaacagttaggaatttaggcagagctggtgatcctgggacaatagcacttcctaggtaattcgtcttaaaaagttaaagaagctgcttgaccacaaagtatgaacttctggagggcggggcccgtggcagctgacagggaatattgtgtgttgagaaaggaaatgagttccaaggataccaaggacaacgttaccagaggcagaaatgacacgagatacaaaagaacgtattcaaaaatttaacaaaacagaaatggaaaattattttaaaatatattgaaatatcaacgaataacacctcaaatgtacagggatatgtaaagcagcaactcgggtcggaagcaaggaatcgaggcgttgggtgtgtttaaacttgacgaggtagggagaagagaccctgatacaaactccttcagaatcgttgactctcggtcctttctagtatatttttttagtagaacaacgtgcagataagtgtttaaaatgcagatcttcctaaggaaacacttttaaaggcaacagaggggaatttttttttaagttaaaatggaagaagttagtgggtttaacagatatgaacaactgagtttcctttgggggagaggcaatgaaaagagccggagtactttagggatcactttggagaggatattgtagtgggggaaaggaaggtaaaaacttaggaagcagagtagtacctttaaagtcgtcagtactttatataccatcaactgggctatggacaacagaagctgtgcctggaaataactcacactgaaggttaacttgaatataaatttagaacagatcttaaatacaaatgatgatgttcattataaactgttattcttcaaagactcatttaactgaagtaacattgtatttgcataccagagcactggtgtttttcaaaatgagtttaggataagaaaattcacttgaaaagctggagtatgtatgtattttgcgccatcatggattttatcataagcagtgttcaagaaaacaaattaccagcgaattcccaccctatgagtaaaagttatcttgtcaacatatcaatagatgaacattttgtacttcttggaatacatttcatggtagctttcatgatgaagtttatagacgtgtctgttatatgtcttcatgtctccagctacaactgagtgtctctgatgattaaacaacaacccgagttttctctctgcagaagactcctaaaaaagagttgtaattagttaccagctgagaaagatgcaatacaaataggaaataaccgcaatttataattttatttatctaaaatctgtcttcctccctagacagtaagctctctgaagtcaagaaccatagttgttttgttcactactgtatactcagcacctaatagtacttggcacataagtactcagggactatttgtcaaatgcaagaacatatgcccctaaagcagaagtcaggaaaaccagaaaaaatgcctttaagtattacagaaatgccacaggcctccacttaaattgaaaagcaagctaacccctcttgataaaaatgtggattgagatcaagaagcagcttctctgctccttctggaatctccacctggtttagcctgctgcctccactcctgcctccaccatgtccatcagggtgatccagaagtcctacaaggtgtccacctttggcccccaggctttcagcagccacccctacactagtgggcccagtgcctgcaccagctccttgagcttctccctagtggggagcttcactgtgcagcttctggggtggcctgggcggaggctatggtggggccagcagtatgcgaggcatcaccaccatcacggtaaaccagagcctgctgagcccccttaacctggaggtggactccaacatccaggctgtatacacccaggagaaggagcagatcaagaccctcaacaacaagtttgcctccttcacagaccaggtatggttcctggagcagcagaacaaggtgctggagaccaagtggagccttctgcagcagcacaagatggctgggagcaacatggacaacatgttcgggagctatatcaacaaccttaggcggctgctggagccaggagaagctgaggctggaagcggagcttggcaacatgcaggggctggtggaggacttcaggaacaagtatgaggatgagatcaataagcctacagagatggagaattaatttgtcctcatcaagaaggatgtggatgaaacttacatgaacaacgtagagctggagtctcacctggaagggccgactgtatgaagtggagatccgggagctgcagtcccagatctccaacatgtctgtggtgctgtccatggacagcagccactcctggacatggacagcatcatcactgaggtaaagaggcagtacaaggaggttgccaactgcagccgggctgaggctgagagcacgtaccagatcaagtatgtggagctgcagacgctggctaggaagcacagggatgacctgcggcatacaaagactcagatctccaagatgaaccggaacatcagccagctccaggctgagattgagggcctccaaggccagggggcttccctggaggccaccatcccagatgctgagcatcgtggggagctggccgttaaggatgccaatgccaagctctccaagctggaggccactctgcaacgtgtgagtaccaggagctgatgaaagtcaagctggcctggaaatggaggtcgccacctacagaaagctgcgggagagctaggagagccagctggagtctgggatgcagaacatgagtatccatacgaagaccaccagcggctatgcaggtgatctgagctcggcctatgtgggcctcacaactcgtgacctcagctatggcctgggctccagctttggctctggcacaggcttcagctccttcaggtgcaccagctccaccagggccgtggttgtgaagaagatcgagacccgcgatgggaagctggtgtctgagtcctctgacttcctgcccaagtgaacaactgtggcagctcctcctagtctgcccctcccgtggctgccacagactccaggagggaggctgctgtgtggggaagcacagacaacaggagaccccccacctgaggctcaacccacccgtgggggagtttactgtctggggaccccccttgcccatgcttccagctagaaaacaattgtggttttttttttggtccaaaataaaacctcagctagctccaccacaaaaaaaaaaaaaaaaattgtggattgagtcgttattgcttctagtttactgagttccttctatttatataaattcttgatttgatatcaagctcattctggggtgaaagtttagggaataaatcagacatacatttcagggcaaaaccccctatgtatttaaaagtagttgtgacacacttcgttaaacaattatccttaattataattcttagtctattggcttaaatttattacttgaaattgtcactactcgtttgccaagtttacatgtttagtgtctatacttacagttcttcccagatagaagatacataatttatcaaatgggcaaagaagtccttcagggagttggtaatagctctacatgctgattggtaattgaattagcaagatatggtagatctaactgattagaaggtttcaatttaacttgctgaactaaggaagtaaaatgcagaattattaaccatttcaatattatcttaatttgggatgtgataattaattaccacaaactgagtggcttaaacaaacatttatttctcacagttagggaggacgtgaagtccattattaa

SEQ ID NO: 4783 - DNA, 2089 bp, Homo sapiens
taatttgttgactctgtagcatgtcaagaagagtagttttttgagatctggcaagaatattttagagatacatattcttttctaagtatgttatcaccctgtggtgttgagcatatcgtcccaaaaacctgcttcagcaagcagttcttggccaggcatggtggctcacacctgtaatcccagcactttgggaggccgaggcaggtggatcacgaggtcaggagttcaagaccagcctggccaagatggtgaaaccccatctctactaaaaatacaaaaattagccgggcgtggaggtgggcgcctgtcagctactcgtgaggctgaggcagagaattacttgaactcaggaggtggaggttttggtgagctgagatggcgccactgcactccaacccgagcgacagagcaagattccgtcccaaaaagaaaaagcagtttttgccatcagcaaggatatctcctccactttaatggacaggcctcatttttggcagctatgctgtttgagatgtagactgaatatccaaggttcctccctagctcaagtttttacttgtgattacacacaccacattgaattccgtcttcagaggcaaagatttgggcttcatatctcaacagcaaaagggcctgttcagcaattcccttcattttagactcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttaggaaaactggttaaacaatcccccatttgggcctgtcatcattttaatagtgacgatgttctttctgaaatcttcagggtcggagtcaggctgaatttttttaaaaattaaatattatgttcaaattctttcctttttgccattgtgaaaaagcaaaattttaaatgatttctcctgttagaatttttaaaaatacccacaggttggaccatctttcttatgggttgcacaatgaatttatattttaaattagattaagtagaatgtgaagtacatttcagatttactagttttctttccattgttcattttgggttgcctcagattcagtgtatattttaaaatattggttacataataggtactcaatgaaatggtttatagtagaatatctaagctagcactttattttaaaaagtaacttattaattaatcacacattgatggtacaccttgtatttagcaaatgtttgcatgttgataaaatctcctatgtcttctttcttaaatccagttgctgattttgtaaaatacagttgtgataaagcagcattacgggggggaaaaagctatattccaactggtgttaaatgtattcaacaaaatcttacatcatacagtatttatttcttaattaatagaacttcagtgatatacttggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtggctttatgaaatgttgtgaattgatactgtaatcaataaagtgcttttaaccag

SEQ ID NO: 4784 - DNA, 325 bp, Homo sapiens
ggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccacggaacagcaggctctcctctccgagggggggcg

SEQ ID NO: 4785 - DNA, 252 bp, Homo sapiens
ttctgtatgcatgtgtttaattttaagtgtcaacactgaaaaattttaacagataaaaacacattacacaacgtctacaaccttcacaacagtgagaacctcctgcccggccaggagggtctcttcccgcctccccatcggaggactcaaggtgggagaaggcgaaaaggatgggggagttgagttccttggtgttgttgtggctcagaaagatggagttgacggcagagaggcgtctgagttggacaccac

SEQ ID NO: 4786 - DNA, 1731 bp, Homo sapiens
ggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaagaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggcaccatccgtctccctggcaggccaagagctac

SEQ ID NO: 4787 - DNA, 1001 bp, Homo sapiens
ccagctgccggtcctggaacacccagaactggggccctgcagggtggaggccgggaggtcaggggtgggctccccgcgccggccccagcgcgccccgccgccggccccactcaccgctaaagaggaggattcggccgtctcggtgccgagcataggcggcctgcaccaccctcacctgggcgggcagcccctcccagaagcggtgcagccgtgcgggtcgcggggacaccagctgtccggagggctggaggcgccagaaccaggggcctgcaggggacaaaggggttcgcaggaaggcatgagacagcaggaggtctcctcccccagggtgtgtggctgggtggggaggggtcccatctggaaatcaagggcgcaatggatctagggtgaccagcccatcctggcccgcctgagacttttccctttttagcgctaaaagtgccagggccttgcctggtggctcagacctgtaatgccagcacattgggaggctgacaccggagaatcacctgagccaggagattgagcccagcctgggcaatatagtgagactccatctctacaaaataataaaataaattactagcaaggcgtggtggcatgtgcctgtggtcccagctaccagggaggctgaggtgggaggatcgcttgagcccagtattttgaggctgcagtgagccatgatcacaccactgcactgcggcccaggcaacaaagcaagaccctgtctcaaagaagaaaaaagttccgcttccagggtaagcccacagccccagtgggtcactggaagtgggcaggaaaccaacatatatgaggccaagtgaaatgactcacctttgaagaagaaagtttcccctcggatgttggcgatggcgtcaaaattgccctcacatcgatcagggatggggaaggatgggctggggaggaaaggagagagttgctgcaggccatcgcggtcatcctgagacaggcggtacttgtcagggtcgcccaccggaccc

SEQ ID NO: 4788 - DNA, 3272 bp, Homo sapiens
ataggagttcctctgctgcaggaaggcggcggccgccgcctggtgctgctgctggagctgcgggctgacgggcgacctccggctctgcggctgctgcggcgccgcgggcggcgggggctgctgttgaggtatattcatggcgggcggcggcggagggggcacagcggtagccgagaaggggccgccgaagccgccgccgccgccgccgctcgtcggaacgctgagcccagtgcagccgtgcggcgacacgggcgagaagctagggaagaaggccgggttcatggacgacggcagcccggggtagaagccgttctctgagtcggggctgggcggcggcatggcgctgagcgagccgccgctgccgccgcccggggtggtggcagacgagccgggcggctgcggctgcggctggggcggctgctggggtggcggcggctgctgctgcggctgggtcggcggcggctgctggggctggggtggcggcgacgcggtctgcaccgaccagggggtgccgaagccgggcagcggcggcggcgacgcggagccgcctccccctccgcctcctgggggccccccgcccccgccgccgccgccgccgcccgggtgtggaaggtccgggctctgcaggctgctgaaggcgcccgcgccaagcgcacctccgggcaggaggttactgggactgttgagcagagggtggttgggggactccatggagcccggcgcggggttcaccggcgtcgaggaggccaagcccgcattgggggactcggcggcgctgccctcgcccgcggctggggtcttgcgagggctgcccgcgcctccgtggcggcgccgcggggctgcaggcggcgagggagggagctgcgggagcgggggcaggtctgccggacgctgccgcggggcgaagtcctgcggcgagaggtgctgctgatgcaggaggctgaactgctgcggcggctgttgctgctggcgctgagcgagctgcgccggctggaggagcgggccggctggcggcggcggcgggctgaaccgaccggggcagtggagcggcggaggcggcggcggcggcttcgagtccggagggtggggaaggtggggagggctgaactctttcctcttctggctgctcagctgctgctgctgccgcttactgaagtcctgcggggaggaggtgcggcagcagcagcaggaggaggcggaggaggaggaggggtggtgcagactcggtttgaagtcctgggaggggaggaggtgggtcacacccgcgatcgtgccgccgccggggtggtggtcggggagtttctccgtggccgccgcccccgaaagcggccgcgccggctgctgtgtcagccccagaagcagctcatcctgcatggtctgctgatgcgccaggaacggggaggaagaggaagcggcggcggccgggctgcccgcgccgccgccgagggggacggagaagggggaggcggcctctaagaagccggtgacaggcaacggtggtggcgacagtgggccgaagggcgtggcggagggcagcgggttgacggaccccacggcgtaaggaccatacgcctcgccgcagaacaggggcccaggactgctacttcggagcggggcggtctgcagcaccccaaacccgaaatccctcatttatcaggccgccggcagcgggaggagacgctcctcgtcccctgccccacctaggaagccgccggcgctggggttgcgcggccgtggtggaaggagggggagtcagtgagagagggacaccgtgactgagccagggggcaccgacttcggccccaccacccctcgcggcgatcgccgccgccgccgccgtcgcagtcgccgtagccgccctggccgcttaagaaccccggaacgtgcgtcagcgccacctcacaatcgcgccgccccccgcggtgcgtcccggcacgcgcgggcgcgaggccaccgcgtccccgtcgcccctccccgcccctcattactatgcagacgcagccgagggcgcgctcgcgctcccgggagggcgggagcgagcggcgtgtcccgttgggtctctccgctcccggggaaatggacaggccggttggggtgggggtcggctggcaaacagtggtcgggagcattgggcgggcgcgcgcacgagggcaagcacgcgcgggagggagggacggttcctgggcaacggcccctccttggcgcgggatccgcgcagagtctgcctgggtcgcacgcgtctccgcccctcgcggtgcctcctccttcctgtcacctcggttccgccctgggtggggagaagccctgctgcaccactcgggcttcccagagcggggctggcccgcgggggaaactgaggcccgggaccccgaccggcgcctgcactgtgcgacccgcgtagaaataggcgcccgaggggcccccagcgcaacgcgggagcccggcccagcccgggggtcctgtggtgaactagcgtctgggctctgccggcttgaagtccgctgagcgcctcgccgcgcacctctagaccccgagtccccgatctagggcctccttgtagccctaggtagcgccctctaagcttgtttctgtttttaggcgctggtaggagtgctgtcaccgacgtcgtagagccgccgagggtgtttctgtagggtaaacatgaagcctcggctatattccaggcattttcacttgggtaagaaggaacaaagtccctggaacaaacacgctccgcgtggttatttacacactcggatgcgtggaacgggttccacggcgagctcccatagtaaccccgggccagctccgcttcataaaagcctttcgtgtgccatcagggctgcagcgtgggactcctccccaccacattcattccggcgtccccgccccttccccccagggagactctaatttattcctaagctttatgaattttcaagggagaaatagttcttacatcagggaaaaaaggaggttctgactcagcagcagacttgttgagacttgcaaaatggaagggagagagctttccatggtagagctctttagaagcattagaggaggaactaatcctgtgtttccttttgtatagaaacattttacataaagtatttgaaggtctagataaagaataacagagtgatccatactacatgatgaggtgaactttatgtttctgttttgtaattttaactgttttgcttgatgcttagagaaatgaaactattaaatgaatcctagaatatagactcaaacccccaaagcaatag

SEQ ID NO: 4789 - DNA, 3287 bp, Homo sapiens
tttatttatttattttttgaggtggagtctcactctgtcgcccaggctggagtgcagtggcacaatctcggctcactgaaacctccgcctcccgggttcaagccgattctcctgcctcagtctcccgagtagctgagattagaggcaaccaccactatacccgactaatttttgtatttttcagtagagatagggcttcaccatgttggccaggctggtctcgaactcctgacgtcagttgatcctcccacctcagcctcccaaaatgctggaattaaagctgtaagccagcgggcctggtggacatcttttaataatcagtctttccattcaggtatatggtatatgtctccatttacttaggtcttatttcatatccttcaggttggagctatcatttcttttcatacaggttttgcacatttcttgtgaggtttattccttcatggtccatggattttgttgtgaattgggaatcctttttccaccaagtatattttctaatttgttactttagtatacaggaaagataactaatttttatctgcagtttattatctatgaaaggataaaagtagaactactcagtaaaaggtttccataatcaaataagtatgggctaaacaaagctaaacagatgtgttcactgctggacttatcaatgcttgtgataatttttttttttttttttgaggcagagttttgctctgtagcccaggctggagtgcagtggcgggatcttggctcactgcaacctccacctcccgggttcaagtgattctcctgcctcagcctcccgagtagctgggactatggcatgcaccaccacatctggctaatttttgtaattttaatagagacagggtttcaccatgttgactaggctggtctcagaactgttgacctcaggtgatctgcctgcctcagcctcccaaagtgctgggattacaggtgtgagccaccaccaccaggcaattgaagacgtatattctatgaagaaatgggtagattttaatgaacaataccccttttgtgggcagattcctaagtcccaggccctcacaacaaaggggcagtgggcctggagatgccagcttcagctgccagagggactgctcctccagggccaccccagcccacttttgatcaccaagttttgatcaccaagaatcccaagaagggcacagggaatttcctttcttacctgcccatgaaaccttttgtcactagacatcctgaaacatactttgggaaactgcatccaaagacccttctagtttcaaatctgtggatccaggggtctccactgaaccttacctgatgcccaaactcccacccattcactcccaaccagaacacagaagatgacctggtgccaaaatgaaagctttaatgagtgttactcctagacagtcacgtctcagcttctgccagcctccactgtcccagctctcttagctggccgacaggggagctagttgctgaggggtagggatctggagtctaaagagcagagccaggcaaaaggaggtacaggaagcccccgatgggggctgggctcccggagtgtggtgctggggggtcatgggcttcaggccggcccctcttcaggcattcctagcaaagccaccaggggctccaggggtgtgggggtccccatgggcacagggtgggtgcgttcatgcttgcgcaagtcgctggcactcaagaaggccttgggacaatgggggcaggtgtaggggcgcactgagctgtgagtgcggctgtgtttgcgcagcccagcccggtcagagaagctcttgccgcactgggtgcaggggaagggccggagctccgggtgtgagcgctcgtgccgacgcagcagcgtcattgtggagaaggtctccttgcactctcggcacacaaactgggggggcttctcgtcagcctcctcaccccccgcctcgcctgccccttccaagggaccaggagcctcccggacaccagcatcttggcattccacatgctccaccgtcatgcccaccacctgccactgtgtggccatcacaccacctgactccgggggcagccctagcagccctgctggagggtcccccagccccgcccctgctgccggggcggctgaactctcacctgccacgcccacaggcagcgccaaccccaccaccagctcctgtgcagggggcacacccgcggcctcactgcttcgatgggtccgctcgtgcttcctcaggctcgacgacaccacaaaggatttcccacatgcgttacagtggaaggggcgctcccccgagtgcacccggctatgcttcgtgaggctggcacgctcggcgaaggctcgcccgcactcctcacagcggaagggccgctggccagagtgcaccagcgcgtgccgcttgaggtcccaggacgccacgaacgtcttgtcacattgcaggcacttgaacggccggtcgcctgtgtgcacacgccggtgcatggccaggtccgccggctgccggaagtccttgccgcacttctcgcagtggtatggcttcaccccttcatgggcgcgctggtggcgacggaagctcgaggggtcggagaacatgcggccgcagcgcgggcacaggaagggcttctcccccgagtgcgtgcgctcgtggctctggtaggaactgagctgcgtgaagcccttgccgcaggccgggcagcggtagggcttctgtgccgcgtggatgcgctggtggcacgtgagcgaggatgagcgggagaagctcttcccgcactcggagcagaggaaggggcgctcgccggtgtgggacctgcgggggtgtggaggacttggcatgaaggcgacagacccataacgtgaccccactgcctgtctgggctgtactttaggggctccccaaacgttcgtgggggcctaggcttaatcccctaagagccacatggctgcaccccagaggaagaagccttcaggctggctgggtgtctctattccaaagacctgtctctgcacattaaagaccaagatatgggccgggcgcggtggctcacgcctgtaattccagcactttgggaggccgaggtcaggagatcgagaccatcccggctaacacggtgaaaccccgtctctactaaaactataaaaaattagccaggcgtggtggtgggtgcatgtagtcccagctactcgggaggctgaggcaggagaatggcgtgaacccgggaggcggagcttgcagtgagccgagatcttgccactgcactccagcctgggcggcagagcgagactccgtctc

SEQ ID NO: 4790 - DNA, 581 bp, Homo sapiens
aatgaatgttttaagacacacacaggtgtctctgggacaaccaagaaaagtgcaacaggcagatggattgaggagtctggctaaagataaggatttaggaactgctgaattaaaattacccaagcgtgagaagtggtgttgtgattaagagagaaaaaaaaaatggaggtctgaggaataacatttaaggaataaatgaagaggccaaaaggtggggggtggttcaggagtgagcaaaatgtaagaagtcaagggaataaatctttaaagtaggggttgtcaaaaatgtcaaatacagaaaaaaagtcaagtactagcttgtgaattaaactgtggatttagaattaagattttagactttacaggaagggactgttaaccagagagccaaatggcagattttagttaaggagccagtagaaggtgacaaagtagaggtaagaatattccttcaaaaagattggcagctaaaaaaaaaagaggccgggcgtggtggctcacgcctgtaatcccagcactttgggaggtcgaggtggaagaatggcgtgaacctggaaggcagagcttgcagtgagctaaga

SEQ ID NO: 4791 - DNA, 587 bp, Homo sapiens
acaggatctcggaccacaaaccaaggagtctcgtggccttggattcccagaccctaggatggtatccctctgacagctggaaccaggcaagggggaacacacctcagcctcagagcagcctctggacactctccaggtaacatgaaaataacttgtgcaaacacagcccccatgccagaaagtccagtgccctaggaagggctatcctgaattctgaccctgatgtttgccaaaggagaatgcagcaagacagtgtcaggtttggccaaatgtgaccctgctcagagctataccacttgaatactggcacaaaagaaaggaccaaggtaaagcaaatttatttgggaggaacaattcccttcaaaagtagatccctatctttaggagacaaaaggcaacactgtgatgaacccacaccccctagtttggggggccacaggcccaaccccattctgctgtgggctctagcctcagtagccagatccaggtaaacctcagtttcaagaataaaggtgagccacagacatgcagcaccaccagagacaacaacaccccgtggcaagaagaccatgttctggactgtctcc

SEQ ID NO: 4792 - DNA, 5941 bp, Homo sapiens
gcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggccctctggaggaggtgagcctgggctcttggcctaatgtttcagctctcactttccagtcctgagctgttgttgccagtccatctttcatgagaccattggagtgatctttctggtcttgtcacttcatggtttaaagtttccctgggcctacacagtgaagtccaaattcagcatggtattacaagacccttatgatccagtcttaaccattggttaggtatcctacccatactgtttatctcttgaatacctctatgctctttgacaagtccagcccctacgtgttcatacctcacttctgtgacacagccttgcttcagggctcccaatctctgtagcctccctgaactgtgcatttgctctgctgcttgatttgtttctgtgactgttccattctcctcgggacacatagcagggaccttgtcttggtccttttttttttggctttaacagaacatagcaaagaacctgacataggtgtagtctgagtttaccactggggttatcacagaggtctgctaagtgaatacaacacagtggggacccagaacctctagaaagggttgaggattacaatccccagatagctacaatcagggaataatgtaacctgtttgcctagggtgctacatggtaatcttgaattagaacaactgagacttccatgggaccttagggtgataaccattaaacctactctttcagtgtttactttgtaaaagcatcacactaaggaggttgtcatttaatcctcacacctaccctgggttattaacactgttgatgaagaaagccttacttggctaagatatggagcaggttagtaagtggtagaatagatactccagtcctgtctccaaaatgcaaatttttttttaattaaaaaaatttctaattttcaatatatttatttttgattttttattttctgtagagttggagtttcgccatgttgtccaggctggtctcgaactcatgggtgcaagccataccccaacctcgaccttccgaagtgttgggaatactggcatgagccatgatgcctggcctcaaaatgcatacccttaaccactatgctctcacatttttagatgtgggatttctgtctacgacgtcgcccccactaagacctagggcttaggtgtcgaggtgggaaagatcttgaggcttttcttctcaaaattaatcagaaacgatgtgaattttatatctctttctgaggttttccccataagctaatcgggattagtagacttaaaggtgaatgaccaactgtatccctggttcactggttaggaagagtacatagtctttgtgtataggctattttcctcggtaaccttgggcaacatgcttgacttctccaagccagtctcctttgtgaaaggtgatatacttacaagacattatattaaatgagaacccaggcaggttacctaccctaccatgacactggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataatttacagattggggtggggagtggtatctacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttcaaagtatgatgaaaccatcctcatcttttctacccctggactaatcatttaaaatggatacagacactttaaaactgctgagtttatcttgtgttaagcaattaagacttctctgtctaatcatgctacttgttctgcttttgtcaattgatactctcatagcccttttgaaaaagtatgtttttgtagaaattaagttgtatgccctcaggacgtacaacttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgca

SEQ ID NO: 4793 - DNA, 7047 bp, Homo sapiens
tccttttctggcatcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggcatgcgcaaggcttgaatggcgtcggggttggagggttggaaggtcgggaagtgaaggactcgcaggcatatttaacaacgcaaagttgctaggagttggtaccagcgtttgggaggtagaggtggcgctcatgcatatttgagacaacatctggatggttggggagaacggtaagctgtctttgcttggccatcttgggctagcaggccttgcagagaactacctttttagctgagtgaagggatcaacctgagttggagttctcctatgctgtggccagatccactagaaattaacccagaatcttagcctctcagtggcctatcgaggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgagattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttgaggctggattgtgaaggatatttgaaaagtattttagagtccaccagatcatccatgtgagtgaccatgcagcaaaagaaggagggtcctctcagtgattaaggtaagattatgaagtattaattcttccactgatatctcaaaaggtgatctggacaaaggaacaggtatctcagtcaacctcgaatacctgggattacaggcaccagccaccatgcctggctaatttttgtatttttagtagagatggggtttcaccaaattggccagcctggtctcgaactcctgacatcaggtcatcctcccgcctcggcctcccaaagtgctgagattacaagcatgagccattgcgcccagccctccatctcatatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgaaaagacaaatttactaggcctgttgtatcccagtttagttaagatatttatatacccacagcaacagtttgtggatcttcacttttgttttctgccattaatatgatgattaccctgttttgctgcttttactttgcttgtttcttatagcttagcttataaagtatccattaacaactgactgttggacttctctctctttgtttcaaggactgcaattgcaaatgcctgtaggatccagatgccataaatgtataagatggttctggtgttttcttcttttcttgaaacactgtcttgtgtgtgtgaggggggtgatcttttgttcagtcatttttgatagagacattagaagagcgatttctttaaaatataaacaagggtgcaaatgggatggtaaagggcaactgacgctactaggaggatagtagggagtgtttgacattgtgtgtaattgggacatacatatttcctccaaaagggaagactttagtacttctgctgattgttgcctagtggaaatgtctgcctaagattaccagttgtctacaaaaagcctgattggcttcaggtttttttttttttaatttagatatgatttaacgtatatgatttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttggaaaaaaatacaacaatgcaaaataatacaaattttaaaaaatacaatatatttatgtggtgtttacattgtattcgttattataagtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaataatcaggccaggtgtggtggctcatttctgtaatcccagcactttgggaggccaaggtgggtggatcatttgagctctggagttcgagaccagccagggccacatagcaagacctcgtctgtttcatccttcagattaaggtgctccaatataatccataccacagcaaacaaaatcctgaagaattctgctgccaatcatcttgcctcttaacctcaatataacaagaacatacataaaagagattaccgatttagtaaatgctatcatctcataccccattcacaccactggcctgtgatattcttcccctgggagagatgtcaagatttaatgagattctatcataacctgtagaaaaaatgagcaacatggaaacattccaattccagtcttaggtgagttccaatgaaattacctgaagaactgaactagtgcttttagttaaggggaaaagtgccctagcttttaaaaaatatgtctataaatctagttttaaaaacatagcaattggctgcatgtggtggctcatgcctataatctcagcattttgagaggccgaggtgagaggactgcttaaacccaggagttcaagaccagcctgaacaaaatagggagacccccatctctacaaaaataattttaaaaagctgggcatggtggcatatacctgtggttccaggtacctggagggctgacgtaggaggattgcctgagcccagcaggccaaagctacagtgagctgtgattgtgccactgcactccagcctgggcgaggagagcaagactctgtctcaaaaataaatacataaaatacagcgtccaaaagtgtgtcatcttctttctcttcacaattttataataagggggtaaaatgcctgtgagtctattcattatggaaaataaaaaagaaacaaccatttaaggctgaggcattttggttttctgctggcttttagattattaactgcattaagcccctcactacaacttcaccagtatcctagaaacaatttgggtttccttttaggcagggacaggaagtattcaaaggacagacatatggacagagttaggcccttcagggttgaagtctgtggtttcttgtgtctcaagactcaatgtcttgagaagttggtggaccctgtcctccatccaagaagtgctgccaaggaaaccaggggacctagcaaagagtcaggagaaaatggccaaaggaattctgacattccatacctgaatgaactgttttcgtgagtgctttgatcaccctatcccctatcaaggcgctgaacaggtggcccgcaggaaatctgctgtcgcaagaggagggctttgacttacttcccctaattgttgagtaaaaagtgattctcttaatttctgtattctgtttttcatatcaccagtagaagggtcctgtggatctaaatagagcacattttaaggctacagagtagtagaaattgatgtttagacaaggcagcttgttcaaaatctgaaaggcacacccagaagctttctctaaacattttggctcccattaaaaaaaaaaaaaaaacaagcttccaagtttgctggagccatgttttctctaatgtccccacagaacagtggttggtaggatggcggagacatggacttcagagagttcttggtagaagactcaaagagccacctgtcatgagacatcccacttccttccccaggttacttccaagactgagcagccaggtttttggtagatgagaacaaatgtttcttcctgaagccctggggcttcaggtaggaagaaggactgctatacttgttctcacccttggcttctggctgctccagttaaacatggttcccattgatacagacattagagtgggaaaggacttcgttcatagaccgaagaccctcaaaggaaagtccttccattttgggaagggtgacattgatttcgtttagctgcttaagatatgtacttgctgttgtcttgtgagacatgacatctgaagctgaagaggagtccctctcattgttgtcattgtcccaccgggactgaaagtctcccagttgaggcagcattttagctttgatgtctacagggcaatcatggatcaggaaatttctgcaaattagacttggaaaacaaggtcttgatccttcttgtctttggacgaagactaatcatcacttttgactgaaggtgtagtgctggagactatgttggaggcagcacctgatgcactatccatattcttccccttgatcttgtcttaaagttttccaaatggattccgaggcttgtctttgatgaaaaggtcaaacatactggcagtcatgttgtttctcataagctggatgtcaacctcaatttctcctctttatccttctctcctggtttggatttcaaggtataccaccgcatcttcctgctcccctagtctgggtgcaggtcctgcaggtacacctcggcgaagcccaagtacagtagcagcagcacctcaaaggtggcctcctcctctgacactgaggtggcatacttctccttacccacctgaatcaccgagtacatgttgcttgtaccgtcaggctcttggttcttggcccctggccctatgcctgcaacactgtcacctgcacgtggattgggaaccacatagcccccggacctgctaaggccattaaggacaggatggtgatgcctcggctgactgacgtgagaagattgtcatgacccatggcctctactgctgtcctaccaacagaaacttcataatgttgtgcaggcgttaccactacctagttccagaacattgccatcacccccaaaataaatcttgcattcattaagcagtcacccctattttcccccatccctgtcaaccactgatttatgttctgtctctatggattcccctgttccggataattcacgtaaatggaataacacaatagatgccttttatcatgggtttctttcacttaggatgttttgtagggtaatccatatagcatgtatcaggacttcattttttttttttttttttttgagatggagtttcattcttcttgcccaggctggagtgcagtggtgcagtctcagctcacttcaacctctgccttctaggttcaagcgattctcctgtcttggcttcccaagtagccaggattacaggcgcctggcaccatgcccagctactttttttgtatttttagtagagacagggtttcaccatgttggccaggctggtctcaaactcctgacctcaggtgatccgcctgcctcagcctcccaacgtgctgggattacaggcgtgagccaccatggtcagccttcattcattttcatggagaaaaatatttcattgtatgagtataccacattttgtttatccatttatccattgattggttgtttctacttttttttagctattatgaataatattgctgtgaacatttgtgtacaaggttttagtggacacaagtttttatttttcttgggtatatatctaggagtggaattgctgggtcatattgtaattctgttcaactttttgaagaacttcccaactgttctccatggtggctgtgccattgtatattcctaccagcagtgtatgaagttacaaatttctccacatcctgagaacccctttattattttctgtttttctttttgattatagccatcctagtaggtgtaaagtggtatctcattgtgattttattttgcatttccctaaatgattaatgatattgagcatcttttcatgtgcttcttggccactagtatatcttctttgaagaaatgtctattcaagtctttggcagtttctaaatgagttattgtctt

SEQ ID NO: 4794 - DNA, 7379 bp, Homo sapiens
gcccggtttcggcgatgggttatagggtccgcgtcagccccgcgcccgcacagccaacgtcacgccgcattcttatttccaaagacccctggagcttggggtcccaccccagcggtctttcggggcgtcccctgcccttcacgcgccgcgccggctcggcccgaagcgccctgcggacccgcagcctgggccgccccgaacctgacggccccgcgggggtcggacgcgggaggaacggcctcgctttcagagacgcagcgggagggcggtccccgctgtccctctggccgggtcctcagcacgcgttctcctcactcccaggactagcgagcggcgggcgcggaccggggcctggggtcggaggcggcgcagccagaaaggccccagcggcgctgagacgtttgggggaaggcgggggcttcgcgtttcgatggcgggaagcggaatgaggttggaccggccgggccggcgttcagggacccggcgggaggcggagggctggcgtcctcgcggacatccatctgcagcgaaccaggcagaggctttgggattagatccttgactccttgcgtcagtagttaagctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatggtgcatgctgctgccaaaccagagatcacttgtagacttgaaagggaacatgagctttgggtgaaggattcccagcccccaacagaggccaaaaagctaccacccagccaggtaagccttgatggaacatctcttgcacaaagatcaccatgttcattgagcctttagtgcctcctgggctctgatcaacccacgaatcagtatctccgcagcacttcctgtggtttggattcaggttttttacttctgtttcctgcctttatgataggagtttgggtaacctgtgagaaacacagccacagtgtaaacctcttgagacaagctacactgatgggacaatcagggtgagggcaatccggcgccgtggctatgtcagctcatgtgtgctctttcaggaggacatgtctcacagacacagatcttcagctctgacatgctcgatctcacaagcccttttctgaaacctccatcatgtgctttctgattctctacaggcagaaggaacataaagtatgcattttatgatacgactcagcttggagggatgaagtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgccagtgtggcaggagctgcagtcagaggcagcatctcaagagccctgggagcaggggccagccacgtgaagcccacgagtgtcgctggcacagggaagggacacgaggatcacactgacccaagagaaggcccacagtgaggaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaggctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgtttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctttaccttctaactggcaaaaatgattgagctcactttgaaggactagagaggaaagaaactgaaagacaaaaatcaggtgaatacacaggcacttcccctgcccacctctgttcctggccctgtcccctcgtgagtgagagcagagctcgttctgtcagcttctctgagctcctggtcctcgcttagggacacacaagacagagatgtgttgaaatagactctgctttattcaggtagcaaaaggttaggaatcaaacatggtttttaaaacctcctttcatctttgaaaatagaggagagaacatccctgggccagtcacagttactgtatttggctaagcacacacctgtatgagggacccgcccctccacactgttctgataggtacttagcaccctagaaactcatcctctgcaggagagagaagcaagggtctggagcgcggtcacatactctaaggtatcttccaggacagggggctgggctccctcactcccacctggagtcgctatggctattgggatcaaactaccagttacatactggttacttggaatgtcagacccggtgggtatcagtcatcagggagagggaggggaaatgccaggacacgtacatacggatgctgtcaagactacaggcaaggaggagggtggcgacaagcgctgggactccagccaaagcgggagtgcatgcttcttcccctcccagagccctgtggtttttcttcttgtgaggcataaacaggaagcctctccaacaagggggtctccagcactaggggctgaaactcagccagcctctccaaacaaagcaaaggggccagcctgggccagggcctctgataaggatgctcactgtgtttccacgggggtcctgaatgaggaagttcaggaataagatggcagtcatcttcttccttcttggccattggctgacaaaggggaacggagcaggcctgtgccccttgagaaatcgggtagtgcaaattttatgacaaacagcattctcagtggccccgctgcacagggacccccctttcccaccacctaaggaaggcactggccggtgtcctcggagcacgctgatgctgacgtggagagggcgagttgcttcccctagcttccacctcagctccagaactactcccacagagacccactcacggctgctcacaggatggcctcctgctctgagggattcttcaaggatgaagaggccgcaggaagcatgtgtgctggaacagcaccttgatgtggaatccctgtgggtagggcagaggctatagccccacctaaaaaagcctttctccctccctttccacgagttcacatccacagtgcctgacctgggcaagttcctgaacgcccatggagacggtgatggggagaaggaggcctgtgtgtgccttagccacgcagatagtaacacctcccagagctcccgcaccacaggcctgtggggtccctctgaccgccagacccacagggctgggagacatttccacaggtcaaaggcagaaagcaagaaaggaattcctgactagaactgaaaatgacacgaaagcaacagtgctaaggctaagtactggggtggggatgaaagggcaggtggggtaccagggtacctgcggtaccagggaggggctcggacgccagcatctaccctgggaatgggaagggtactcagacagcagcttctaccctgggaataggaagggtactcaggtgctcagatgccagcatctaccctgggaatgggaagggtactcagacagcagcttctaccctgggaataggaagggtactcaggtgctcagatgccagcatctaccctgggaatgggaagcggcagactatggagaaagggcccacccacaggggcctgcagcacagcacaggacctgcctgagccaggcagcaagcaagctgggatggatggcgcccacttcctgcctgtttaaaacaagtatcaggcagggcagagaaaccctgcctgctgacttgcctcatttcctgcccatggttaaggaaggcagaacctagacaaaatcatcctcctcctgataagcggcctcctgagcctgccaagacggagctgcccttggaaggaaaagtgcttcactttaggtggaaggaagatcggggcgaggagggtgtgaacctagcagtgccagaagcccctctgtgcctctagggcggtggttctgtggttctgaagctagagcaggcccaaagtccctggaggaggttgttcaaagcccttgtcactgagcgcccattcggggatgtctcagtgggccctggagatcctggtgcagagtccccagggcagctcagagaagagtggactagcctgtcgtgcagatggtgcattcagagagcaactcctacaacaaggactttggagacaaattcctacctgtcccactaaggacgaggatggggcagatggcagctaagtccacactgcagccagaggtctttgagggagctcgaggctctcattcactaatcctagggcagatggggagtcagcaggcacttggatctctgctgccacttcatggagagggaaactgaggcacaaagaggaagggattaatcagaccactgcctgcagcagagctggggctgcatcccaagcctcccaactccaacttcgtcccatcctctcctgggtaaaccgggccgggcatgccacgggttaaacgcggctcggctctccgggaagcaccagaccccctgccagaagagcccagctccaccatctggagctgcaggaagagaactttcttgggtgctctgtgcaaagggcttgtgattgtttcgccctaaaggaagccctgggaagaggtagagttccgcacgagaccacggcctcactgcttctgctgtgggagccagggtaggaagtcccagaacaatgcctctgggggctcttgcagccaggccagctgtccctagagcaggggcaacctccccctctaacaaggtggtctttcccattcccacttagactgtgggcagcctccctggaacattccccagggatgtccaacagtctcccctaccaggacactcctcttgccaccaaaactcaggggctgaaacctttcatgatggggttattttctgcagcaccttaaaaatgaacttgagatatagaaccttctggcacatttgtgtgctgtgaggcatggctgtgctgagtggggcctcaggaaacaggtcatgcacctcctgatacccctgctgctctgggatgccactgcccacttcctggtgcttagagaccatcgccaccagcagaagatcctagggcagcctagaatctgcagagcctgtcccagtgatcacagaggcgtctccaaggcagtcccaaggactccctgtccctcaggacatcccgggggcctcctggctggtgtggggatacaggagtctctcgggaggctccatgatgcagtccttcagaacctccgctgcttccctggagggcaggatgggtggcttctgggtcctgggctcctccacatagagggctcccatctcctccttcctgagcctggcgcctgtgagggaggaaggagaatacaattagactgactgacagtgaccgccttccacatccagcttcgcccaggggctgtttggtgaggaaagcttggcagaacagactgaagtcaggaccacgactgctctttgcagccctcatctgttgctactctgttcattcttttatcctgagataggggatctcaactgggggcgattttgtcccccaggggccatttgccaatgtctggagatgatttttgtggtcacaaatggggtgtgtgctactggtatccagtggttatctaataggtagaggccatggatgctgctcaagttcccacagtgaacaggaagggcccccaacagagattacccagccccagcatcaacaatgccaaggctgagagccctg

SEQ ID NO: 4795 - DNA, 4680 bp, Homo sapiens
gtgtcacaggccgcgcgctttttccgggtactagaacacagtcccgcttacagggcctcagcctaaagcgggtggaaaacttgtatcacccccctacacacacacacacacacacacacacacacacacacacacacacacagcccagtcctaccaccaggcgcgaccgtcccctccctctccagacggaaggggccaggttaacgcagccgcgcgcccgccgggcaggttaggttctcgggggcctagaagggaaaggggttaactaatgtgtgcgatgcgtgtgcagatgacaaaatttagggcacgtagagtttgcccggccccaccgcgtccgctcgcggggaccctcgggggccgggccccatggggccggggcagcacggtgtagcccctcctccggccgggcgcgagcgtctgcagaacaaagcctggagtccagccccggccccggcgcggccgcccctcaaccaacccccaggcggcaaggccctctccacgcgcgctctccagcctggcggggccctggaagccgggacacgcggaggccgggagggtcatcggcgtttaaggcagcctcccacaccaagtgcaccgcccggatcccctctgcacgagggctttctgcttattgctcttttccccagcagccagaatcgtcaccgtagcgcgggaaggggcctcgcgggccgtctgcagcaggtgcggccgggagccgcaggcccgcgcggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcagttgggtatttttttagctagataatttaaacgcgaataattcaagtctgactaaatgaaagtcacataatcagaatgcaaataattgaatttctactgcattcattaattcagtgtggaggtgtgtgtgaagactactatgatgagctgtcacagctcaataaaatctcagtcaattaattttttcattatcttagtattatatcaacaaaaaagtgaagtgtgtatatatatctatacacgtgcatatgtgcatactatgtattatataaatacatatacattaaatcaaaatgcaaggaaatacctttctgaatcataatctatatcattttctttttttccttcttcatcttcttcagggaaacgtctattcattaaggcaaacttgtgaattgcttcttccacagagtacttagtctgcccagaaacacacgcctcaatgtcttctgaattcagatggctctgtaagaagaggtgaaggctgctatctgaaagcaaaagtgcattctgtaggactctatattaaaaaaaaaaggaaaaataattggtgaacaggatggtcagtgatagggtagaagaaagaaaaacattagaaaagtaccactgaagattaagagaagagttatagagcaacaatccattaatacgaacttggatcgtgaagtctgtgaagtctgagcagagtgtttcctgtggcctctgtcagcggtttcctgcctgccataagtacaaggaactgttcatgggattgtactcgtggctttgtttctgttggaaatgtgttttattttctttataaaataatgggtaatctttaaaattgattttagatggtttgaggcattacaccacaacagtaatgagcactaatgccaatgatattggacacaaattcattttagctttatttcatgtctgaagcaattctactgagccttgaactgctcacgtgttgttattaacttgctagtaacttaacacatgggtacagcaaacaaaagtgatcagagtccaggttgatcgggacctcaaggctactgtcctttttcttgagctataattcaatttccaattttactgtacattagactcattatttcccagcgttttctttttctgctcaatactgccatctggaggacacacagatgaaaagagaaggagccaggctcacccagctcacaattccaaagagccagaaagatgtggctggggaggggacatctgaacactcccccaggcctagagttcaaaccagtgagtcggctaggtacagttttggtttttggaatctcctctgtttctctggctaaattcatgccaccatactccatgagttttaaataagcaaaaataatttttaaatgtatttatatgcttattttagtcagatagttcattctgaaatttaaaatgaaaatttttgagagtgttttcccatctggttaggtgagcataattaatttattttgagtactatttggcttactatcagagagggctgtgactgccaccatcataatattaaatactattttttccttagtcatgtttgtgccatattttccacaaacaaatctaatagcccaaaatcaatttcaaacctaatataaagagtactttgtaaaacagtcaataaaatgtcatttgtagaaacctccatttaaaaagtatatgattttcaaacctttataaaaggaataaaaaatagcctctaggattttaaaagaatttctagaaagatatttatagtgcaaatcagaagttattcctttccccataacagttttagactaaacaaagcaaaatctgttttttttccctaaactggacacagttgaaaagcacagttttcctcaacatgattttattagatgtattatatgctggtttagctgagaatatatagctatgcaaaatcatttcatcctaactaaggatgtcctgggtctgctgaacccaatacaatgatatatatacataactgcatagtacatggaaggttagcagtttgatgtagaaaaaaaaaattaactcagcctgtttagctcttactataagaaaaaataaaacctacaaatcttcattgaagacattcatgatctatgctgtggtgccctctattgaacacaaagacataaaaatcgtgtgtgtgtaaaactagctgtcatggttcaacactagccttttgtaaaaaatctttaatattccttaatatttgaagaaatacaaaaccatgatactaaagtctaaactgtagggtaaatgtagttgtattaatgggatgaattcagtaaagaagggaagcggctcccagtcatgaacaaatctattcaaacctaaattgaaaatcccattcaaacctaaaaattagtaggaattccatttttcatagttagagacttactgagtttatattttttagcctataactttcttttcataactattagaagggactttaagtttataattactcaggggcaagaatacaaaagggagattatagttaagactgaagaaaaatgaatatatttgaaaaatctcacaatcataccaaatttagccagcatttaagagtactgctaattttaaatttgccaggttctgggattcatatagtatgtccatctttcctataatttctttatctataaaactgagataatacccaactcctaagatttttagtactgagactaaaacatgtaaaatgccaaacacgtagaaagtgttcgataaatggtagaaattattcttatttggcacctagtcaaagaaacaattttccaattcctctacaaagatcagtactttcttattacatatgtatcatttcacaaatgaccttaaagaaaaataggtatatatacacatatacaaagacattgtggtttcaaaaggtttgaacatatttagtgcttctggttcataacttcaaaactcacatgaaaaccaggctttaaaaatgcatgcgaaaaacctacaatacaagcatgtttccatgttttaatgctgtggttcctaaaattcctctacaaacaaggtacaggctattgatggctggccctacttaacaggtaaccagtgggggctcagaggatgtcaaactggggccaagacacagtgccaaggtacacatcacatccagttccctagagtggaccctggttgggtgaggggagggggcaccaggggcaaagacatggagggtactaccttacacaacccgggcaagcacagatctgagggacacagaagggaggctggggagggtcagcaggggccgcagagctcagttcaggcctgaagccagccctgtggtatttgactcctcacttccttcaggtttaggctgtgtggaagcaccagctttcatttttaaagtgaaatattaacttgtagacaaatgttcacataccacaggggaacaaatgatatcacaagagaaccccctgccaattccatgatttgacaatccaatcggatgacaatccagattcagtgttaatgaatctagccgtagccctggatgtgtacacagtgctccccctagaaggaagtgtcaggacaaggacttgttcattctgtgcagtcctatgtccgtggcacgcagcctggcccaaagcattcacttaataaacatctattgaatgaaggatcgctgcatggtttttagagtttttttcaagtccttttcatctgtaggacacaaccac

SEQ ID NO: 4796 - DNA, 16429 bp, Homo sapiens
agctgaggtggttgctgggagaggtggttgctgggagagctgttccggcgctcacgttccaattccaaattacaaattccgatctagagctcccacgcttgggggctgtggagcgctcgccagccgctccccgtttgctgctgggtcttacgaagttctcatatccatcatacagtttctttgtcacactgtccgcggcacgccagtccctatgacagaaagcacctgcggtctgtctggaggcggagttggtggcggagagaaaaagttctggagacacctggttgggagcaggctaaggaaacaaatggggaggaattagccacaaatcctcaaatagacagctactcaaaggcatcttcacggacaatttccaagcattggatgcagtggtgcattcttgcattgggcagtgattgtgtgcacacatctctttaagggagagtggaaatggggtgaggaggaaaatgggagtaggatagagtgtagcgttgacatttattttctttaaaggaagacccgagcatacctgagagctcagtgaagaaagtagttctggcgaatcggattaatatggtatgatcagcctttagcaagattctatcacttttcccactgatgatgtgagacggtgtccgcgtgtgtaagtgcacacacgtgtgtgtgtgtgtgtgttgcatcttctgagtatttttcaaggagaagctttttagtgatctgaaaaagtcaattcagttagccactagagttcaatcaaaaacttcggaagagtgcatcatcttaaagtacataagagagaatcatgacctccagctcagaattcaagaataggcaggtttgtgaaatagtaagctcagaaagttgagggccagtgaactcctatttcaagttcttgcgggtgtttgtacttttttcccagcaccactgaaacttgaccttcggccggcgcggtggctcacgcctgtaatcccagcactttgggaggccgagatgggcggatcacgaggtcagaagatcgagaccatcctggctaacacggtgaaaccccgtctctactaaaaatacaaaaaaattagccgagcgtggtggcgggctcctgtagtcccagctacttgggaggctgaggcaggagaatggcgtgaacccgggaggcggagcttgcggtaagccgagatcgcgccactgcactccagcctgggcgactgagcacgactccgtctcaaaaaaaaaaaaaaaaaaacaaaaaaaaaacttgaccttcattatatctcactgccctcatcccaaacatttcctctcccagttttccaggaaacggcatcgctgcccatctcttttcaggccccaaccctggagaagaacctaaatttctcatttcctcactacctacctccagtccttcagcaggtcccgttggttgggctgctaaactatgggctaaatcctttcagtactttccatgcccacagctaccactctggtccaagccaaattcttagttcccctggacttcttactgcagtagcctctcagcttccactcttggcaaaatcaattttataaaaccttgaaatcccttaataccactcgtctgcttaaacctcggcatcccacatttaccactatcaggaaggatcacgtttgtttgtttgctgtctcattcccccatttatatgtgaattccacgggtaagggcctgctcctacatcccacacctctacatccacagagcctagagaccgcaggcgcggggaaagcactccacgaccatcactggccaggccacaagagtgctggatctaaatttggaaccggactttcagagctgaaataaacctgaggttttccaggggcttttaacctccttttacagccaaggatgcgcctaagaaaggggagaggcttccgtgacttcctgcagtaacgcagccactagagattgagactacaacgacttgggagtctaaaagtctgcaaccttttccactccagagctcaatgtttcctcaatcccccgggatcggcatcagcaaaaacccggagaagcggagcctttctcaaagaaaatgacctccagactcatgctaccatctcgaccggtgcaagtatcacgcatgcgcagggccggccgcccggccgcacctcgccaactcctactcggacacgtcatctaggtcggcctgggtctggtgggaggggccgggggcggggctcgtacgcggggcgaagtggtccccctacttccggatccggcctcacctggccaacgcctcattcggggttccttggttacgtggctgcggtgtctacccggtgctggggcgtggcggagagagaccgccccgccctccacgcaggccacaaaatggaggccctgccctgtgggcttttgtggcctgggcgctgtcgtgccgaaagacgaaagtgacaattccagttgcaaactggaaagaaatggagtttttccttcattctccccatgatcgtgacggtccttttctcaaagtactaatacttttaatgggactgtaaaacttgagggatatgactctctcctctcctctgcttcagattgcatttgccaactctgatttaccgccaatactatggtgctgtcatattcatagagacagaaagtagagcagtggttgtagagagagtctgcagaaggagggatggggatttactgtttaatggcatacggtttcagtatgggttggtgaaaaagttgggatgaatggtgatgactgcacaacaatgcaaatatgctaatgtcacagaagtgtacacttaaaaatggttagacggtaagttttctattatgtatattttaccacaatttttttttaaatgcaacagagtctcgctgttgcctaggctggagtgcagtggcaggatctcagctcactgcaacctccgccttccaggttcaagcgattcttgtgcctcagcctcccaagtaactgggattacaggtgccagccaccacgcccagctaatttttgtatgtttagtagagatggggtttcaccatgttggccaggctaggctgttctcgaactcctgaactcaggtgatccgcctgccttggtctcccccagtgccgagattacacgcgtgagccaccacgccgggccccacagttttttgtttttgtcttttaaattttttttaacagcatttgtgtctttttttctttttcttttgtttttgaaacagaatctcactctgtcaccaagctggagtgcagtggcgccatcttggctcactgcaacctctgactccctggttcaagcaattctcctgcctcagcctctccagtagctggggttacaggcacgcaccaccccgcccagctaatttttgtatttttagtagagatggggtttcaccatattggccagggtggtctccatctcctgaccccgtgatccaccttgccttcccaaagtgctgggattacaggtgtgagccactgcacccaacctaaatggcatttgtttcttccactcctctctgccagaataatttggacagccttttctgagtttcccatgacgacttctgtataagattgtcggatatagcaaataaaagtacagtatacccaggtaaattttaatttcagatgatcaatgaataattttttagtataagtacattccaactattacatgggacataagggtattttatctgatcaccctacttttgtgtcaagttaaaattattagcaaaagtgcttccgtttttaggaagtgcacactgtactctagtagttaggcaggagaacagggtctgcgagcagggaacctaaggccgtttcacactgacttcctagagccatttggaaaggaaaaccctaactttccactcctaagtaacaaaaggcccagaggccactccctttgcaaacccccaccttttctgtgccgcagctggaaaattgaaagtgcctctgattggttgctttctgcaactaatcagatgtttgcatagagtgtaactttgtaacttcacttcagcctctgattggttgctgtccccaaccaatcagactgattgtgggccaaggcttcgtttgaatagaagtgcaactttgtaacttcactttagcctctgattgcaggccaccacttcatttacatggggtgagcaccaatgcgttttgttcaattctttgttcaaaaccccaagaatctggacaacttgcactcaagaccctctacgggtttggcgagccaggtaggaggaagcccaaagtatgggatttatttttctcctttcttcttttcctctctgctacatacaggggaatctttctctctttcttttcctttccaactcgggactcttggtgaacagtgcctaagcatagtgacaactgcaagtttctggccagagcctctctctggtgaaactgaaaggcttccatgtggaagcgtctgagtaacaccactgggtttgggtgagggacctgagtccttttccttgtttttgtttttctgagtcctattccttttttcctttttctgagttatttccctttttttcttttccagtctttcagtggctgttttctagtagctccttggcaattgaggggaactggctgggaccactctccagtgctgtctgaaggccaaggagtgaacagggatggctgccctgccttgaagagggaaggactcttttctatcctttccagctatagtccctgatccctacatgtgatgcggttggcagcggaagctcatcctgggcgaactcacacacttttcaggagacttaaaccttttcttatgctaagttcttcccttcccctactcatctggctaaaggacagactatgcaaaaaaggttatacaagtcagagggtctgagcatgtcggaggtggtctgtgtggggcatggggtggggggaaaattcatgaaaggcaatttattgcctaaatttaaagggttaaagggttgctttaagtgggatagaaaaaccttaaggaaagttcatagtaggtcctcagtggtggagtgttgtgggaagtcagggaccctgaatgaagggactggctgaagccatggcagaagaacataaactgtgaagatttcatggacatttattagttccccaaattaacacttttataatttcttacgcctgtctttactgcaatctctgaacataaattgtgaagattttatggacatttatcacttccccaatcaatactcttgtgatttcctatgcctgtctttactttaatctcttaatcccgtcatcttcgtaagctgaggaggatgtaagtcgcctcaggaccctgtgatgattgtgttaactgcacaaattgtttgtagagcatgtgtgtttgaacagtatcaaatctgggcaccttaagaacaggataacagcaacgttcaaggaacaagggagataatcttaacgtctggctgcctatgggccgggcagaacagagccatatttctcttctttctaaagcaaataggagaaatatcgctgaattctttttctcagcaaggaacagccctgagacagagaatgtgtgcctaggggtagtcctccaaaatggccactctggggacggctgtcttttatggtcgtagataagggaagaaataagccccggactcccatagtgctcccaggcttattaggacgaggaaattcccacctaataaattttggtcagactggttgtctgctctcaaaccctgtctcctgataagatgttatcaatgacaatgcgtgcccgaaacttcactcgcaattttaatttcgccctggtcatgtggtcccgtgatctcaccctgcctccatttgccttgtgatattttattaccttgtgaagcatgtgatctctgtgacccacaccctattcatacactccctccccttttggaaatcactaataaaaacttgctggttttacggcttagggggcatcacagaacctgccgacatatgatgtctcccctggacacccagctttaaaatttctctctttgtactctttccctttatttctcagaccagccaacacttagggaaaatagaaaaggacccacgtgaaatatcaggggctgaatttcccccgatagtggagggaaccatcccaaagcagtgccagcccccatctaaggtcagagacatctgacagactaaatcagggccctaaagtagggacgcccctggggaccccagtctgggttcagaattttttcagggggatgccctgggtaaagtttgggtcacctaatgggccctctacttttcaaagtcctcttctctgttccagaccactatgggcaactctctatctattcgacctgattccactatgggcaattctacacctgttccaccggattcctcacttggctacatcatccaccattggaatcaatttgaccctgacactctaaagggaaaatgtataatttttttctgtaatactgtttggccccattatgagctgcccagcccccagcaatgggcagtcagtggtagccttaattatgacaccatcctgcaattagacctactttgcaagaggctgggaagatggtcagaagtcccatatgtacaggcttttatcaaaatatcaaaaacctaacaatctgtgaaactcccagaacccaccccccaaaggaaagtactaaggcagaactagatattatagatgaccctcttttacaagggctagctgtctctcagggtgaacagcaaccatccccataaagccccttgccaagtgctcctgaggctaaaacccaggagcaaacaccagggaccctactaaatccccctcacacttggagaggaatgccatattcaattctctctccagccctgctacctcttagggaagtagcaggaaccaaggggccagtcctagtgcaggcccccttctctataatttatacatacaatataaggaaaagctaggaaactattctgagaatcctaagaaacttgcagatgggttccagcgtttgaccttagcctctgatctatcatggagagatgttcaattcattctagcaacctgttacacaccctcagaaaaggaatgaatctctgaggccgcccacctgcaagcaatgaattatttgcccaaaactctcagggcaatcatcccggcccagacacagttcccactattgatcataattgggactataacactcctgaggaaatgaacaaccgggctaaatttcttgaggctctccttggaggaatgagaaagggaataactaaaggcagtaaattatgataaagtaagggaggttacacaaggcaaggaggaaaatccagccatgttttatggcaggctggagggagactttaaaaaatatactaatctggacccttcctctcccgaaggcaaaatattaatagcacagcatttcattagccaatctgccccagacattagagataagctccaaaagctacagatggggccacaaactaatcaaaatcagcttacttatatcacatttatggtgtataacaatcgtgacctgaaggaaggaaaaagggaacagagtaaacaaaatggcaagccaaaagtatggcagccatcattgacgatgccctgaatgtacaaagagtgtctaagggaaacccgaagggccataaagataatgccagcaaaggctcttgcttcaaatgcaagaaaagaagacattgggcaaaggattgtgctaagtccccgccaggcccctgccgtcaatgcaagggcaccagtcatgacccctggcactggagaattgactgcccatgttcccactgaggggctcagtcagtcaaaactctagcagtgcaaaaggaggaattagatgaagactgaaggggcctgaggtcttcctcactgcccctgttcaggaacattgtaattactactgaggagccccaggtaactctggacgtcatgggcacccaaattcagtttctttttgatgcaggagcaaattactctgttcttactgcttatgcagtaaggcgttcctcccagtccacaagtgttatgggaatagaatggaagccacaaacgagtttttattttattttattttattttattttactttaagttctgggatacatatgcagaatgtgcaggtttgttacataggtatacatgtgccatggtggtttgctgcacctatcgacccatcatctaggttttaagtcccacatggattaggtatttgtcctaatgctcttcctccccttgcccccaaccccccaacaggccttggtgtgtgatgttcccctccctgtgtccatgtgttctcattgttcacctcccacttattagtgagaacatgcggtgtttggttttctgttcctgtgttagtttgctgagaatgatggtttccagcttcatccatgttcctgcaaaggacatgaactcattcttttttatggttgcgtagtattccatggtgtatatgtgccatattttctttatcccgtctatcactgatgggcatttgggttggttccaagtctttgccatggtaaatagtgttgcagtaaacatacatgtgcatgtatctttataatagaatgatttataatcctttgggtatatatccagtaatgggattgctgggtcaaatggtatttctggttctagatccctgaggaatcaccacactgtcttccacaatggttgaactaatttacactcccaccaacagtgtaaaaatgttcctacttctccacagcctcaccagcctgtttcctgactttttaatgatcaccattctaactggtgtgagatggtatctcactgtgattttgatttgcatttctctaacaacaagtgatgagcattttttcatatgtttgttggctgcataaatgtcttcttttgagaagtgtctgttcatatcctttgcctactttttgatggggttgacaaacaagattcattactcctcctttgatttgtcaatttgagaaacaactcttccaacaggatttcctagtagtaccaagctgcccaatccccctgttgggaagagatattatggttaaaatggaggcactactacaatttaagcatcacccattgaaattgctgatagtcaaaaatacagtgttccagaccacattaataaataggttaacccgctggcattggtatactggaaaaccagggaaggctaaaacagcagtgccagtcaaaatacattttaaagacctcagctagtttcccaattgaaaataatatccaattaagcaggaagcaagaaaaggcctagcacccataattgaggtattacttattacatgggctcttaaaatcctgtaattccccttgcaatacctgttctaaagcctttgggggaataccagttagtataggactggagaataccggttagtataggacctgagaataattaatgaggctgttatccccgtccacccactggtggcagatccatatacccttatggctcaggtacaaggggatgcaaaatggttctcagtcctggacctaaaagatgctttcttctccatccctctggccccagagtcccaatacctttttgcctttgaatgggaaaatcaatatgagggaaaaacagtaatatacctggacagtgcacccttagggcattcaggatagcccccattggattgcccgagccttagagagggatctgaaggatctgaaagtgaaaaatgggaatatactccagtatgtggatgactttcttgtgtgtagcccaaacccaggaggtttctgaccaaactactataaaaactttgaatttcctggcagacaggggatacaaagtgtccgacaagaaggcacagattatcctccaatgggtgcaatatttagggtatgtcttaacacccagagcctgacaaatatccccagaacgagagcaagccataggtggtttgccccctgccccctccccaacccccccacctgccacacctagtagcagctttgttcttttttgggaatggccaggttttgcagaatatgggtaccaaatttcagactcatagcaaagcccctatatgaagcaacaaaggggcctgaagacgagctaaaggaatgaaccccagaattgagaaaagcctttgccaagttaaaacaggctctcgctcttggcatcccagacctacctaagcccttctctttgtacgtagcagagaagaagggcatagctgtgggtgtactagcccagacattaggatcagaacccagactaaccactgactttccaaagaagttggatggagtggcctcgaggtgaccaagttgcctgcggccaacagcagccactgctatgttagtggaggaagccactgaaatcgctctgagccaaccactggaagttctcaccccctcatcaggttaagtctgtcttagagataaagggacacatctggatgacaggggaaagatgaaccaaataccaggccatgttcctagacaatccagatgtaacccttaaaacctgcaacactttgaatccagcttcagtgctgcccacaggcccaataactgatcattcctgcaagcaggtcattgcacatacacaatgttagccagcctgctttaaaagacaagcctctcccagattctgaggatgagtggttcacagatggcagtagttttgtgtcaaatggggtttgacacagcactgagctggatatgcagtagtaattatcgaagcccagccactgctccttggcacatcagcacaaaaggctgaaatcattgctcttacttgagcattaatgttggtacaaggaaaaaagcttaacatctatatcgattctaaatatgcattccttgtggttcatgttcatgctacagtctggaaagaaaagggatttctaactagaaaacagtcctctataaagcctgggcctgaaattcttcagctattggaagcaatacacttgccaaaggccgtagctctaattaattgttggggtatcaaagggacttaacccctatagcacaagggaacagaaaggctgataaagaaccaaagccgcatccctcagggtgccatcccaacagaccctagccctacttcctttctatgatttcccaacagaacctgagtacacagtacagaaagaacagttaatagaggaacaagggggacacaaaaaaaggatcctggtggcatatggggtcaaaaacatatctccctcagacagcccagtggaaagttataaaagccgtgcatgcctctttccatgtggggagggatgcaactctggccatttaaaccagctctttactgggtctaacttagcttcagtggctaagcaggtttgctaggcctgctccctgtgtgcacttaacaacctaggaaacaacatgcctcctctaatagaaccagtgcagaggagaggaacttatccagggggagactggcaattagacttcacccatatgccagcttgcagaggacatgagtttttgttagtactaatagatatctttactggttgggtcgaagtttatcctaccagaacagagaaggttaatgaggctataaaggttctcttaaaagaaataatccccgggtttgggttacctcagagcctccaaattgataatggcccgtcctttatctcccagctaactcaaggggttgctaagtctcctggaatcaagtactatctacattcagcatgaaggcctcgatccttggggaaagtagaaagggctaaccaaactttaaaacgagtgttagctaagctatgtaaggaaacatcagaaacttgggtcagcttactgcccatagccctcttaaggacccataatacccctacagcaaaaattaatataaacccatatgaaatattatgtggaaggccattcttaactaatgatttaattactgatccagaaacagttggtttagtaaaatacctagtcaatctaggacagtttcaacaggctttacaaacgtttggaatgcaaagtctccccacactgggaacaatcagcaacttaaaatcaggtcaggaaataaggtacttcttaaaacatggaaagagggatcacctgctcaacaattacaacccaaacggaagggactgttttcagtggcactggccatgccttctgcagtgaaagtactaggattagatagctggatacatctttcaaggatcaagagagtgataccagaagccctggaccaggaacccgaagttgccatctgcctctacacctgtgaacctgtggaagacttcatgaagtacctgtttagaagacagtcaaaagaaaagtaaatgcctaccaattttccttggtgtctttgttgcatagttactataggctggataatagtgccatttttaaaaatgttttatttttgcagtttcattgccttcttccaaatggatggaatcacttcctttgtagtaattaagcagaatgttttaatacatttctataacaaacattcctgacggcataggtatccacccccaaagttcccattaaatcttttaaccaaattcatttcctgttgcacagagaccatcaagcttcagatgatcatgtgacagggtttccagccagttccaggtgaagacaccacccctggccatcaagaagtcacccggtctccactagacagagtagggtgagagttccgtgatctccaaccggtagtgattatgccccaagtcagcataaagaagttacggaagaaaaaccatcagtccctctgtctcacataaagacttatggggatcacgtttctcagaggggagatgaggcaggagaatagggtctggaggcagggaacctaaggccgtttcacactgacttcttagaactaaattgaaaggaaaaccctaattttccatgcctaagtaacaaaaggaccagaggctactccctttgcaaacccccaccttttctgtgtggcatatgggaaattgaaagtacctctgattgattgttttctgcaaccaatcagatgtttgcattggagtgtaactttgtaatttcacttcagtctctgattggttgctgcagtctggaaattctgcaggccaagtcttcgtttgcatagaagtgcaactttgtaacttcatcttagcctctgattggttgctttctgcaaccaatcagatgtttgcataggcgtgtgacctttgtaacttcacttcagcttctgattggttgctttccacaaccaatcagactgattgtgggccaccacttcctttacgtgaggtgaacaccaagtggccaatggaaaacctcaagagggtatttggacctgagaagattctgtatctggggcccttgagctgctgctctgcccactctcacatggtggagtgtaatttcactttgaataaatctctgcttttgttgcttcattctttccttgctttgctgtgtattttgtccaattctttgttcaaaacgccaagaacctggacaacttgcagtcaagaccctctaccagtaacactagttgtatccctgtaaatgaatgggctttgaagattttctagaagaaaaagatcacctcattgtccttcattttttgacataaaactgtgatagcccaatagataaaatgtgagttatcgatcacccctggaaaggattaggatatgccactccaaaatatgccacgtttattttgcactgaaggcaattgagaaacagtagacacaggaagagctctctgcttttcccctttttacctaaaagcagagaataaatttccttttggaaagatgacatacattttcctttataaaggtgttcccttctcctctaccaggaagatctgagatggcaccaaaatgaatctgcctaacaaaccttactgcacaattcttagctaccatacatttcatagtcaccttcccataatttactgcccttaggagcccaagtccctttcctttgactatcacctctccacaatttattgccctttgttaaaatgatatataagctccttcatttaactacatctttgggttttcacttcttatctttgatgctacgatgcatgtaaaaatattaataaaatttgtgtgctttttctcctgttaattgtatgtcttttatcaacttaaattacaggccccaagtacataattaagagagtaaaaggctgggcacggtggctgatgcctgtagtcccagcactttgggaggccaaggcaggcagatcacaaggtcaggagatcgagaccatcctggctaacatggtgaaaccccgtctctactaaaaaataaaaaaaaatttagccaggcgtggtggcgggcgccggtagtctcagctactcgggaggctgaggcaggagaatggcgtgaactcgggaggcagagcttgcagtgagcggagatcttgccactgcactccagcctgggcaacagagcaaggctccatctcaaaaaaaaaaaaaaaaaagagagagagagagtaaaagtttttcctctcctacacctccttccctgttagtctaaatactatagcttggacataaaacttatcctgaacagtaggcttataaatgcaactagcggccggatacagtggctcacacctgtaatcctagcactttgggaggccgaggcgggtggatcacctgaggtcaggagttcaagaccagcctggccaacatggagaaaccctgtctctactaaaaatacaaaaattagctgggcatggtggcacacatgtgtaatcccagctactcaggaggctgagactggagaattgcttgaacccaggaggcagaggttgcagtaagccaagatcactccactgcacttcagcccgggcatcagagcaagactccaactcaaaaataaataaaataaaataattaaataaatgcaactcatggtagattggagccgaggtatgaaaaacgttaagctttaggataaataatggttctcaggacataacttagctaacatacaagctatttataagctaacatagaagttgcaaccagaagggggattcttttggccagcagaacctggaaaaatgaaagccacagaggcaaatactaaagtatcactcaggaaagacaagagtgtagctctgtgacatagatggatatattctaatcataaaactaattttacttcttccaaatttatgcccacaaaccaactttctgcttttttcttgtctcgtatgcattttttaacttaataatctttaaacacttttataagagtttttatattctgcatagaaacactttgttagctatatgaattgcaaatattgctttatcaaaagattcctagagtcatgaaagaaagcaaacaaagtgctaatattgtggttcattgcttcacttataagataaaatgcataccatttatcaatctataaacaatgtctcaatttgaggttgaatgttagagtttacccggtaatctagtatttctctagaaatgtcaaaaaaaagggcaaaattatatagtacagaggagtgagtggctggaggttgtctagacaaggtacccactggatgccattatcttggtgaaaaagagaaagagaaaagcagtcactgacatgaggagttggcctggttcttacagataggacttggcattctcctgtcaaatataagcaatttcacagaacatgaacattagacaacgccgtgttgtgatgttgatgtagcaagacgaaaacactgtaaccctctgtaatcatgtctcaacaatccactacaacccgaatgtggtccaaaccacaaaataaccaaacatcctctgtcttgcctaagagtagtgactgctgcctctttagcaatcacaacttaagcctcagactagtctgccctccttctagataagagttattagatatctaattttaagaattaccccctgcttcctgacagcatttgatccagagcaaagctccacctctttaaaacgctccccaaaccacaaaacacaagctcaattcttataaatttctttccaatcccctcttactgagatgtcccatcgttcctcatagtgtgcgttctcccttgctgcaacaaggaaataaacccaactatagttgtgttcctggtggtctttagctgaagagcattgacactgcagaatccaggagaatccaggacaattcaagagctggagacagcttacttgtcaggacactaaaaatagacctatctctcaagggtgaatttgtattagccacagacacagaaactgatggataagtaacattactaatttgttaattaataaaaatgaaataaagccctggaagagtcagaaaagacaaatgtatagagtgagaaagtagatgaatggtttcctgaaggtgggtgtggaaaggggaattaaatgttaaagggcatgagtggtcttattggggt

SEQ ID NO: 4797 - DNA, 1149 bp, Homo sapiens
aggcggccagcagcctccgcgggagcatgccgcctcccgcagggcccgccgcgagcttccggggcccaaggaaccagtccggaggggcgcaggcggtggtcgcagcgtccccctaaatggccggccacgaacccgtctcacggtcccgcggccaggagccgccgctcatctgtctctgcagccaccgctgaggaagagtctcctctgaggggagagtcggtcatggcagcagacgccgggatggctccgcgactgctacaccaggcactcctgggcccgggcagcagaccagtcagccctgtggctcctcggcgacctccagcgggcgcccggggccgggatgcagggcgcgcggacagaaacgagacagacagctcaggcccagcagcacgcaagctcccgcgccttccgcgactgccacacgcgcggcgcgcgcgcaccctactttttctccgccacctgggccgtgattgggcgcgacctgggctcctgggtgctcattggcgccgtgaagtgctcgtcaccgccccctcctgccccttcatgcatgcgcggaggccgcctgctagcaaggtaggtggctcggcggcgagagccgtcaagggcgcattggagagtgaccctcggacccggctgccgccgtcgccgccatcttccggccgtcccagccccgccccgcggagaaacctggccaggttcctgttagaatcctgccaggtgttaacttgttttaagaggccggcacgctggcccccttctttattagagtgcagggtgggggcggggctccgcatgtctctgcgggggctgggggctcccagtgataaccgccattgcagaattaaaactgagacagtgaaagagatctgacctaaccaattccatcttgcttctgtccttgttcattcctgagcttaggtgaactaattttgggaggaacttagtttatagtttaaaataaagaggataacagccctttcccaaaacaaatcttcttatctgggaactagactgcctttgtaggactaataagttagccataagattggaaattatggtttaggagtcatgcagctggaggctacaagattctgaccctccctgaactgctcctaagatcagtgcttgagatattttgctgaccttgca

SEQ ID NO: 4798 - DNA, 12267 bp, Homo sapiens
tacttcccatgttttaagctattaacagcttttcaacaagagaagccaagatggtgaagaagctgtgtgccaaaatctcacatttatcccatgttgaactggtgaatgtcgataaaattttccacacatgatggcaggcacataggagtctcataaatacagaagaagccttttatcatctgctccaagtttttcacttctctgtagtctgaggaaatgtctcagcctcggatttcagttctgggatataacttgtgataatattggtgctggatatattactgaggttctatgggggtgagtaaaaccagagtgtttttactctgagattttggtgacccattatgttcttgatgtcacaccttacatatatttatatcacatatggctaaacaaattgttgtaattattaatagttttgtagatggacatcatggcaggtgcccataataccgtctaatcagaaggctgaggggggaaaattgcttgagcccagaagtttcagaccagcctgagcaacatagcaacagccatctcattaaaaaagttttgtgtattaaccttaacaataaagatatacgttatttgtacaccaccattacagtataccagtactgtgaatttgagttacttaccttttaccagtcagttttatacattcatgtttttgtgttatgcatgagctgcttctttcaatttgaagaattccctataacatttcacttgttttaatgaataatgagataaaaaaggttaagtcttcaatatctgtggatccgttaatattttcagtttattttccagatatattaaaattctgtatagttccatccaaatattggaatttaggaatcatcccagataattttccctgtcctttatttctctgttccacccttcctttggtaagtgttcacattatttatcatttttctttctcttgcttataagctgttactctcctgtattaaaaccattcttctagttgctttacatatttacatattatgttaaaataaagactcacaaaatgctgcaaatatagtaccgtttacacataccactcaattttccccagtggtgatattttccattaacattgtacaatatcacaaccagcacattgtcattggtgaaatgtgcacatttacatgacattttatcacatgtatacatttttgtaaccactgcatgaatcagaatgcagaactcatccatcattaaaaacgtatcccttccactagtcttataatcacatacaaccctaacttctaccatccctaacagatgaatacgaacaatgttctctaaactatttaacttcatcacattaagatacataaaaataagcattatgttacaacttgaaatgggtttttccttcagaattgagaatcatctaaggcttatttgtatagtagtagtttattccttttaatttttgagttgtattacacaatacggaaataacagacttatttaactgtttacctggtgaataacatgtgagttgtttccaggttctgactattacaaataaaatttctgtgaacagtcaagtgcaggtttggtctacacataaattttcatttctatgaaataggccatgacagcaattgctaagcctaactaactgtatgtgtgtgtttagctttaaaagaaattgccaaattattttccaatgtggtatacagttttatattcccatcagcaataaagattcaattttttctgcatgcttctcagcctttggaatcattatgttttaactatttcagctactgaaataaatctgctgtaggccaggtgtggtggctcacacctcttaattccagcactttgggaggctgaggcaggtgggtcacctgaggtcaggagtttgagaccagcttggccaacatggagaaaccccgtctctactaaaaatacaaaaaaaaaaaaaaaaaaaaaaattagctgggcgtggtggcaggcgcctgtaatcccagctacttgggaggctgaggcaggagaatcgctggaacccgggaggtggaggttgcagtgagctgagatcatgccactgcactccagcctcggtgacagaggcagactccgcctcaaagaaaaataaatcttctgtaatatctcatcatagtattaatttccatcatgtccttattgacatttccctatcctcaggggaatgttctttcatgacttttgcccattttctaatttaaagctttggatttttaatactatcttttgagaattatgtaaatattctagccataagtccaatgttggatatgagatttgaaaacaaagggccgggcatggtggctcacacctataatcccagtactttgggaggcagaggcgagcagattacctgaggtcgggaattcgagaccacctaccaaagtgctgggattacaggcgtgagccaccgcacctagcgatgcttaaatcttctagtccacaaatatgagatgtctttccacatatgtagatattcctcaactcctctgacaaatattttgtgttattcacagttcatgctgaatttcactttatcccacagtattttgccttaataatattgtaaataaaaatgtttcaatgatgtcacttttgacttctttaataatatatagaaatacaactgatttttggattgtaatcttaaatcacaaaaacttgctgagatgatcttgttattggaatccaaatttattggatccactggggttgtgtatgtacaaaaccatgtcatctgcaaaaggttttgctgcttcctatttaaaaaattttatttccttccatatgcaatgcaattaatgtcacagatacttccagtacactgttgaacagaactggcaagaatgttttatcctgtccttgctcctcttcttacagagaaagcattctttaaatactaagtgtaacattagttttgagggttttgggttttctgttttgttttgctttttagagacagggtctcactctgttgttcagtcaggagtacagtggcatcatcatagctcattgtaaacatgaacctcagcttcccaagtagctaggcgtacaggcatgtgtcatcacatctggattttttttttttttttaagatacagagtatccttatattgcctaggctgatctcagacttctggcctcaagtaatcctgctttggcttccccaagtgctgggattacagccacggcaccaggttctagttgtgaattcttaaaatatgccctttactaggttgtggtttacttcttagtttaccaaatactttttccaccttctattttttttttctctctctttttttttaaacatagtcttgctgtgtcagccaggtccaagtgcagtggcacaatctccgctcactgcaacctccacctcctgggttcaagtgattctactgcctcagactcccgagtagctgggattacaggcacttgccaccatgcacaggtaattttagtatttttagtagagatggggtttcaccatgttggccaggctggtctcgaactcctgacctcaagtgatccgcccacctcagcctcccccagtgctaggattacaggcgtgagtcactgagcccagcccatggctattacaaagtcaaaaacaaacaaacaaacaaacaaaaaaacagattctggtgaagttacagagaaaaaggaatgcttatacactgttggtaggagtattaggattacaggcgtgagcctccacttccagccgtccacaatctattgagatgaccatgttgttttcttccttcagtctgttgcactaatcatttccagctgatgaaataacgttgcattccagggatacactgtactgggtactggtgtacattcctgtttatatgttactgtatttggtttgccaaaatttactaggaaatttcacagatccactcataagcgatattatcagagttttccctgtgtatgatgtttcactttggtatctagataacaatagcatcatagaaccagtaaaaaatattacatgctcttccaagtttttaagacatttttatcgaattggtaattttcatgtgtttggtataatatacaaaagaatacatttgaactgggaatttacatgtgtgtcaggggcaggggtgagagtttttaaattaccaatttattgtcttcactttgttcttgaatgagttgtggtagtcagtgtctttctaggaatttgtctacttccacaaagatatttgtcaaaatactaatcccttgtatggaataaggtcattaggaacatcacgttttacatttctcattttaataaagctttattttatgaataagtcaacgaagtgctgtgtttctcaattatttttaattctctatttccacactaaactttatatcctttctgctttgattttaatttgttctttttttactgtattttctaaagttggaaagttaggttagtaatttgaagtacttctcatttcattacaatgttcatagctattaatttcactgtaagcgttgctttcacacatctcacagaatttgatatgttgtttctgtattttcattcacctcaaagtattttctgatttccttataaattctcctttgacttgttggttacgtaactttttttttttttttttttttttgacagtctttgtcgcccaggctgcagtgcagtggtgtgatctcggctcactgccacctctgcctcctaggctcaagtgattctagtgcctcagccacccgagtagctgggactacaggcgcacaccaccacatctggctaattttctgtatttttagtagagacagggtttcaccatgttggccaggctggtctccaactcctgacttcaagtgatccaccctccccggcctcccaaagtgctgggattacaggtgtgagccaccacactcagcataactttttaaatttgcacaaatatgtatagttcctatctctgtgttatttctaatttcattaaattttagtcatagaacatattttgtataatttcaatatttttaaccttcatttggtttgttttgtatgatgttagtgcagacattccagtttttttgtggttgctacttggatatttctatttccatcctatttctttcaacacttttgtattttataaactgcctacaacagacaccttatagtttgattgttttttaaatatccacttggtcaatcagactggtttggattgcttgatccatcagtacagctggatttaaattttccattatacattttaaaattctatgtctatcttcttttacagaatccctcctatactactttttataagttaatattttctaaaataatgtattattatctttaacgatttttccctctattatatgaaaatcctttttagtggttgcagtagggcttttttttataattgacaagtaataattgtatataattccagggaactatctgatgtttttgtatgtatacatagtgtaataactaaatcaagcacattaacatatccataacttcacctacttttgttgtgacaactttaatatctacttataacaattttaaaatatacagtcagtgacaatggtcaccatgctgtgaaatatgtctaaaacttattcctcctaacagaaaattggtactctttgaccaacgtcttgcctttgcccatctctccaacacccacatcctggaaaccataacatccaactttctacttgtatgagttagcctttcttagattccacatacaaatataatgtagtatttgcctctctgtgcctgtcttacaacacttagcatagtatactacagattcatccatgttgtcacaaatgacaattttccttcttttccaaggataaaaaatattccaatatgtatatacaacacatcttctatgtccattcatctgttatgaaaacttaagtcttttccatttattagctttgtaaataatttcaaaataagggagtgcaagatctcaacatactgcttcaattcctttggatatatacctaagtagagattgctagatcatatagtaattgtacttttagtttcttaaggaaccaccatatagtttcctaaattggctatactaatttatattcccactaacagaatgttgggacttccttttatccacatccttgccagcacctgtctttcatccttttaataatagccattctaaaaggtgtaaggtaatatcttgcagttttgatttgcaactcactaatgattagagatgttgagcatttttttcatgtatcaatcaattggccactcatgtcttcctctgaaaaatttaagttgaggtccttttcccccttttaaagacagttgttttcttgctattgggcttgggtttcttaatacattttggatattagccccttatcagatatatgatttgaaaatggtttctcaaaacccgtgtcttcattctgttaactgtaccctttgcagtgcagatgctttttagtttgatgcaactcaagttgtctgttgcgggaagtcagggaccccaaacggagggactggctgaagccatggcggaagaacgtggatcgtgaagatttcatggacatttattagttccccaaattaatacttttataatttcttatgcctgtctttactgcaatctctaaacataaattgtgaagatttcatggacacttatcacttccccaatcaatacccttgtgatttcctatgcctgttttaatctcttaatcctgtcatctcgtaagccgaggaggacgtatgtcgcctcaggaccctgtgataattgtgttaagtgcagaaattgtagagcatgtgtgtttaaacaatatgaaatctaggcaccttgaaaaaagaacaggataacagcaatgttcagggaataagagagataaccttaaactctgaccgccggtgagccaggcggaacagagccatatttctcttctttcaaaagcaaatgggagaaatatcgccgaattctttttctcagcaaggaacatccctgagaaagagaatgtgcccctgagggtgggcctctaaaatggcccccttgggtgtagctgtcttctatggtcgagactgtagggatgaaataagccccagtctcccatagcgctcccaggcttattaggacgaggaaattcccacctaataaattttggtcagacaggttgctctcaaaccctgtctcctgataagatgttatcaatgacgatggtgcccgaaacttcattagcaattttaatttcaacccagtcctgtggtcctgtgatctcgccctgcctccatttgccttgtgatattctattaccttgtgaagcacgtgatctctgtgacccacctcctattcgtatactccctcccctttgaaaatccctaataaaaacttactggttttacggctcagggggcatcacggaacctaccgacatgtgatgtctccccaggatgcccagctttaaaatttctctcttttgtactctgtccctttatttctcaacccggccaatgcttagggaaaatagaaaagaacctatgtgactatctgggcaggttccctgatagttgtctggctgtttttgctgcccatgcttttaaggatgtatccaagaaatcattgcccagaacaacatcatagagcttttcccctatattttctactagtagttttacagtttcaaaggcaacatttcaggctttaatccattttgagttgatttttctatatgctatgagaaaatggttcaatttcacatatagatatacagatatctcaaaacaatttatttatttatttgtcctctccccattctgtgtgccacttttgtcaaaaatcaattggatggaaatgtatgagttatgtctgggctttcctgttccactggtcagtgaatctgtttttatgctggtaccacagttttttgataatggattacaaaatcaggtagagtgatgcctccagctgtgtccttgttgctcaagattactttgattatttaatgtcttttgtagttccatacaagttttagaattttttttgtatttctgtaaaaaaaataaaaataaaaaggacattgaaatattgattacacagaatctgtatgtttcttttggcagtatgaaaattataacaatataaatttcccaatccatgtacaaagaaaaatttctatttttgtaatcttcaattcgtttcatcaatgttttcactatacagatctttaacctacttggttaaattcattcataagtttgtttacttagtaaatagtgtaaatgtgattagtttcctgattacttttttggatagattgttgtttgttagtgtatagaaatgctacagacttaattgtcaattttgtacgtagcactttttatggaattcattttattagttctatagtttttttttttttaatggagtctttaaggttttctagctataagataagataatcaggagaggcaagttttttcttcttttcctacttagatgtcttttatttctcttgcctaaatgctcttgctatgacttccagtacaacactgaacagaaggagaaaaaatggcatccatgtcttgttcctgatcttagagaaaaagccttcaactcttcggtgttaagatttcagctctgggccggtcatatagggcctttaatgtgttgagacatcttccttttatacctaacttgttcaggtttttatcatgcaaagatgttaagtattgggccggggactgtggctcatgcctgtaatcccagcactttgggaggtcaaggagggtggatcacctgaggttaggggttcaagaccaacctagccaacatggtgaaaccctgtctcaactaaaaatacaaaagttagctaggcatggtggcagatgcctgtaatcccagctgctcgggaggctgaggcaggagaacccaggaggcagaggttcaagcgattctcctgcctcagcctccagagtagctggcattacaggcacataccaccacgcctggctaatttttgtatttttagtaaagacgatgttgtgccatgttggccaggctggtctcgaactcctgacctcaggtgatgtgcctgcctcggcctcccaaactgctaggattacaggcgtgagccaccgcacccagccaactatgtacttacttttatcagcgagttttatactcacgttttcatgtttctaattagcactcttttactacagcttgaaggactccctttagcaattcttcccgtgcaggtctagtggtggtaaactcccacatcttttgtttgagaactttatatttctccttaatttttgaaacacaggatagttggagatagtattcctggatggcagtgttttcctttcagctttttgtatatatcacgactgccttctggcgtgaaagttttctggtgaagtctgctgacagtcttccgtggatcattttgtatgtaagaagagactattcccttgctgctctgaagattgtctttaacctttatttaattacaatatggtttggtgtgagtctccttggattcatcatacctgatgttcgagattcttagatctaaatttctatttccttgccagaattatgaggttttctgacattatttcttcaaatatgttttctgtccttttccctctatcttctccatctggtaatgtataaattattcccctttgaggatgtctcaaaagtctcttaaactatcttcaatcttttttcttttttctcctcacattacatgatttccaatggcctatctacaagtttgatagccctttcttctgcttcatcgattcttctgttggacacattaaatttttgagtccagttattgtattcttcaactttatactttttgttatcttttatttctttatgaaaattctcagtttgttcatgcattgctcccatgagactctttatggttgctctttttaatttcctgtcaggttaatcacatatcttcatttcattagggttggtttctgaagacttatcttcttttatttagagtgtttctgtgtttcatttttcttgactcaatgtgttgatttctgtgaattagataagataacctcctctaccagtcttgttaaactggccttcggtaggagatgtttctctccaaataacccagtgaaagatctagatgcctctttgttcttctataacccacttttactggcctccagaggtgaggatgaactaagtcataattttgccttgagacaggtactggtccctcataatgcagctggaagggttagtgttatatgtgtgttccagttgcttctttcctttgaagaaactgagagacaaagtttacatcatactgattttgcaccacaccaagtagagaatttgtggtagatgtctgtaatctctttgagactactcaatctgaaactgaggcgataacttctgaatgtttccaagtttgaaaatcacctattcttgctggacgcggtggctcatgcctgtaatcccagcactttgggaggctgaggcaggagaatggcgtgaacctgggaggcggagcttacagtgaaccaagatcgtgccactgcactccagcctgggcgacagagcgagactccatctcaaaaaaaaaaaagaaaagaaaagaaaatacgcttcccgattatctttgagttatgcatttcgaccagtatgctacttcacataattatttacttattagcaccctttaaatgtccactctgttctggttctgctgcttcactttccctaacccccaatcagcccatatcaatctcttcattgctaaaacagtacaacatcaacagcactggaacacagtatctagctacgtaagaaaacttacatttaccctgctgcaaaatatggagaggaatccataagagctaagtttcttttctgtccagtgtgtatggcattaactaatcaccattttccttttttcttttaagttaatgtgtcaaacatagaaataacctgaagtactatgaattatttttaaaaagttatgttgataattattttacctggaaagtattagtttgcttttaaatgttattcaaagatatactccacaagtataattttattatacctcaagaatattttataagaactcatcttaattttataattattaacctcttaaatctgtgtaagacattctatttaatgcaactccttataaaaatcatatcccacaaattatctttaacgacaaaaatctaagtctagcttgtcaagtttttctctgtaacatattctcttaacaatttgtatccttgattactaatagtcagttcctgcaaatgaaccaatcaataatcaattaaaaaaacctaaaaaaattaaatgatgtccaacattgttctcataaaaatatatacaaaattaacataccagtcgtcaatgcaatttcaaacaaacaatgcaaaattggtaaaatgttttagtctttatgtagatttcatcaagtgttttgccttctcccaagggttaggaagtttaaaactaatgttctggccgggcgcggtggctcacgcctgtaatcccagcactttgggaggctgaggtgggcggatcacctgaggtcaggagttcaagaccagcctgaccaacatggagaaaccccatctctactaaaaaatacaaaattagctgggtgcggtggcacatgcctgtaatcccagctactcggcaggctgaggcaggagaatagcttgaatccaggaggtggaggttgcagtcagccgagatcgcgccattgcactccaacctgggcaacaagagcaaaaatccgtctcaaaaaataaataaaacataaataaaataaaattattaatgttctaaccactgtttacagggttgttgcactaataaattccacgtcctggacctaaatgattgctaaaatgttttgcacacagcagctaaatgtaatcacactaacatgatgccagaaacaactgattcatctacatgcaacctcatttccctcagatgcctccaaggcaactgaagttcatagattttgtctaattacaagtgcaggctcaaatcaccttggatttgagttaggatccacggattgttttttgtttggttagttggttttgttctgtttttcaattcaggcatcttgttcatggaacattcattatttgcttgagattgctttcactgccagctgcttactttctttaccactgtagtataatct

SEQ ID NO: 4799 - DNA, 12495 bp, Homo sapiens
atgtgctgccggcccgggctccatgagcgtggcgggcactttgcagtctcgggtgttcctgcccggtcttctgttcctaaactgcagcaaagggaaaaggaactgaaaaaggcaggctcgtcgttgcaatatcaccaaaagagaaaattaacggcatgccatcaggaccacagcagttggagaaacaactctttatcccggcttgcagccacgaggtcttgattgggggaggggtggtgaagaatagtctgtgggctgctttttttttttccttttactggagctgtacagtggagtcggtgattgctgctgatcataatcaagtattttaggagcttatttagacatgtatctgatagctaaggatttttcaactttattctcttacgtatttttcaactgtaaattattgggcttttaaatcctgctagtattgctcgactcttactctcacaaatggatggaattaattgctgttaggaggttggaaaatagcaaatatagatttggacggtggtagtaattttgagcaaataatgttttatcttttttttccttatttttccctattccagtcatacacgtggacctaactgcaccagtagcttttctgagaatacttgctgaaaaggaagttttctggaatgggtaagtgtattctgattttcttgaacttttcttaaaaacaaatttttcttgctattaaagttgaataaataggattggtttcttagagagtaaaagtaggtgtttctttctttagacaatgtaccttttctgaaaaactaactcattaagtacggatttgctaattttaaggtagtaaaattacagtgtaaatattcctgtacatttttggaaactggcttatgcagtttacgaaatataattttagaccctcttttaagttgggtgataaagtagatataacctgagatgatagatttaaacaggatatttacgttctgctacaattgactgataacacttgaagtgtagtctgaacagtaattttgttaatcatttcaacaagtatttgctaagtggaagccagaagaggaggaaaatgttttgccacgtggatgtgaagatttcctctaaaagcaggaaaaaagagaacatcaccttgtaaaactgaagattgtgaccagtcagaataatgtcaaagtgcttacagtgcaggtagtgatatgtgcatctactgcagtgaaggcacttgtagcattatggtgacagctgcctcgggaagccaagttgggctttaaagtgcagggcctgctgatgttgagtgctttttgttctaaggtgcatctagtgcagatagtgaagtagattagcatctactgccctaagtgctccttctggcataagaagttatgtattcatccaataattcaagccaagcaagtatataggtgttttaatagtttttgtttgcagtcctctgttagttttgcatagttgcactacaagaagaatgtagttgtgcaaatctatgcaaaactgatggtggcctgctatttccttcaaatgaatgatttttactaattttgtgtacttttattgtgtcgatgtagaatctgcctggtctatctgatgtgacagcttctgtagcactaaagtgcttatagtgcaggtagtgtttagttatctactgcattatgagcacttaaagtactgctagctgtagaactccagcttcggcctgtcgcccaatcaaactgtcctgttactgaacactgttctatggttagttttgcaggtttgcatccagctgtgtgatattctgctgtgcaaatccatgcaaaactgactgtggtagtgaaaagtctgtagaaaagtaagggaaactcaaacccctttctacacaggttgggatcggttgcaatgctgtgtttctgtatggtattgcacttgtcccggcctgttgagtttggtggggattgtgaccagaagattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaaaagaacaaatgctaaatagagtaacagttaaatgtatgtgtacactcttcccaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataagaaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagacggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaagtttcataatacagcatggtctggtagtttgcaaaatggtgtgcttttggggagatacactagcaatttttttaaaaactggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaaaatgggtcaacttttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttattatcgcagtttttatggcgtttttgttttgtcactacagatggtctaaaggttacttattaattaattggggaagtggagacaaggaccaaagtttatctggattttcttatttaatcttcattacctgtgaaatatgtatttgtattcttactttacatatgagatcagaagttcattttcaagcagaatggaaaggtggtaaatggactctgaattaaaatatgtcagtattttaaaaggttatcttctgcctagtatttttatggaatctgacaagttctcagatcacacttgtttccttaaatcttggtaagtctgaagcattcttcattttgtttatattatacacgttagtaaggtgggagttcttttgttttttgtgttttttggccagttgataacatgaaagtttaagagaggaggccaaagtatataaaaagtcttaaactcctgcttctaataaatgtccaatatgtgttggctcctgggttgagtgtttattaatgggtctgtactaactctaaaacattaaataagaatggtatgttctgaccagccctcaaagttcagccatttctaaaagttcaaaaaatcattgtaaatattttttaaatgaggtacgagattgtacctgtctatggccagtaacacaagaaatctaggctcatgcagagttttagcatagttgaccctcagtatcagtggagggattggtaggaccctcagtgcataccaaattcttcaggtgctcaagtcccttatgtaaagtggtgcagtgtttgcatgtaaatctatacatgtcttcttgtatgctttaagctgtctatatattgcttgaataatctggtaaaatatcttacatattattcatgtagattcagtatagtatttgcgtgtggcaaattcaggtttggcttttggggacttcgtgagattttttttcctgagtattttcagtctgtttgtggttggatgcaggaaccacagatacatagggctaacttaagtaagtgccgacataaatgcgttagtcatagaggtaaataacaaagacctgagtttggtagtaagttccccgaaatgaaatgttagtatactcctaagtgattagtaattagatctcaggttgaatatactaaatccttaataactgcatgtttacttttaagacctagatttgtcagtatattagtagaggtgagcatgtactaattgttcacacttgtttataaaagcatatatactgtgaatttttagtacgtttaatgttgacttcaacttacatagactgaaaaagattgaaaaaaagcttcgacgacatcagttctgcacttgttgagatgtactgatccagatggaataccacactgttcagcaggttggggtaactagatgagactagtgaatgttccaagagtagatgaaaattggggtcctgtaaggtggtgctaggaattctaaagtgattatgcatttaccaagaaaaggttcttaaccagttgtcttaaaattattaagacgtaaagacctggaatcttaatctagctgcactatattagagtctttggggcaggatgctgcgcagacaagtattttgagaaatacctgttgattttgctgtatatacttaaggatatatctactaccctgaattgttggaaatgctgagccataggaatgcagaagaacatcaaaacaccttagaatttatatgcaggaaagagaccagtaaactatttttatggttcatgcagtcattactcagttttatagctgactgacaaaatatgtgccccaaccccacatttatttctaaatccacaggcttttccttactcttcaatttcagtaacttccctttttcttctccaatgatactttgttttggtaacagcacctaacaggccaggtgtgtagttgtctttgtgctatacctgtatttccttggttggctactgtcacagtggccaccatcattctgaacaagtaaggtgcacaaggtacaagccatgtctttagacataggttatcgtcagcatttagattctcctctaaggctttcatctaaaactcccttggttttgtgtttaaaacttagtccacagttttctagtgttaccctcagaataattgtcaaaattgtactttctaatactcaagattgcatctaaatttcaagttagaaaagatgtttatgccatattctgagtgtcttgtgtttataacctatgattctgcccttgactgtacttacgaatactccttttaaaatacgaaacttgattgagaccccagctcatttactgatgtcttaatacaactgcctttccacttaagtgttttggctcccccagttcctatcatttatcctctccaggcagacttccacttcagactgcatttgctattcccttagtttgggaacttcccactccggatacctatgacttagtcttgtttccttgtagtccttgtacacagatgtcagactggctctcccttaaactgcatactctgttcctgttctctgcatcatcatcctgaattagtggcatcacctgggatattggaagtgcaggtccttcccacccccttccaaacctgaattgggagcttcgttttttaatccccccaattaatctctaagatataaggcctccaagggcaaagatttgaagatgtgtggttcatggatgcttattcaacatctaaaatggtacctggtgtgtagaaggcactgaatagactgaacaggtaagtggaaatgcccgtgggtgaatgttacttctaggatgagacggtctgaaagagaaaagcaaaacaagactagtatgggggcaaagtgcattattgacggtgtggtaaaaagtcattagagcaacgttggtggagcaagaaaacagagtaagtaaaaaggatttgctgtgtacagtaatcccagcaaaaatgaaggaaagcctagaagtgggggatcaagaaaaaaaccaactgatagatgctccatttgtgtggatatgtaatgttcatctgttggaagtaaatgtaaaacccagcttctaaatctcagaaagcaactgacagcagcaatagggtgaatgtgaaagcactgaacaaagtaacaaaagtgctgagaagttgtgctttgtgacagattagttttcatgatgttgcgtggatgtgagaaggctctgctaataggtatagtcaggtgtgttttttttttcggtttggtttgttctctgtattactttgaaatttagactatcaagtaccagaatactatagttttctaactcaggttcactccctgcagaaggttcaggagtacaagaagccctgcactgaatcgtggtgcctcaattaaattttgagttgtccttttggcttcctgagacaaaacaacgtgttaaaccagttacttcgagtgtgtgacatgagaagatggatgatgataaagagaagttgagaaaggcacctcagattaattttaggaaacaaatgtaaactaaacttgaattctattctctttgagtcatgtaatacttggctaatcggttgagaagcttaaagaactatttaagaagtcttacagtgtaatgtttaggacggagaattctgggttcaagtaccagtttcctccattaatagcttaggcaacttaagtgtgttgtctttccccaaaaattgtaagcttaggtaggctttcccatcttgatcaaaaaggtagctatcatgttcacatccagctggaaaataaacctttcctcaacttcaaagtgaattttcagctccactctgcccacctgaactcggtctgaggaacaagattacattcaggcttgagctttgtgtaccatctctgttgacagtaccactgaaagtctgttcccttcctgaagcacacaggatacctaggcaggaaattagaaatgagtcctacctcaggaccgcaatctgtctttttcactttttggctgttatgttcttcaccaaatcactctttgggaagtaagctgcagagtgaactgatggatgtctatgaaaataaacatgcatgaccctgtaacaaagcatgtgtgtcctcaagaagattgcaggtgattttcagatgagtctcatgtctgcacagtgagaattcataaaatgaagtgttaaccaatactcagaaagtgagttcagagggggaaataactgctgcagtactgtgtgtgcttgatacacattatgacaggtaggtaattagaagagtcttgttactgcatctagtttagcatacataaatacagtaattaggttgtttttttaaaaaagcaattttgtcacagaacgatccttagtatgacgaatccaatatttaatattttttccaccccaaaatggaatgtacagtttagtaccaagtgaaaccattcagtcttggttgattgatattactatcagaataaattattggtttttttgtttatataggagttgaggcatttcactgctgtaaagtactgtgccttcttaaaatgatgatggaatattggaatatcaaagaccctaaacacattttattcattttaaagacatgtaatcctgctgatatttaaagtctaatattttaatcataggtctgtctccaaaaggatgtcatctaaaagcaattttcatattttgtatagggttattgctttgtattgatttggtttataaaaaagggacaacaatccatttagcagtcatgtaattcaattttaaattataggtttcttaaaacacatctgattctggataatgataggatctaggatatggaagtagtgatgagccttaaaatgaaaaaagactactaataaagtgttaaagtttgataattcaatgaggttacattgcagcaattaagcaggcatgttatataatgcctattgttgagaatgagttagccatgacctttgcccacttttaaaaaaatacaatgctaagcacagagcacatgctacaaagatgctaaagaaaattatgagattaatgattggtttttacacattaaccatgttgtaacagcctaagtgctactgacgctgttctgtcttagactcatcaaataattggaccaagtttgaggaaatcaatttctactaaatagttaaccataaggtatatttgtattagcaaacaaaatgctttcaaaatgttccacttttgaaactgtttgagtcttttatgttgactcaatgactttgtttacaaagggaaactgaagtggagttaagcaattatctggcaaatttgatcactgtacacaatcacagggaatacaacaaataatattttagaaaagttgtttgatgacatcacagcttcactccatagatctttagtagttttggggtttttattttttgaggaattgttggaattgcaataatgcatgtttgcttgcttccattttttcccctcccccccatatttgtatctctaaataatatgtacatggttaagaatttagtaattattaaccctatctattcttacaacactttaagaatttgtagacctatctaggtagtcagaatacattttgagtttcagttgaatgttttacattcatatggaaaactcaggggcaaaagtaattattttaaataatggcatactttgaaacagttgctcaaggccaagttattttctagcagatttattaagttactgccccgtaaacttaactgcctatttattggtctatattcataacagtgtctcttatttcctagtcacctcaaattaaaaggaatttgtaaggtacttatcttgaagccatattagtttgagcattaaatgtctttcaaatattttttaatctcatgaatccatgcccaaagaacagtaaggatgtgtatgtagcaatatatttttaaatattacctgaagattttccccagatacctccctttacctcatgtcctttcttccattttttcagttcttattcagtctcataaaaggaagaaaaataaggaatttgcttggcttttggatttcaactgtttcccttactggaaaatgaaaaacatgtgcataaacaatacagtaaatttaaatgattgcataaggatctctatatgcctgaaagtcatgcttgaaaaggcctccagtttgaacaagagacaacatagcagtgacattcatggcctgatgtccaaagaccagcatagaaaaaaaaaagccattacccttgccctgaatatgtgggctgaaattcattgtaactgtgtacaggagattagagacagaaggcaataagaaagcactggaagtgcttggtccagaatcatttaatagtgtatggattagaaaaggaggtggtagttagatgggattaagaaaccgtgtttgttgctaacaagaaccctaaattctgccacaatacagtgagaggagaccatggtttgatccctattaacagtaatagtggatactgctaagaaaaacccagctaattatgccgccgcctcctctgaatcactgctgtccctactggtttagttccttagcagaaacaaagtagtaatagacgaataaatctgccctgctgcagaagtgcattagagaacatgaaggtaattttattgggtgaaaacctggagaatggtttttttataaccttaaaaaatcttattgagtggcctgagtaattttgttacgatttactcagccctccatccttcctgtaggacttgtgaatgtccttgttaactatttaaagatgataatggtagctaacaattttgtcaagcattgagtattcatttaatcctaactccagtctgaggtaattgctgtgataattattcccattttacagataaggaaactgaggcagagagagatgtagcggaccaagttcacaaagctgataaaacagaggaaccaggatttaaatctaggtagtttggctctagcacaagttctcttaactgctgtattgcctttcagtccagcttatacattttgataactatgctaacaaaatccaaggaaatagcaacaaaatattaacattagttatcactgaacagaaaaatttggagttttagtattttgagtttatacctttcccaaatgttatagaataatcgcattcctgttacgatcagaaaaaaatactttaaaatgagcataatttttatgaaaactagggagagaattacataaaatattctcacaagaaagactgggagaaatacatgcaaaaaggtctgttgcagtgttacctgtgtagtgaaattttcagtcattttttcttctgtactttattttttggtatttgattttaaacctgtagttttttttttaatgctaaaaaatatacaatcatctttat

SEQ ID NO: 4800 - DNA, 5242 bp, Homo sapiens
ctggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattagacatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaagcctagagatattagcacaataattaaggcccaagtgagtataaaattttatctgaaattgaagagatattgattagataatccacagagactactttttagtgattatcttccaccagggtaaaagcaacagcagcctgaaaatgcaaaagaccatacattttaatggtaagtcctccccaggaaggattaataaatctcaggaggaagatttattatctgtaaatccaggaggaagaaatcaagatgaaaactatcatatttataaatttgattgttgcaattttatagtttgacatagtgcaattgctttagatttgaaggggaacttactttagagtaagtcactcaatctcttttttggaaaggcaaatgccacacctgatcctcatcactcccttctcctttgtccatagcctggctttattctgccattaacacacacacacacacacacacacacacacacacaaattgggaagaggatttctcattttacagaaagtatgctgggctacacaggatattctatcaggtttcttccagctataaaattctgagactaaatatcaaattaaagaaagtactaattgtcagcgatgggggatgtactgctatttgcttctagtggtactcactgctcatttcctatattcactggtataaaaaaatttcaaacaccctcaaaaaagcctatactggtggtaccaggaaaacgctgaaaatcattactttctgtgtggtgtccagctcttttggttacatcatcacttcgaccattcacttttaaagaaaaacttttgtggaacaaaaatataaagatttattttttttcttggtggcttagcacagtggcctaatgtggctgaccatgtgcacctgttgtgtgagtcacttagacgtgctttgtttcttggtcacagttgatccctcaactcaagcatctcaccctcaaaatgtttgtttgggacccaagaggcaaaccttgagatgggttatttctttcaccttggattggctcatctgctgggagtggagccaagctgacatttcctttcctttttgtctgcctatcactacgtagaggcagcacataagagagggaaagccatgcgcgtggagtccagcacatcacccagaaggcagatgttctatctccattttactcattaaaacaaacaaaaccacacctggattgcctggtacttaaataaaatgcactatgatgattgaagaaaaatatcttatatttaaggaatagttttaatagcttacatctgtatttctattagcttccgtttctatttttaatatttgtataatattaaaagtaattttaaaaatgaactaatctttttacatctcttatgagaatttaatggagatatgatgtttgaagatcaaagatacgtggtatttgaaatcagaaaatgtgtttgcttttctacacagattacaaatatcatgcattatttcacaaactcttctcaaagtgttgattttaaaattagtaaaaggagggtatattcatatcacatcctggcatttttataggcaagattgagcagctataacctctaaagtgctttgatccctataagcctcaagaagagaatggtgcaatttgaattaataactacccattatagagcatttgtatcacagtattttccaaatactatcttatttaaccctacagcaatcctatgatatggggattatgtacacattacagatgagaacttgaggctcggagaaagtaaataacttacacaagatcacaaagcaagtgactgccagagccaggatcagaacccagtcaggcttcattaggagctctgctgaactctgtctagagaattctcaccacctgctgcaaaggctaaaagaaagggtcatattccacatgtagattttgagaaatatttgttatttttcttatgataaaggttatgcatacacactcacacacacacacacacacacacaactagaaattacagaaaagaaaaaagattagccagaatgtcaccacctaaagacagataatattttggtgttttcaaatattcttttatctatacttttttgaattattttattttaaaaataacttttactggttgcctgattatgaagtaataaatattcaccataaatattttgaaaaatataaaactgtctataaaagaaatttgaaatgattgctaatctcaaaatatagatacctgtcagtactttggcattttatcctccttgtggctgaggtcacatatcttgagactgaagcacaaaatttctataccatacagtttatagtttaggccacaacatcatttttaaaattgtttctttggtttttacttgatttgctgatgttttattttttagaaaattgcagatgtgatttttaggcagctgattggaatgttctggttgctctgaataggactagctactttgttttttactgaaggacaaatattattcctacacacataaaaaacctcaaagaatgagtaatgatactgtttaaatctgcccttataactccaaagaatgacttcaaattttctttcttccaaagcaacttttaaaagcctttccactgcacagtgaaagaaaaccacaaactccttgtttaataagtgggatcacgtgcttttaacacgaggaaaaggtcaatctgaagcaactgatatggaactgccagagtaggagttgaaaatcttcctaaactgctggaggatacacctctgatagcttgagacaaatatcctcttgatcattgtttcaccatatttgtctttgctcatggagaaccattttgatccgtg

SEQ ID NO: 4801 - DNA, 37567 bp, Homo sapiens
aggacaataataccccacttttattcgctataatttgcaagaaagagaaaatggtggaatttttattgaaaaacaaagcaagtacacatgccgttgatagcctgagatggtacagtagttctttttaaatgaaacctgagtattctagagtggtaacagtcactcaagtcagaaatactaataagaagattaatgtaattattggcatgtagtgaaaaatgtcaccatgaataatcagatagatcagcaaatatttagactgagtaacataaagaacagtatatagtaggattcatcttctcctataatacagagtgtttgttatttataattggatgtttttggtactgtaatcttttattagctaaagggttttgtattagctttattaagttttttttgagatgcagtctggctctgttgccaggctggagtacagtggtgtgatcttggctcactgcaacctccacctctcaggctcaagcgattctcctgcctcagccttccaagtagctgggactacaggcgcgcaccgccatgcccagctaatttttgtatttttagtagagatgggatttcaccatgttggccaggatggtctcgatctcttgaccttgtgatctgctctccttggctcctcaaagtgctgggattacaggcatgagcccctgcacctggccagttttattaatttttaaagtgtggacttttagtttatgactactagtattatcatcatcatcattattgttgttgttgttttcagtctgcagatagctcttatctgacccctagctgatataaattacaatatatcagactaggaaagcaatggggaaatcttcatctaaatctttacctgctttagataagtgacctcagcacagtttcttggccatcaaaggactatgagttagcaacttgtattatgtcataccccagtgggacaggaggcttccttattgtccttttcttttagacttggtgacaatttataaagatgaacacctgagcaccctagatgcttatagacccaagctagtacatgcaaaatgttattatgtctacactgacaggtggatattaaattggtaaagtgtatcaaactagctgtttaaaaaagtctttattaaagttcttgagtggagtgatttccttgttattttagaacagcccttatgcttgctgtgcactatgactcaccgggtattgtcaacatccttcttaaacaaaatattaatgtctttactcaagacgtgtggacaagatgcagaagattacgctatttctcgctgtttgacaaagtaagtgtttatgttaaaaggccagttaatattgaattgaagtttaaaataattgcaactattccatcttatacattaggtgagagttcctagttttgttcagatggtttgaaatagcaatgagttagtctaccttttagccagaaatcaagcagaagtctagattagttagaagtagagtgcaagatgttttcaggatttttaagacctttatccctagggatctcaatgttgttcattttattctaagtataatccccatgcatgggataaaaagagccacattttttacttcttttcctttcttttctttttttttttttttccttgaaacaaggtctctgttgccctggctggtcttgaactcctgagctcaagtaatccacctgcctcggcctctcacagtgctagccaccgtgcctggcctgacttttctaattagttattgggtcttgaaatgtccaatttagcagaaaatcttgtattttcccgtggggctatctcctgtgtcttccttctttgaattttccaagaagctaaggggtttcctaagtccaaggaaggcaatctttctttacaagtcagaagaagggggaaaaaggccattctgatctttctgttgtttccatggtctcacttcctgtattgttgccattgtaaccagtcctgcaatctgataatgattgacctttgccaccaggatgccttcactcattcagacccctcagtttttgtggtgattcacacatagagttcaaagctacggtgtttattaatttatgtacttatgctcagtcgttgttcccagcaccctgatctggcagctaggcctcctagctttacccacacaaatgtcgagcaagttgatcctcaccctacagtaaaaaccttatttggagcccacatcttagctagacttagcctaggcattcatggtaagttatcctttgagacccgtgtttgtctgttctttaaccaatattagttgggattgctctcaacagtcagggatgttaaaatcatgttgcaggaagagattagggttccctttcccttttgctatcagatctgtaccttgaggcctttttacatcctgtggagcagcttttgttagatagcagaaggttccatgttatctttccaccgagtagtgggaaccaacttgcaattggcccctcaattaatgtgtctctatgataatgaaaatctcctgggctaatcacaactcttccaggagttttaaatgtattttaaaattctacctcacaggaagccattcaataaaattctctgaatctaaagtcagtgagttagatttaacagagctaagcctcatccataactcatgagtatccatttatcaaacagggctttgtacttgtttcagcagcacatattttaaaattggatcaatacagagcaggtaagcatggctgctgcctagggatggcacacaaattcagaaagcattccatattttgcatagtcccgggaaggtcatttgactatttgttgagtagctccaaggaagcagtgtgagtgaaaccaaaacagaagacacccaatattgaaattgtgattatcactataaaactattgatgtaaggtgatctctgaaatgagaacagagctgagtaataaggggatgttacttgttgctagtacatgtcttggaaatgacaaaatgtcaacttgcatttccttcatggaagtgaaaaacaataaaagcagggttttgtctcatctgttagttggagaggaccatggagatccagcgtcctagcacagatctgctggctcagagtttgaggaggtagagaaggagaggtagttgtccaagcccaggttttgacacctattagttttctgcctttggtgtgattgatgagctcagtgatgggagacaattaggtaatctattttaatcagattagttatgaattaggtaaaatgccctgaattacaagccacaaagaatacaacttaataaccaaaattagcacttaataacattttctgaaaactgcaacaattgaatattagaacttatagaaaaacacacaccaagcaataaagttcaagaataaatcattccattgctttactatttcctgaacatttaaacatgtaatcttattacatcttcctaacaacctactgaagtaaggtagcaaaatccttattttttagaagaaaccagggagcctaagagaagcaacttgtctgaaaacaaaatatctattacagagtgaggatttattctgagtgcaggacatgttacatgatgtccagctaactagagttcatttactgagctatgcttcctccatttatgagtacttcactttttttcttctttaattataagcttaataagcttgtaaggtttaaaaatttgaagtatatgggatattaaaattctgatattaggtctgatattgcctgaaatggttttagaatttaatatgtttggtaaatattttttatttcagtattaaaatagcaattttatttattacttttgtatacgtagaattcaacaacaaattttggaacataaaaagatgatacttaaaaatgacaaaccaggtaagacttctgatagtgaatttcttatttctcttggtgttcctactcttgattagaaagtaaaaagtaagatgtaagattaaggtagtgttaataaaaaaagaccagtttaaaaatatatgtaaattaaatgtgcatatatgtatatacatatgtaaattaatttttaaaatttaacttctttagtttgaaattcagatttatttaagaaggtagttgtagctaacttataatctcaaacatgattgtctgaaaaaattcctttatttaattatgatccctaaaatcctatgtaatatttttgcgtaaataagaaaaaagacttttaagttagtatgttgtatgtttcctctatagtcacattataacaaattggacttgttatacaaatggatcttctatttcatttttataataaattgtttatatttagtaaacaaataattacagttgacccatgaataatgtgggggtgaggtattctgatccctgtgcagttgaaaatctgagtataacttttgattccttcaccttagctactaatagcccaccattgactgggagccttcctgataacataaacagttggtggacacctattttgtttgtgctgcattattatatactgtgttcttgcaataaagtaagctagagaaatgaagcggttagaaagaaaatcatcaggaatgatatattgacttttcataaagcattaagtagatcctgacaaaggtcttcaagatcttcaggttgattaggctgaggaggaagaggagaggtggatcttgctgtctctgggttgcagaggcagaagaacatctgcatataagtgagtcgctgcagttgaaacccttgctgttgaagggtgaactgtattacatattgatttgtgtcactaagaaagtaactatctttagaaccaggaactcagcaattcctttctggtaccataaataaatggcaataagaactgtaaaactgaaccagcatgcacccatacaaataagagattattttttgaggatagctactgagcacagaagacagaaaagcaattccttcatgagaagcacaagttatattacatattcttacacaagcaaaatggttttatctgtcatagtttatacacatacacatacacacatgcacatatacacatacatatgtgcgcacgcatgtgcacacagacaccaagttaaaagtcctgctgattcttaatgaccaaatccaactgttcgcggggagtggtggataacacattctacagtttggatgcaattcttttgactttttgacttgttctgtaatgaactgcctttaatgggtgaatcatgtttttagttttataagaaacaaagaaaaagattagaagcaagtaaacagaaactctatgatcagtagtagactattatagtatattcaatagtcatatgtttttctccagttatacaatttacttgaatgatgcacaattaatcaattattattattataggagatggggtctctctatgttgcctaggctagaataaagtgtctattcattggtgcaaacatagctcactgtagccttgaactcctgggctcaagcagtcctcctacctcatcttcctgagtagctgggactacagttttgtatggttatatctggcctgatacacaattgtttatttatttatttttgatacagtgtttccctctgttgctctgcactggagtgcagtggtgccatcttggctcactgcaacttctgcttcctggccttaaatgatcctttcacctttcaccttagcctcccaagtagctgggaccccaggcatgcaccaccacacttggctaattttctttttaaggttttttttgttttttgtttttttttgtttaatagatgaggtctcactatattgccaggctggtctggaacttctgggttcaagtgatcctcctgcctcagcctcccaaaatgctgggatttacaagtgtgagccactgcacctgacctgcacaattattataaaaaggaattaagcccagttgagttgcagaaaattgaccaccttttcattattttttctagaaacattcatattgtacaacatattgtcaatcacccagattctctgttttttattcagttaaaataggattgctgcttattccacattattttctgatattattgtgtcatttattccttttatggctttattcctgtggatagatatagaaatacaagaatctccaagtcaaatatcaagggaaaaaaagaaaagaaaaacagtttagggaaaattattctgtgaaatagccatctgattacagttacatatatcatatcaacttaatacaaatcttacacaatgtatttgtgtcaaggtttcccaagaccaccccaggtttgatggttcactagaaggactcacaggactcagcaaatagtcatactcagatctttaattgattacaagaaaggggacaagcaaaattagtagaggaaaaaggtgcttgtggtcaattctggaggaaaccaggctcaagcctccaggagttctctcctgtggagtgcccgggatctgcttaattctcccaggcccacattttgacaacatatgtgcagtgatgtctaccagtaccagagtctcattagagacgaagtatccaagtttttctgtggaaattactctgccttacatgtacccaaattccagactcgtacaaggaaagcagatgttcagagtaaccacactgtttctataaacactttagacacagtgagccactcttctcagggaatggtggaaaccctcccaattccaatttccttaacaccagccaagggccagccttgcatgcaggcctttctaaggatggcagtctcttgcctgctatatgaaatcttttctgcacaacgcttatagccccaatttaatttttgggtttgttttaaaatttcattttaataagacataatattataagataaggtaacttggtactaatttctgttgtatgatccatcttaagttgcaatgctggttactttttgacttttggtgactaacaggtatttgtatataagttaccatagcaatgttaggtaattataatctgtcctttttatctcattaagctttcagtagaattgttaaattaaataagcataataatttttgagttaaaattagaataaaaattgtattttattttgattacatgaataatctagttttcatattgtgctaaatccctgtttagaattatgaaataagatattcaatcatttttaacaatattttcttacctaagcatgcaattaaatttatttattttatatatttcatatacttcaatttgagaaatataatgaccacatgctgtcactttggtcttcaatgatctccaatttctagggtcactgtctcttgcttaaatatatcatcataacaggttcagtgaatatctttattttttatttatttattaatttttttgcgacagagttttgctctgttgcccaggctgcagtgcaatgacagaatcttggctcactgacacctccacctcccgggttcaagcaattctcctgcctcagcctcccaagtacctgggactacaggcatgcaccaccatgcccggctaatcttttgtatttagtagagacggggtttcatcatgttagtcaggctggtctggaactcctgacctcaggtgatccacccaccttggcctcccaaagtgctaggattacaggcatgagccactgcgcccggccatattttttttattattttaattattctggagatcctgggatgcataaacagtgaatatctttttttttttttttctttgagatggagtttcactgtctcccaggctggagtgcagtggtgcgattttggttaaccacaatctccgccttctaggctcaagtgattctcctgcctcagcctcccaagtagctgaaattacaggtgcctgccaccttgcccagctaatttttgtatttagtagaggtgaggttttgccatgttggccaggctggtcttgaactgctgacctcaggtgatccacccgcctatgcctcccaaagtgctgaggttacagtcatgagccactgagccctgctgtgaatatcttttttaaatcaataactttatttcttagagcagttttaggttcacagcaaaattgagaggaaggtacagagatttcttgtatattccatgcctccaacacatgcatagcctcccccattattagtattttccaccagagtgtggtacatttgttacaactgatgaacttacattgacacattataatcactcaaagttcatagtttacatcaggcttcactcttgatgctgtacattctgtgaatttggacaaatgtataatgacatgacatgtatctattactgttatattattgacagaacagtttcactgccctaaaaattctctatgctatgcctgttcatctctccctttctccctagcaacttgtggcagccattgatctttactctgtcttcatagttttacttttttcagaagagtcatatagttggaataatactgtggatatctttttgaatagttaaaaaaatcaaagctccatggcaattgaaggtagtcatttaagatgttctttgtccttttgtttttcttttgcttttttatcattgtaaagaatgatatatgctgatgaggtatgctttacatacttagaaaacatgatttgtatagatatttggcacataatggaaagggttgaggaaaaggacaccacgccgtaccacacagcacaacctggagcatcttgctctgtgaggtgggtccagatacactgtctagcaatggaagggggcaagcgcaaggggttgtactttataaaactggaatcacaaagtctttcatacttaccttcggttggaaataagaccaggcagtgaatgctataggtaaatacatatgttcctcactgatcctcttcctttgagggatgaggttgacaacagcctgtgttatgatgacatgactcacctacaactagattctgttatgagggatggcaagggagttttgctttatgtgaggtgaaaaagaatttttttctcctactagggagaacagcaagcattggcacattctggtagtaaaagggcattgatagttttctttctatatatttttcacatcagataatactgcccagcagcctgccacacctccccagtgtttcttaagcttctctctgaatgtggataagctcttaaaggagtgatctttccagtggttctttctgtgggaggtaaaatggcaggtgaacatgggccttgttatatgtagggcagagcaaatagctacaactaaggaaaccacccagcaccttccccagaagagtattagccagagtaacacagtggtctctctcgagctcttctccactggcagctgcaaagtttttgcaaggattcctgtttctggtctgattactatgttttgctggcttctggtgatagggtgttttatcctaaactgaacagtttgaactgaagagctagagaggctgtgttgtgttataacaaaataagtgcagtagttcccccttaattgtgggagatacattccaagacccccagtggatgcaagaaaccatgaatagtactgaatcacaaactgttttttctatacatacatatctatgataaagtttaatttataaattaaatctgatgtaatctgaagatagggtgtgagaattgaatcgtgccatcagcaggaatgattgcttgctttttggtggggaaaaactctccacacatttggtcacagaagccttctttgttgatgattgttgctgtggcgtgagagcagagaaaaacatgtcaagtatgtctttccgcacatacagtggataaggggtactactgtatcctctaactgctcctcatattttggtccagaaatcatgctctttgacactgttgactcatcacacctgttctgctaacaataccatttttactcaatctcatagggtttggctaggatgacttgtatactgcagttcacttgtagataccaaattttaataaatttattcttctttacatctaataaatacaaagggaagagttcttactgcattaattacctaccaataggtacaattaatgttaattctaataaggtcccaggcatgctcccaaaggaattctttgtaacaaagcatcagtcttatgcttttaaaaaacaaaccaaaacaaaaccaccaccaccaacaacaacaaaaacaggatctaaagcatacacacaagtgtgcacaactttttttatgaaggtagtgtcttactatgtttcccaagctgttctcaaacttctagattcctcaagtgatcctcctgcctcatcctcccgagtagtttggattgcaggcatgcatcactgtgcattcttatgcttttaatattctgtacatttattattgatttaaaatgcattctacctttttctttaatagatgttggaagttctgatgaatctgcagtcaggtaggattttatagatttaaagaattatgttaactaagaaaacatagatggaagaaactagtatctgttgagtgttatattctgggctagacatcctaatatgttctatgcatttatcatctcataaagccatcacaacatctgtgttcctataacctactgtttattaaataaacaactatggattagagcagttgattaattgccttataatctcatagttaacaaagtagctggcctacagttggaccgtcagcctgcctggcttccaaatcccttctcttgctcctcagcatagattgatagacatccatgcagcacttggatcaaggtataggtctgaatcagattaatcagattcattaatttaattaatgtctaaattaatgagagtttaaataccttaaataccttaaactctcatttaaggttattgttagaatgtggttagtggaagagattgtccagataaatttgacaatttcagtggtaaccagtatcttatttttaccatcaaaggctttagggcaaatcttacttagctttggccataggactgtaagttttacaaaagcaagtttaggcaagtcttagagagaaatcatttgacttcccagtttggttttccatttaggcaagtatttctgctacttccataatacttttgttagtcttgtttctttttccatgacttttctataatcttgtcttgattttttagaactttcttctctgcttttcttgctgtttcttttgttctattattttttaaaattctgctgggtatgtattcccagttttcctatagacagaatcaagaggacatagaattacagaattttaaggaatcttagaattaattaaaatactttctagtatttttacctgtattgaacattctggtcaagtgattctcagagaatgtgaggctcaaagagattaggatgctttttttttagacataggaattggcagaaatgagatttgaactcattttgaggcccagtactcttccttctttttatatcctatttgcatgtgctttaataatacaaatgggagtgagtctggtgcacccagtggatagtatgagaatggaattagctggtgaacccaatggaagtagataaaaatggaatgagcaggggaaggccaagtttgaagagaaacaacactggattggataggagtatggactcttcaataagagatcaaaatattggggtttatgagaagtttgataaagagttcaagggagctctaaaaagttcgctccttttgtttaaatcaaggactgacaaacttgaagaattttactgaaagatgctaaaacattttgagacactgggaggagtgtctacagcagatagaaatgtagtgtcatctacttccgtcctgactttcagaggggtggcttagagcccctggagtacgaaggggctggagattgctggactacatagatgtgtggcccaggacaggtggcctcttcacctctgcctctgttcccgattcactgatgtccttcccatgtccatgtaggctgggtcaggggcatgattggctggcaaatcagtcatggagttcagttgggtagttggtagtgtgtctatgctgggtgcaggtgatggagactccagttagcttgtttttcaggagcagggatatagagggctcctactcctggtcatttgaggccatcctttcaggaatctgtgctttcataggctgaagatttgaagattggagacttctgtggagccctgcagaagtggaatctggaagtgggagcccataggaagacagatacttagatagtacttagggaaatagaggtacaactaccaggactctgtttttctggcagtctctctccttgggtgtctgagtgcctatgaaaatttttaagggcttgctagtttatgtggacctgaataaagtaggacctatagagtgaaaataatgggattttataattgctaatattttaatctttctgggaaaagtattctcaataagaacatacacttttgttatttgatttttgtacatgtagctttcatacctttcaaatattgcatgggatttcctgtaccgatttagggcaaaggaaagcaataggacattcctaagtgggttccatgttgaggaatcaagactgccaatttgaagtgatgcagattagtcttttaaccagagatagattatggaaaagagacagtggatctttctaccttgttttaggtcatcagttttcttccagtttaggtaacaaaatttatgtcatccattaattgagttttaagttcagcttcaggacagataatttgtgagggcaaattattgtcaggctctgccaatatattgactgtcactatttgttatgaagctgaaggttagttttcattgaacattttatagatttagacaggtggaggcagaaataggtaactaaaatctatttttagaacagaggacctattttaattatatcaagaatcataatttaatatatagatcactgacctttccccagattattctttccttttttgagggggaagctggatataaactggcagttaaaaaattgtaaagaaatcaacttgctcattttcattgtgtatttttgctcccaagcattttccatgaactgtgtgtggattcattgcctgcattagatgacgaagtcttgagtgttgctgctaaggtaaattggtctcttgtaaaattaattttctcactctgaatgtagttttgcagagtatttacttttcaaacttagcagtggtttatctgtcattgttttatggtggtaacggaaagtgggtcagagaaaaacatatatatggctagttgattgaaaaaatttgtttaactttggtaactaacaaagattgataagtaccgtgacagggtaggagctgaaaaaaaatgaactggaaaataagtagtgacaggaaaatcacattaggaaatgctttctccaatagaggaaatatgaaatttgattaagctttatttggataaatactaatactttgagttttaaatcctgtgagtgtgactttcataatatttatgcctgtataactcttcagtggatcaaattatttgcagtaatcatggaatcctcctggtaacttttagttgcaaaaaggttcagcacatagcatatagcttttcttcttggaaacttattattttggtatcatatagtttttaggagagattgtttctctacttatattattggttctatagtgagactaaaataatattaaaaattgtagaaaaatagctgagtgtggtggtgtacacctgtagtccctgctacttgggagtttgatgcaggaagattgcttgagcccaggagtttgagaacagcctgggcaacataacaagactgtatctgatttaaaaatataaattgtggaaacatagaaatttaaatttatgttctcaaaatttgtattgcgaagggatttttgtgtgttttatgagttgtccatgaagagtttatataaaacacttcatctaattgaataacatgtattttgctgcaaataaccagttctagaagcagagactcttaataccaatatggtaagactttatcatcataattttgtcattgtagtttatttaaaatatttagttggccagacgtggtggctcacacctgtaatcccagcacttttggaggccgaggtgggtagatcacctgaggtcaggagttcaagatcagcctggccaacatggtgaaaccctgtctttaaaaaaaaaaaaaaaaaaagcacaaaaattaaccaggcgtgatggtgcatgcctgtaatcccagctgctcaggaggccacggtgggagaatcgcttgaacctgggaggcggaggttgcagtgagccaagatcgcaccattgcactccagcctgggtgacagagcaagactacatcttaaaaaataaaataaccactcaaagtccttatatcctattctgaaattttgaatgtcagaaggttttctatttagttgtttaaataatcattggaagctcctgcatactataggctactggaggtcagtaaacatatttgtgtgtatcctggagtacctagaatatagtcttccatgtaagaagcattttacttgttgttttttgagatggggtttcactctgtcacccaggctggagggcactggtgagatcttggctcactccaatctccatttcctgggctcaggagatcctcacacttcagccatccaagtagttgaaacagtagagctatgtcaccatagacctgtgtcaccatgctcggccgagttttgtagagacagggttttgccttgttgcccaggctggtctttaactgttgggctcaagtgttctgcccgcctcagcctctcaaagtgctggggttacaggcatgagacattcagccttaatagttgtttaatctgaataaatagacaaatgaatttttatataatggaatgttataagtaatataatatacctaatgtatctaacaattaaatattgtatttaaaatattgcttacatttgtattattttttaatatttaagggagtataagttttgatgtgttatgttgagaaattatgccataattaaaaaggaaataaattagaaataggtcatcagtagcaaagagggttacaatatattttctagtatcattgaactggaatcttaacattgagattttagattaacatttcttaagctttttattagtcccaactcaggttctattaaatataccttttcaagccatacattaccctttattattattattatattttaagttctcgggtacatgtgcacaacgtgcaggtttgttacatatgtatacatgtgccatgttggtgtgctgcacccattaactcgtcatttacattagacatatctcctaatgctatcccttccccctccccccaccccacaacaggccctggtgtgtgatgttccccttcctgtgtctaagtgttctcattgttcatttcccacctatgagtgagaacacgtggtgtttggttttctgtccttgtgacagtttgctcagaatgatggtttccagcttcatccatgtccctacaaaggacatgaactcatccttttttatggctgcatagtattccacgatgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccaataatgggatgactgggtcaaatggcatttctagttctagatccttgaggaatcaccacactgtcttccacaatggttgaactagtttacagtcctaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgccatacattactctagaattctggtgaccaattctttttctgggtggaacgttgatggaaagttccagttttctctctctgttataataatgttctttcaggtagtggtagatgaccatatttagctaattgaatgtcttatagtaataaactctatcacagaagtacttacaaaaaactaattgtagcataaatattaattagtattatcagggatatgaaagaccaaaaggctctgttatagatctatttccccatgtactttattgtacttcatgttgtttcttttctttcttggcttaagctcatatttcattgaccaattaggcttcttttttgtttgtatctctcttcattcttacattttaaattgatatttttggggagtcagggtcttgctctgttgcccaggctgcagtgtagtggcatgatcttggcaccctacagtctccacctctcaggctcaagtgatcctcccacatcagcttcccaagcagctgggactacaggcacacaccatcatgcctgactccttttggtattttttgtgtagagatgtgttctcattatgttgcccaggcaggtctcaaactcctgaactcaagcaatccacccaccttggccttgcaaagggctgagattacaggtgtgagccaccatgcctgggcaacattgagactgatttaaagaaattgattagggctgggtgtggtggtgcacactgcttatctcaacactttgggaggcagaagtcgaagatttactcgagcctaggagtttgagaccagcctgggcagtataatgaggccttatttctacaaagataacaatagaaacattagcatggcatgatggtatgcacctgtagttccagctattcaggaagttgaggtgggaagattgcttgaggtcaggagtttgagaccacagtgagccataatcaggcccctgcattctagcccttggttgacagagtgagacccagtttcataaaaagagattgataagaagctcttgatgcaactcataattttaaaatggaaactaattcttgatattaccttagcagtgtgtccccgagaaagtgtcagagcctttatgtggaccttcccatggaaaaggaaaacagaatagtcaatggaaaaggagaaggtgagaactgtattttatttaaaaagtcatttgttggaggctgggtgcagtggctcacacctgtaatcccagcactttgggaggccgaggtgggcggatcacaaggtcaggagatcgggataatcctggctaacatggtgaaaccccatctctactaaaaatacaaaaaattagccaggtgtggtggcgggcccctgtagtcccagctacttgggaggctgaggcaggaggatggtgtgaacctgggaggcggagcttgcagtaaacggagatcactccactgcactccagcctggatgtcagagtgagactctgtctcaaaaaaaaaaaaaaaaagtcatttgatggaatgtttctttgaaaatatgagcactaatagagtctaatagctaaagaaaatgtcctattaactgtataataagtaaaggagaagtgaaatggtgataagttgtgtctctaaccaagggtcagcagttgattctattgggagtaccactaaaggagctgagttgtgggttccattttaagatactctaagacctgaggcaagtcaggagagagggaagaggaaatgaataaaagagaaagaaagatgaggagggcagagtatacatggaataaataaaaacacatatgcggatgtatgtaatagagggtagtaaagtctaattgatctgtagaagaaggaagaacagggtgttaggaataggaaggaagataaagtgagcttcccgtaccaacatatgtcagagaattagagtaacattttcctactcttgctgtcatcctcactactggggaggcattaaggattgaggtattttaccacacagacctgtgttttatctaccatagatgaacatcaccataaatggtcagccatgtatggctataatttggttttaaagaaaatgttgtaacctcataggatagtatcatataggccaaattaacataattgaaaataatagtgttgggtgatgtatggagaagaaattaattagagaaggtattacctgattaaaagttcattagaaacattatggcttataatgtagtattaaattcagagacataatagggaagaaattgagtctaggccaaaaagggcaattagggtaaactaatatggaagcacataaagtgtaaaacagggcattcagatagtcatgaattagttgaggaacttctggaaactgcacattctgatttagcaggtataggagtctgcatttctcatgagtactcaggtgatgttgttgctggtccttggacacagctctgaatagcaagggaatagccttcctttagagaaatctggaaaaagaaccactggagagcaatttgaataatagcagaatccagggaaagcattaatttccttttatttctgagcacgattctagccacaggggaaggaaaatgagatgaaaaaagagagattacaggtgtatactactgctgaatacagatgaaaaaagtggtcacaattatccataaaaagcagttaggaagggaagcatcaggatgacagatctaaaaatcactttttcaaaggaagagggattgtgaaaggacacagagggaggaaagaaagacatttgctggggtcttgggagttaaagccaagtaaacttgagacaactcacttccagttgcttcagcatatgcccagtctcacaaaagaggttattgctgtggagagtactggaggcaggagggagtgctagaattggggtaaaccacagcagctcatttcacttcataattgtcaggcctcagagagagaagtttcattgacatgagtgaataagatgtgattaagttgcatatagatgctttggctaattttttttgagacagccagttctttgatatgatagctgctttataaaagtcctttacagtgtaagatgatataccaaacttagttaattttagaagcaattgtattataaaattcattctgtgaataccaaaatactcattttcaataagtactgcactgattttgaaatataaatgtgtattcgtatccagcaagtctgtggtaattcagtgttttcttttttgataaatattttgatattggaagcttattcgacatggtttatttgatgtgttttatggaccacctcgcacaagtggatcaaggagctctaactcaaggccaaatgaggggataggagaaatgtaggtgctgcagtagcccatgtgatcatgggaaaaatgagtattttgattagctgttatttcataagtgtgcgtcctagctgatcaatgtagaacactttctttgatgagaggtgaatcacacattcacctgaactgtcatcccaactgtgtatttcctcagcgacaggacaaggggaatttatctgtggtgtgctggcagcaatgcctctgatgtgttgagttaaaatactctgtacattcaccatcagctttgacatcgattccctcaggtttgatttgctcctctgtttagtggtcccttttctcctcatcagcccacgtgttcacagtgatatccatgcttttctattttaggtatagacatttgaaacataatctcactactgaaatgtaagctgtgcattttaggaatcctgtattcctattttcctcattaggtttctgtcatgttgctgtcctaggcaatgaaaagaagaagccaagaagaaccctcaaaaccttaagtaattattttcatagccaggcatgagaattcagctcgatagtaacactgcatgaatggttggccctgtcatacttacatataattgatgacatatcccttttgctttgtagggcctcctgcaaaacatccttccttgaaggtaattaattatgtatattttttgaatcactaactccacattgtataaaatatatatgatttatgaatcattttcttttaaaacccattcagcctagcactgaaatggaagatcctgctgtgaaaggagcagtacaaagaaagaatgtacagacattgagagcaggtacatattcaatacaaatggaatgccggaaataagtacattcaatgattggaagtactcacattattcttacccctaattctgtttgttcaaaactgaatggaaggcattgacgtaaatgttattgttggtatccatatttgaataacaataaatttagaagcataaaaaagattttaaaaatgtaagctttaactcagatgtttctcttttaatgttttgaatagcatgaagttttcagtataaaatttttatacttgtcagggattaaaagcactgaattttgagactctaagatatttccattgatttatgtgctagttggcgctctgatctttacgtagaggaaagcttttcttattaacgtgtcagtttctgttttaactttagaggcttgctgctagtgttattacactgatgatctgaagccaatcagatgttctagtgagcaagactgtgtgtggatgtggatgtataggtgtgtgtatgtgtgtgtttgtggcatctttgactactaaaaatgaggaaagtaattattcatttataactggtagacacagtcttttaaaacggtgattttgagcctttttggtgttaaggtttttaaaacgtgattgcatagcggctaccaacatcataagttggttgtttttcatttcaatgcccttttgaaatctttaactatattgtgatgctcagaaataatatgcagaattttttatttgtgtcccaaaatggtatgtgagtggttatacactttacatacctttctgccactttctttggtgtattttgtattatgttttccagatgtatccacattgatatgattatctctggtttaattcattttatacttttcattgtattcccttataccactttaccacatttagttagactctcctgttgctgataaatgaagaaagaaagaaaaataaaaataatgtcagattaagagggcttttctttagtcagtttgtataaattaatatttactacatgagagtttaaagttgaaaagttcagaatacaagcatgcaccaccatattttataaatgtccttagaactgtgactcatgagcctttagcctatgaagttaggacaattcatttctctgaagaagtttgctgtgctattctcagaaaagaaaactgaaaatagcaaatgatattgtcttatttgacctcttggacatccttgaatgaaactgaaactctagggatactcggatcaaaattcagaactaatgttttgaacaatatagtttgtgaatgtccagtgatcatgagcccttgatggggaaatgacctttcaagtttcacttttgcattttttgctcttttccttgacttgtcttaaaagcttaaattcaaccgttttatttttacagaaaccaggaatataacttttaaaatatatgtctgtcctgtctcacggtggtgtgtactcttcagatcttttgtgaacatagacttatatgggaacaattatgttttttgtttgttcgtttgtgtttttgagacagagtcttgctctgtcaccaaggctggagtgcagtggctcagtcttggctcattaccacctctgcctctcaggttcaagcaattctcctgcctcagccccttgaatagccgatactacttgcacgtgctaccataccctgctaatttttctatttttagtagagatggggtttcaccatgttggccaggctgctctcaaactcctgacctcaggtgatctgcccacctcggcttgccaatgtgctgggattacaggcgggagccactgtgccagctacaaataagatttttaaggctattatattttatacaattctttggtttatgtgaattctgaaggctttcatgcattgagggaagattatatcagtttaatgaaagcagtttttaatttaatgtatattcattaaaattttttttgaagtttttgtctctagtacatagaaatacacaataatgtcatgggtatttgacctttatgtgtttatgcacaaacttagttattcaaatattttcttatccctaaagaatcttaattactaataaacaaatttctcattgaaaacaacatatataatagagatcgttgagtgattgaaagtaaattgtagtaaataacagaagcttagaacaagttaagtaaacttgtctgagttaatagcaattacaggacttttaaaatatgttagaccatgagggagtggtgtgtttgtggggtagaagacaacatggtactgcttcagtgaagaaagaacttttacaacttattacaatttgtattactatttacattctaataaataaaaactttattttcagatattttagattatgtttctactagttgaaccatcaatagtaagacttttcaaagatttgggaagttgtgagttgacgataaatatctgtatcgccatccgtgatcaaaaatcagacagcaactacagactttggacacgcgaacttcatagttaaagaaaggattaattttggagctgtgtttctatcagggaattatactcttcattgcctgcatgaatcgcagttattagagtagaaagagagcaaagaagggaaagaagcatagaaaattttattctagattacctcggttggcttcatgctaccatagttctgacttttaaaaagtcattttgtgatcaaaggtactttgtgtttactccccttatgcaggctacaaccaaacagaatggttcttagcaaggcatttgtattcttcccttaaggaaagcaacatataaataaagagaatgaggagaaagagtgatttcattgaggttgttatttaacataaatttgagtgtgggtaccatgattatatttagaattttgggactggatgggaaaaccagctagacatctacagattccctactcaaacacaatgtgcctttgttttatttttatatctctaattttgcaattattcagtacaactgtatgcagtgtcactaaaaataccttcccaaaccaaatattaaataatgcctatggctttctgttttatagtgttgattttcccaatattaatgggaaccattgagcatttgccttgtggtgtctcctcagctgtattcacacattccatcaccttgtcttaatggataatcatacactaggagtacggttttcagaagagctgtgtcatttaaagataacacaggagcatcaaatttaattctgctagaacacctggtctactgattaactgcagctaatgtggggtctacttcacatacaagttaaattcagtgcccttaatcagtcatatgatcaggtcaacagtaataaattatgcaatattttcccccacccctatagttttaatttctttttccccttatgtctagaattaacattttgttttataaaacatgatgataatcttctagagtagtgatgacaagctataaatccaaagtttgttacttatgcagatgacttgtttgcttctattttctcatgagcttggtagatccaggaaacagaacttttaaaacaaaatccccatatgtggctgggcgcggtggctcgtgcctgtaatcccagcactttgggaggctgaggcgggtggataacctgagattgggagtttgagaccagcctgaccaacatggaaaaacacatctctactaaaaacacaaaattagctgttcatggtggcaaatacctgtaattccagctacttgggaggctgaggcaaggagaatcgcttgaacctgggaagcaaaggttgtggtgagctgagatcataccactgtacttcagcctgggcaggaagagtgaaactccatctcaaaaaacaacaacaatgacaacaacaacaaccaacacaaaacccaaatgcatttccttggcacagtaaaactgaaacagaaaaagtgtaaagtaaatacaagtaactgaaacagtttatgtatattatcttacttctcatttgataaaatttgtaaagtaatgagcagagggtatttctccagggacctggatatatacatttattcattcaataaaaattcattcttataatggccactgatacttgtatcctaatcatttctgaaaacatctcctcaggcctgcatcatctttgcaacattgccatattttatctttgttcatttatttatatgcctcagaattttatgctcctcacagtatttagagttaattatctctaatgtaaatagatccatgaaccactcctgaatacctaatgtccaagcatcttaaagctttatataaggatttcagaaactgacttctgggttgggcacggtggctcatgtctgtgatcccagcactttgggaggctgaggcaggtggatcatttgaggtcaggagttcaagaccagcctggccaacaaggtgaaaccccatctctaataaaacacaaaaaatagcaggtggtggtggcatgcacctgtaatctcagctactccggaggctgaggcagaagaattacttgaacccaggagaccgggttgcagtgagccaagatcatgctactgtgctccagtctgggagacagagtaagaccttgtcccaaaaaaagaaaagaaaaggaaactgatttctgcccaaatctctatccgtagccctttccccatctgcctttttctctggaattactcagctgctggtaatggccccctcaccattcctcttttgcagagaaatacatactctcttggaggcttctctccctctcttgttgctgcctggcatgtgctaaccctttcctgccctctgcctcacttaatctggcgaacctcactctctaattctcagctcatgcatgatctttaggaaagccatccctgacagcttttatgttccttccttataccccagtgcctaacacttagcaggaactcaataagtaattatttagcaaaattaagactgtttatacaaagatgattcaaaagattgtcctctacagtctagcagcaaaggggattgacatgtaaagacatgatgtgcagttcaggtggtaaagtgacactagaaaaattgacaaagtactaagggaccgcaatgaaacagacacctgtgtgtgtggagaaagatagctagaatcaaggaagacttcacacagcattctgagcctttttttttctctttttctgttgttggagacaagttcttactctatcacccagggtggagtgcaatggcgtgattgaaactcactgcaacctcaaactcctgggctcgagggatcttctcacctgaacttcttgagtggctgggactacaggcacatatcaccatacctgcctaattttttgtagagtcaaggttatctatggtttccaggctggtcttacagtcttggcctcgagtaattctcctattttggccttccaaagtgctgggattacagatgtgagctattatgtccagcctactttctgagtcttaaaagatgaaaataaatttttcagaatagcagggggaaaacatttgcgatgtaaaaaatggtgtgcacactaattaagatataaacaataattttgcaaattagtaactgccaactcaattagtgtcttgttaaaaagatactgttatgtacattgtatattttgactgtatttcaaaattttgttttgtttccaacagttttgttgatttatgttgggtggaacaatttgtgagtgaccctgagattttgtatggcttgaacctggtgatatctagtgtctccccaaatggtttgttgaagttttggataattagaagtatttcttaaagaagtaaatatttcagtaaacattaagcttcatttaaaccctcaaaatataaaatacgaagaaatgttattttctatttatttttataaagattatagtctttatctaactgttcttagttcatttgaactaaaccaatgaatttgtcaacagaacaagccttaccagtggcttcagaggaagagcaacaaagacgtgaaagaagtgaaaagaagcaaccacaggtatatgaaaatttaagtttcttgtttaatattaggtttttttttgctttagtaacaaagcatagtccaaatgacatgaccttttagactatacctttagaatccaatagatcataattttatatttaatttttaaaacattttaaccagttatgaaacttaagatattcttactatctctagtaacttattcattattctagtaattcttactatctctagtaactcatagctgtctttacccttggaattgaggcaagaatttttcacaattatcttgctcttttatttgtataaccttactcataatacagaaggtaacatgaaatattgggtcatattactaaggaatagaaattatgaacaatttaataacgatggccgctgagttaaactagtgttaaaagagtcatcattgccaatggttcaaatgttgcagttttatattgctggtcatcagtgccgaggttaaagatttattctgttttgtggtcaccagttgacttctgtgtctgtgttcagggagtgaatggggtcataaaaaccaacccagttgccttttaagagaatcctaccttgcagaatgggacctttggtatcagggtacaaacaataactttatttcaacataaatacatagtaaatattactaaaattaaaaaaatccaaacactatcactactggaacttaaaatatattagaagtggatatcatagtatatcatttgaattagaatttaaaattttgcttctctttcttattggtgttcagtttggctcttaataatttagtgtttgcctagtctctagttaatcttcagaaatatacatgcactgtaggggctcactctttctggtatgctgaggtaaagtctttgtaagagaggaagcttttataatactacctatcatctttgaattcatttctggtagactttacacataatgcattaagtttagtccaaacaaacactgagagttcagcttgccggtttatgtttctgtcctatgttaagccaaggcaaattatttttcactttttagttacaatcccataattgaagagtggcaacacgcagattaagtttcacagttaaattttaattattttctaatatttgtttatacttgattaaagctaattttagaacatgcactctgacagaaaagacatctgagaaacaaaacaagcaaatttgttttccattttgcacctgccaaaaaaaaaaaaaaaaaaaaaaagcctcaagaaccagaactgggtaagaattgtgataaagggaatctatctgtatattcacgactttctttaaaattcattacaaacaagttcaagctgaatattggtaaaggttttggaaactccaaaattactgcttgccctgaggaagagcttctacatagtaactctaaagagggatgaacgaaaaaggagtgccctctgatctgatgaatcaggtccctgattgtgaggagaaaaatgcatctggagggtctaactctgtggcattccaagcagcacctgaatagaggaatcccatgtcaaatgtctttttattccattcacactccaggtccctgaaatacacttaccagtcatcttctaagcttcatttaaatgaaaataaatcagactatgaaaatgataacaaaccagacacatagcttgtttctaacacagatgatgaaaatttttgtaatgatacagaaactgaaacattaaggaacccagtaattatgattgaaatgaaagatgattaagagtttcacatgcaaatggcaaaaaatacaaacccaaataccactaattggaaattagacattaggcattggcctcagtctagagatccagaaagtctttttgatttgtggtttacccaccccaaagaaatgaagcatatgattcagatagaaagccacagtatttctgctgctacagatacttataaaaacagaaaaccaatacagtgcttactccagaagccactatatgacaatcccagtgctaataactacaaaagcatgaatcttgaattataaagtgtgggtttattctttgccacatagtgagagaacatcaaaaatatagctagaagacacagcaagatattccaaggtcaccaacatggcacatgtatacatatgtaacaaacctgcacgttgtgcacatgtaccagaacttaaaagtataataaatagtaaaaaagaatgaggtagcatgttacaagtagagttcctggctttggaaaaagagaaagtccaacttcaaaaagacagaggttcacttgctgctgcttttttctctttgtcaattatttgatttagtcagattttctattcaagaaaatctcatgtgtacagttacagtggggttatctaaatgtgtaattgtgtgtcaaagtagattagttttgctatctaaataatggttctggagaatgttctcataatgtttgttcattaatcaacctaagtcttcctatcagtcttccaagtggcgtatgagctgggaaactaattcagccatataccatgtgacctttatgaaccagatcaacataaagaaattgctaaagaaataagctctagattctagattcttttttctgtattcatttagagatgaattacatttatttaatgatagaatggtaatacaatgggagggaagcaatgactgagatgagccacaaaaacacgtctagccttgagagttgcaacgaatattcccagccaaatgagtctgtttaatatgttttcatgcatgcaagtttatctgcttagctcaaactgcttgaacttatagtcccatcatggttatttccaatattttgaaaacaaatatatacttccacatatttttaaaaatcaccactctccaatatttctgttgaatcagaccttacattatgttgtttaataaagtatggtaagttttggcatgtatgatttttatcatgtaagaagcataatttcttagtcaaaaatttagcctttgactctttagtagaaagctgagttctgtacattgtgttctaaagatagacaaaaatctagagattttcttctttcaaagtaaaagcagatgaggcctttttccaccctctgaggcattaaattgctttgctcaagttagacttttaatatatttaatttgataaatttatctggtaatatatgtaattcagcaatatggaattgtatcatgttatatggtgccatgaaatgctagggaatgccacctcaagagctctggatgaaacatttaatatgtcttggttggtttgactcccattatcagtagataatggggctaaagtaggtaactgtatcctatgttttccacctataaacttttgtggtaatagaatgtgaaatctgggaagcatgtcgttttccagaattctgcactagaaactcagcagtttcactctgcttcttgtgttgtggcaaactttggttcccatagttcagggagcacctttacttttttgatatcccaggattcaaaaaaaaaaaaaaaaaagagagataaaaggcactggggaaaagaatagcttagtgcagaaaagggaaatcttctttactgttcctgaagccctacaaagtcacatcctctaaatctggctatttcatgtaaaatccaggtggtaaagacagaagacatatgttatgcctgtgtctttttatttctctgtttctgccagtcagatagcataaacatttatgtcagatagcaaagagtggatgggaataaaagcacaaaatggagaagaggactttttaaaattttggaaaattcttccattcactcaaacagaaatgagcagacttgacaaaaatttcattgataaaatggtgagtaccttataattataataattatgtataatgataaaattaaagtaagcacaaaatacctttatcattaaaatggtgatagttaacctgaatcaagtgaaaaaatcagggaaaaagttctttttatgaataaaataataattattattcatattacttttattaaaggtcaaagaaggaaataatacatacaaaagtgaaaaaatacaactatcagaaaatatatgtcatagtacatcttctgctgctgctgacagattaacccaacaaagaaagattaggaaaacagcctcagcaatttcccaagaaactgaaggaagagcatgataggtaagtaagcctattgcagtgtgtttgttttgttttgttttgtttgggtttttttttttttttgagatggagtttctctcttgttgcccaagctggagtgcaatggtgtgttcttccctcactgcaacctctgcctactgggttcaagtgattctcctgactcagcctccctagtagctgagattacagggatgtgccaccatgcccggctaattttttgtatttttagtagaaatgaggtttcaccatgttaaccaggctggtctggaactcctgacctcaggtgttctgcccatctcagcctcccaaagtgctgggtttacaggagtgagccactgtgcctggccacctatagcagtatttcacaggagataattgtcattgtgctataaactaattcaaaattggactaatattccttatgattaacaagttttatatttttaccagggatatttagccctgtctggtaatcagaaaaatgtaaattaacataaaataagatatattttgtaaagtcatgctgatatttaaaaagtaattactcatgttggcaaatgtgaggaaaaaggcattctcatacactgttggtatatgaaattggtaaattatttgtgaagggtaacttagtgctgtgtatcaaaatttcaaataacctgacatccctttaactcaacaactccacttctgggactagatttcccaggaaaacataacttgtgtaaacatacacaaacttattaagggcattaattatatattacacataatgaacaataggctaattaatatataaaatatatgtaataagaaggtgaattgaaagtattaagaaagaattataaaaagtgtgaggtaacagatgttagactctttagcctagttttggatgacagtcatttgcagatatagtttttgtgagagacatcttactctgtaaatcatttggagagacacccgcaatatttcgtaaagatgaaaatttatttctagtgaacttatacacttgtcagtaaatagtaactttaaaattttagttgattgtaaatgaccttttctaattagggagtaattatgactgtgtgatttgaaaaggtaattttgaacttgtaactttactgaattatctccagtatccttttttataatatatactagagtcactagtaataaaacctttagcagaatattctttccttactacttctcaagtatatgcattcttttgaagatgttgaagtgagaatttaaatatctgagaactgcaaaggaaaaataatccagaacatagaaattttattaggataataaacaacatctgcagaggtagataacaggatgaactctttattttttaacaaaatgaatttcaagataaatgtctttatctgcagatgcaccttacaacaagaaaatgaagaaaaaacaaatgttaatatgctgtacaaaaaaaatagagaagaattagaaaggaaagagaaacaatataacaaagaagttgaagcaaaacaacttgaaccaactgttcaatcactagagatgaaaccgaagactgcaagaaatactccaaatcaggtaaatcaatctttggtaaaaattctatattttaaactttattttatcagtgttacttacaatatccacttgatttaatatatattatttaggtaaaaaacaaaccagaaatgttatctcatttttaaaaatgagtgatgacacttacaggtacaattattaatatatattataaatcttggcatccacataggatattattttattacaaagagcttttgaaaacaataatatgccataatatatacttagtgataacttattgataaagattttgttcccagtaaaattgttcttgtactttcccctatttcatattgattactgtacctaatattataaagaagaaacagaaattattgcaatcacaaataatctcatgatattcttagaagaggtctataaattttatcttatttaccactggtgttttgaaataaaagttttctttcgtatggatatatttacaccacagaagtaactgtgatctgttggagaactagaagtagagtcagaagtcctggggaaaatcctgtagcttgcttatatttttaacctttctttctcaaaattatggtaactagatgagttcatcaatgaatgtatataggagtgactagtataatgtgtagatttatgttagtaaatgtaattcttataactgactataaaagtgttaaaagagtcaaattggaatagaatgttatcagtgaaacagaactgtaataactctgggaaatttcatctgtccaaatacgtgtgaactaaggttcttactatagggtggtgtataggttagatatcaaagtgtaaatgcaattttttgacatattttaatttagtcaaatttgttaatgctttaatttatacttttgagtttgttgtaattcagggaaaggcttttccaattctgaaattcttaaaaattctctggtgtgcatgtgtgtgtgtgtgtttacttttataaattcattgactttaaataaatttctgaactttttggaatttatgctctataaggttcaaaattttgcttcaactttttctccagttggatatccacttacagtaacctttttagtgcatggatgtgcaggttattctttaacttcagaggtaatcatgatatgttattttattgagtactagctaaaactttctgttgttttatttaggattttcataatcatgaagaaatgaaagatctgatggatgaaaattgcattttgaagacagatattgctatactcagacaggaaatatgcataatgaaaaatgacaacctggaaaaagaaaataaatatcttaaggacattaaaattgctaaagaaacaaatgctgcccttgaaaagtgtataaaactcaatgaggaaatgataacaaaaacagcattccggtatcaacaagagcttaatgatctcaaagctgagaatacaaggctcaattctgaactgttgaaggaaaaagaaagcaagaaaaaactggaagctgaaattgaatcttatcagtctagactggctgctgctataagtaaacacagtgaaaatgtgaaaacagaaagaaacctgaaacttgctttagagagaacacaagatgtttctgaacaagtaaaaatgagttctgatatttccgaagtagaagataagaattagtttcttactgaacaactttctaaaatgcaaattaaattcaataccttaaaagataagttccggccgccgccgccactgcagcctgctgggctggaggaagcagagctggtgctgtcccggctctcttgcggggaagcaactgagggggcgccttggggtgggtgctcctggtgagaggagtccactccatgcatgtgggcggaggccatcccccgagagccgccgacatgaagaaagacgtgcggatcctgctggtaggagaacctagagttgggaagacgtcactgattatgtctggtcagtgaagaatttccagaagaggttcctccccgggcagaagaaatcaccattccagctgatgtcaccccagagagagttccaacacacattatagattactcagaagcagaacagagtgatgaacaacttcatcaagaaatatctcaggctaatgtcgtctgtatagtgtatgccgttaacaacaagcattctattgataaggtaacaagtcgatggattcctctcataaatgaaagaacagacaaagacagcaggctggagtgcagtggtgggatctctgcttgctacaaccttcacctcccagccgcctgccttggcctcccaaagtgctaagattacagcctctgcccacccgccaccctgtctaggaagtgagcagcgtctctgcctggccgcccatagtctgggatgtgaggagcccctctgcccggccgacccgtctgggaagtgaggagtgcctctgcctggccgccaccccgtctgggaagtgaggagcatctctgtctggccgcccattgtttgggatgtgaggagcgcctctgccctgctgccccaaatgggaagttaggagcgcctctgcccagctgccccaaatgggaagtgaggagtgcctctgcctggctgccctgtctgggaagtgaggagcgcctctgcctggctgccccaaatgggaagtgaggagcgcctctgcccggccgccccatctgggaagtgaggagcgcctctgcccggccgccccgtctgggatgtggggagcgcctctgcctggccgccctgtctgggaagtgaggagcgcctctgcccggctgccctgtcttggaagtggggagcgcctctgcccagccgccccgtctgggaagtgaggaatgcttctgcccggccgccacctggtctaggaagtgaggagcgcctctgcccagctgccctgtctgggatgtgaggagcatctgcccagctgccctggctgggaattgaggagcacctctgcccagccgccctgtctgggaggtgaggagtgtctctgcccggccgccccgtctgggaggtgaggagcgtctctgcccggctgccccgtctgggaagtgaggagcacctctgcccggccgccccatctgggaggaagtgaggagcgcctctgcccggccgccccatctgggaggtgaggagcatctctgcccggctgccctgtctgggaattgaggagcgcctctgcccggctgcccattgtctgggaagtgaggagcacctctgcccggctgcccggtctgggatgtgaggagcgcctctgcccagctgccaccctgtctgggaagtggggagtgcctctgcccggccgccaccccgtctgggaggtgaggagtgcctctgcctggcctccccatctgggaagtgaggagcgcctctgcccggcagctgccccgtctgggaagtgaggagcgtctctgcccggccgccccgtctgggaagtggggagtgcatctgcccggccgctccgtctgggaggtgaggagtgcctctgcccgcccgccccatctgggatggggggagcgcctctgcccggccgcccatcatctgggaagtggggagcgcctctgcccggccgccccatctgggaaatgggaagcgcctctgcccggccaccccatttgggaagtgaggagtgcctctgcctggccgccctgtctgggaagtgaggagcgcctctaccccgccaccccatctgggaggtgtactcaacagctccgaagagacagcgaccatcgagaacgggccatgatgacgatggcggttttgttgaaaagaaaagggggaaatgtggggaaaagaaagagagatcagattgttactgtgtctgtgtagaaagaagtagacatagcagactccattttgttctgtacttagaaaaattcttctgccttgggatgctgttaatctataaccttacccccaaccccgagctctctgaaacacgtgctgtgtcaactcagggttaaatggattaagggcggtgcaagatgtgctttgttaaacagatgcttgaaagcagcatgctccttaagagtcatcaccactccctaatctcaagtacccagggacacaaacactgcctaggaaaaccagagacctttgttgacgtgtttatctgctgaccttctctccactattatcctatgaccctgccacatccccctctccgagaaacacccaagaatgatcaataaacattaaaaaaaaaaggtacaagaaaaaaaaagataagttctgtaagacaagagatactctcagaaaaaagtcattggctttagaaactgtacaaaatgacctaagccaaacacagcagcaaataaaggaaatgaaagagatgtatcaaagtgcagaagctaaagtcagtaaatccactggaaagtggaactgtgtagaagagaggatatgtcaactccaacgtgaaaatccatggcttgaacagcaactagttgatgttcatcagaaagaggatcataaagagatagtaattaatatccaaagaggctttattgagagtagaaagacctcatgctagaagagaaaaataagaagctaatgaatgaatatgatcatttaaaagaaagtctctttcaatatgagagacagaaagcagaaacagtagtaagtatcaaggaaaataaatattttcaaacttctagaaagaaaatttaaacatttggttctggatacatgttgaacctagttgaatataaaaatcagtagataaaaagtgtgtttactatactgtataattccatttacatgaagcatccagaaaagagaaatgtataggtacaaaaagtagattaatgtttgcaaagggctggggctggaaggtggtagtgactgctaatgggcgtgagggatcttgcagtgatggaaatgctctaaagttggattgtagagatggctgcacagctcagaaaatgtactgaaaatctttaactttatgttaaaacagatacatctatagtatgtaaattatattttaacaaagctttttgatttaaaaaaaaaagaaaaatgtgtttattacatcagcttagaaacataccttgtttccatagaggtgagagatgatttactttgagagaagacattgtgtcacctatgacattttattaggcacagagtcatattttaaggtagatagtcctgtagtgctgaaataataattttaatgtctttatgttgccacatgttaagaccatgatgaaggtataaatggaaatgtttacacctgaaatgagtgttttcaaattaaaatttaattgatttgcttcaacacttaattgtagatttcccagatgaagtgtattgctgtgtcttgtaatatcttgctttaagtagttttttatatattttagttggtatagctttattattattcatattaatttaacttaaatctgaaaatatgtcagtctcaaattacatatttttatgaccatgtaatgttttaaaggcacctacttgttataaaattataatttagggtaaatgtaaattttagcaaaactatatttgatttagtcttcccactggtattcataatttactttgaatatttttattaataattagctcataattttta

SEQ ID NO: 4802 - DNA, 4284 bp, Homo sapiens
agaaacacagccgttcactgaagaggatttgagtgttgtctcctctgtggggtcaaaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatctattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtaaatttgcttagtcattttcagagacaaaaatttgggaaaaggattgtagaatgactggcttcccaaaaccacttggtgtttacaaagttatcaaaaacgggctgggaccactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtaaacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtctgggcaacagggtgaaaccccgcctccactaaaaatacaaaaaaaagaaaaaaaaaaagaaaaaaatagctggccattgtgacatatgcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatagaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccccgctagaagtgtgtaagagtttatgttgcttcacatcctcatcagcactttgtaatttcagtctttttaattatagcctttttgtgggtgagaaacgctatctcttgctagttttattttgcattttcctagtgactaatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtgtcttttgaaaagcagaagttataaatactgatagtgtccaatttatctttttcatttgtgtagtgctttcttgttctaagaacctttaccaatcaccaggtcacaaaaatattttcctatgttttcttctagacactccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttgtactccattgatctaattttttttcttatacttactgctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctcttgatcaatttgaggaggatcaaaatcctgaaagtgttaagcgttaccatccatgagcatgcatctctccatttatttaaggcttctttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaatatagttttacttcttctccaatttttatggcttttgtttctttttcttgttttaatgcactggctatagcctgtaggacagtgttgaacagaggttttgagacagacatcattgctttattcaggacttctctattatatgtgatgctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaacgggaacattggccacatccgccattgtcaattttaaataaaagatatgatgact

SEQ ID NO: 4803 - DNA, 1264 bp, Homo sapiens
tgcatttcggggacccggatgccgcgcatgcgcctctttcatcttcccatcatggccgccgcctgtgcgcctctgctgagtcgtatgtatttccctcctgacattttttttcagatgttccagtcactttatggcctcaccaacagaaatgagattaaaaagaatttgtcaaactatctttaataatgccccttcactctgcctgtgacgtattagtgacctctgagctagagtcttgtagtcacttcctggtgacccctgaccccgttgatttccgtccgctaggttgctctcacccatggcgtttgctggttatgagatttgcggaacgtgtggtggtggtaaagggcaccaactgttgtcaacctgcatgtgggggtctgaggtctggctctacagcttgtaaaatggaaataataatgcccagaggatgaaattaggccacataggccgcttggcatcatagtaagcactcagtaaaggtcaattgttattaaccatttttatacagcgcctttgtttaggtgcagagctttatcagagccaaaagatctctgcgctctgttggaaaagatagttcctgcagtaattattagtaccccatttaatggctaagtaattatagctaacagtgctaggatttctttttcatatatgacttcatttgaacttttcagtactatttgttgatttcataatttttcgagcactgctgttgaaactgcctttgcaaaattacaactgaggaaattatgatagtggaagaaatcagacttaaccgactccatcttgcttctaacctttaagctgtccttattcattcctgggtgtaggtggaactaactttggggaggaattcagtttatggtttgaaacaaaattgataatagccccttcccgaaaagacccccttcttgcctggggaccagtctgtctttacaggactaacaaattagctacaagattacaaattacagtttaggggacatgcagcctctcgctccaagagtctgaacctccccaaattgcttttaggaataacataactattgtaaaacctaagattagtgcttgagatgttttgcagaccctgcactcattggatcagctgactacctagaccagtaacctggctcaatcagttctgccattccacccaggaacagaaaacagcaagaaaacctcactttgactccctgtgattccgtcttcaacctgaccaatcagcactccccgcttcccaagctcctactcgccaaattat

SEQ ID NO: 4804 - DNA, 2218 bp, Homo sapiens
gaataacttttacaaataaccagcaggaaccggggagtcggtggtgggggcacgcatgagtttcctttcctctgaagccttggttctttaaattggcagcataaccactgttcccgtgcacacacggatatttgaaggcatcagtgaaaaggatgcagggtaaacatgaagcagaggacacggtgggttggcagatgtgggctgggtcctggaagctcacatggacctggaagtttattccatcctgagttctcgtcgtggctctgtgtgttctgcttctctgggaatctcgggcagttggagtctttctgtacacttctcagtgcctggctgtgtggggtagaagcaagtatttgtgaaactcgggccaaggtattatcattttccatctgtgctaccatgtgaaaaaggttgggaaactctactggaaactgacctcgctcttgggacccaccctgccaggcaaaaggggacacctgaggaaagagtttggaaaagagacagtggtcagaaaagaactgacaggattttccagtgtctagaaatgcactgcttgaagagcagcagaatatattacactggagaagagaagactgtaaggggctagatgcttcatctgcaagaagagtagacttgccctgaaggaataatcaggccagtgagaaagagcatatgcacatagatttgagctcagtaaagaataaacctgagcagtcccacaagggaacagtactccccagaggataagctgccaaatatgggcagtgttcaagcagaggtgcaaggaacacctgccaggtaaacaatggacacctgccctgaggaggccgtgagatagatcatctccaaagacaccatcaacctctatgaaaaggaaggatgggcttattatgaccactattcagagagaagaaactcttaatgttttcctgtgatattagtattgttttctagtgcaaattcctatcatcatgctgctcttcaactggaaccaaaacaaaaatttaacattatattatactactaataaaattaatgattaaggaaatctgccatcctaaacagaaccttttatgacttaaaatttgccttcctgaattggagctatgctgtattgacaacttccattggaaccctggcacatacagtaggaaggcataataactaagatccctatcaataccagcttttaggggagaactccatactttatagtgtcctttgataatccatgatggactgttatttctacatttgcctgttttcacatttattttttatgttttgattctacagatggaaagttccacaaaattatcatccactgtgtaaaacagtacttcattttatctcaactaaaattactttcttaagtatgaaatacataacaatcataattttgtagacatttctaaataagacttttttctctatttgcaggctaaagattgctataccccttataatagtctcatcatgccattttggtggttccttctgaaactttcttgaattccactagattttggagatgtagcaagcaaaactatgatatatcctatacatttttttgtatgttatatataaactgtaagaaccttcttgacagctcccaagatttactcaatctttttaattgcatagagctacagacattaggaaacctacaatgattctagattcctttgcaggctcctacaatcacaccctatcaaagctagaatgactttaggagattgtggccaacattctacttttccacagagaaggaatgtttgcccaagtggcagggcctgaaaatagaagccagagagtttgacccagagctgaggactatttcaatcatatccctctgtatgcttcactaaagatggggcagaagctacttttgactgctttttttctaatgcatgaccttttatttgagtatgctaaaaattaatctgccagtttttgcttactcacatggcataatgggtgctttcaataatttctcactaccaccttgacatgagcaagttacttaatctctctaacctttgtttctctctctgtaaagtgggaatgataatacgaacctacccttaaaaagtgtgttgtaagaaataaatgagatgacttgtttatcatgatcatattccgggcacatagtgtaaactctttaaattgtttccattactgattatgcataattattgtaagatgacctcaaacattc

SEQ ID NO: 4805 - DNA, 3491 bp, Homo sapiens
ttttgcaaactaaatcctgtgtatcttcaaagcttttttgcctgtaataagtcagatgctaatgtatccagcactgatgatcatgaggtttttgtaaagcagtgcttgaaaagagattgttgaccgttagctatgatatgagatgggccccagagaaagaggtggctggcgaaggtgttttccttagttatggggtgagagtgggagaaaaataacattttgactgagaatataggatttatatctctaaatatttcagtaaatggtgctgtctaggttacatcgtcagccttcttgcatagattcttaaccttttagacttaggaacttatttgagaatttgatgaatcctgtggatccccacctcagaaatacagacacatgaatacacagatttcactcacaatttcagtggatacatagatataccagaagtccatcagattaaggactcctattagccacaatttcagtggatgcatgtgtgccagaagcctgacagattaaggactcctattttatagtctccttgctcaagctcatccactcatagggctttcattacagcctatttgctgattatcataaatctgtatttcctagtgggtctctttcctgagccctaggttcattatttccaactgtcttctgtatgtgtccaccgaaatgctctcaaggacctcaaattcaaagtccaaaattgaatttattttctaaacttgttccctgagaggcagaagctaggtggaattgttcattaaactgagcaggaatccaccttgagagtggggatgatgctgtgctcatctatacttgcggtacctatgagccagagagcagatttgaggaacagagtcctcagggcacatggctcaaaccccaaaacaattcaagaacctggttgctaaagttagagagctgaaaagcagatccaatttattctttatatagctggctttgtttgttaatccagttttatagtctctgccttttaaatggagagttaatccacttacatttaatgtaattattcatctgattggatttaaaactaccatcttgctatttgttttttatttggatcatctatttttgtttctttgtttctcttttcctgccttcttttggattaatcttttttggtattccattttatatattatctcctctttttagctatacctcttctttttgttttgtttttgcttatagtggttactgtaagacatgggctgcacattttttatattgtaaaaatccagatagtaggccgggtgcagtggctcacacctgtaatcccagcactttgggaggctgaggcaggtggatcacaaggtcaggagatcgagaccatcctggctaacatggtgaaacccccgtctctactaaaaatacaaaaagaattagctgggcttggttgtgggcacctgtagtcccagctacttgggaggctgaggcaggagaatggcatgaacctgggaggtggagcttgcagtgagctgtgatcactccactgcactccagcctgggcaacagagcgagacaccgtctcaaaaaaaaaaaaaaatccagatagtaaatatattatgctttgtgggccacagttgggctctttgttctttacttgaagatccagattttcatctggcatcatttctctttagcctgatgcacttcctttagcagttcttatagtaaagacatgttgactactaatgctcttaggtttttttttttttttttaatttgaaaatgtgtttgttttttttttaatttgagaatattttgctggacatagagttctaggctattggtcgttttgtattttttttaactttcaacattaaaaagatactattttattggcttcccatgtttttgatgaaagtcagctgacattcttatgaatgtaattttttttctttgactgctataagatttttccctatttttggttttcagcagtttgattataatataccaaattcgtagctccgttctactgccatctcctgtgtgggcctcagttttgattagtttttattagcctacctttgaattcattgatcccttctttttctgtgtccagtctgctgttaaacccatctggtgacttcttcatttcagatcatttatttttcagttctagaatttccctttctctgctggaattctttgctctttacccattctgttgatcttttcctctaaattatttaacatattcataataacttttaaagtcttcatccacggatctctccctgttgactttgtttctttattatgggttataggcacaccttggagagactgtgggtttggttccagaccaccaaaataaagtgaatatcccaataaagcaagtcacacataatttggtttcccagtacatataaaagttatacactacattgtagtctgttcagtctgtagtagcattgtgtcaaaagaaaacacaatgcatatgccttaatttaaaatactttattgctaaaaaaaaaatgctagcaatcatccaagccttcagcaagtcataatcattttgctggtggagactcttacctccatgttgatgactgctagaccattcagggtggtggttgctaaagattggggtgactatagcaatttgttttgttatgtaatattctatatcctttgctgtcttttcaacaatattcacagcatcttcaccaggagtagattccatctcaagaaccactttctctgctcattcttaagaagcaactcattcattcaagttcaatcataagattgtagcaattcaaccacatcttcaggctcacttctagttatagttcttttgctatttctaccacatctgcagttccttcctccactgaagtcttgaacctctcaatgtcatctgtctgattcttccaaattcctgttaacattgaaattttgacctcctcccatgaattacgaatgttcttaatggcatctaaaatgatgaaccctttccagaaggtttgcagttgactttgtgcaaatccatcagaggagttggtatctatggcagctatagtcttaagaaatgtatttcttaaataataatcttgacagggccaggtgcagtgtcttaaacctgtaatcccagcactttgggaggccaaggtggatggatcacctgaggtcaggagttcaagaccagcctggccaacatggcgaaactccatctctactaaaaatacaaaaattagctgggtgtggtggcgcatgtgtgtaatcccagccactcaagaggctgaggcaagagaatcgcttgaaccggggagggagaggttgcagtgagccaagattatgccactgcactccagcctgggtgacagagcgagactccatctcaaaaaaaaaaacaaaaaacaaaaccaacttgacagtagaaattactccttgatccatggactacagaatggatactgtgttagcaagcatgaaaacagcattcatctccttgtatatct

SEQ ID NO: 4806 - DNA, 8559 bp, Homo sapiens
acaccagacagtagacagagaacaagaggaagcagattccagaagcagcagctgagatccagtcgtggattggaggcaatgttaacatgcccctccaacttggaaagacaaactggtgtgtagagatttacactgtgaactttttttccaagcaacaatgcaggaacttaacaggaacactgaaagaaaccacagaccctttgaaagaagcagcaggctgcagcctacaccatgagccatgcagaaaactgtaagcctccagagtaagagctggggataaactgcctctaggattcacactcccttgtgggaacctgtcaatccaggccaagggagaagtctttcaccatacccagtgctggaactgattcagagagcactggggaatatcaaggaagaagcaacagtagggagagccttgtgtgcattttcaatctccagcatggaccgagggaagttattcctgatcctgcctcacaggggccttgaagaagtctgccagctaaatcaggcagtggtcacaggttgaaagaagcttccagctgaaattagtgatataatctcaattgaggatgaactcccttggccagaatcagggggtgagtgagaagcctactgtagccacgagcacagaaattgggcaccccaggtttgcaggtggactgggaggggaatggtctgaaagctgtggttgctgtctccaccaggaaggtttatggcctgggtcagattttagttctgagcacagactgcctgaaacttagctagctgcagctggtggagcagtgtgggtgtgggacctgccttgccaaatgcatggaagctgggtggggcttactgctgcctgcttactccccactccctgtgccaacacttcttcacagcagaggcagctgcattctgccctggaacatgaccccagtgtccagagaactgccccctcacaccacaggggccacagtttgccctggaagcagaaagccagagtgcaggcctgcctgacccagcccccacctggctttgtccctccacccaccctgatagcttaacacaaaggacagaaacttttggcagctctacggccccacctatagcttgaaaatccagaatacctctcctgggtaaaaggcaagcacacatcccattgctactactgcagctggtgccctttgcaaatgccacctcttggctggaggccaaccaacacggtccatcacagcatctctgggtagaataacctacacccaggaagaagaaaacttgtatgtgacctcagccatcaccattgcctacaggacctggctaaatacgtggtcctgagtttgtccatgtgaccagttcattactactacaatcagtatctgagaaagccaacacactatggctatttataaccaaaggatctctaatgtagatagagtctacatcactctcctgcccgttgttgggatacgtgaggataggtcacatcactggatttcttgtagacattccccagcaccagcctggagtgtggcagcaccactgggtggctagactcagaggagcagcagcatttacagtagtctggctctcagggcctcctactcctaggggaagggggaatgcaacacatcatgggaacaccccatgggacaaaagaatccagatggcaggacttgagtcccagaactttccacaggtggaaagtttcattcagcagagacacaggtgcagtgctaggctcagcaaggaaagtctgtagttccaccccaatagtcaggcagccctgatgctcatgaaaggtcttggagaaggagacttctttctccccttgtccaccactgcagatacagctggggcttccaccatgggagcttggcatgggtttacctatagacagcctttctggaatacttcagggtgtggctgcatctccacaggagaagggccctccaggttcaggcttgcacaaggagtacagtcacaattcctctctacttggaaaatcaacattcctgtagatgaaaagaggtgcctctctgatgaatagccagaacattgggtcaggagtgtgtctgggtcaggagtgtgtctaggaagtggatcactttcctgctagcctggcaggagagctgaggtggcgcctactctttccctgacaagacttcagtctattccactgagagctcctccatgcacttctgtcaggacagaggcatttgcaatacccattgatggacacctgcttttgccacaccagtctctacccagggacaccactcctactggcctgaagcctaaactattcaacccagtaaataaattattgaggggaaaatagatttttaaataagtgtacaccacaagagaatgagataagcctcaagaaacttctgccattccaacctcacaggagacagtgaatttgctcatacaccaaacacattgctactacaatgagcatctgagaaagctactacaaaaaggccctctatagcctaggaacccatacagggtcttgacctctgaaagcaccaagagcagaattagctttcaatctgctataaaaattaaattcacatctccaaggaaaaataaagaaattttaaaaaacaataaaatcaaaaataaactaagaaataattagaacatatagtctgcccaaataagaagcaaccagaaaaatacttctggtaatatgacaaaacaggattccataacatctccaaaagatcatactagcttttgagcaatggatccaaaccaagatgaaacctctacaataccagataaagaattcaaaaggttgaatattaagctactcaaggagatatcaagaaaaatggaaaacataaagaatatagaaaaatgattcagaatatgaatgaaaaaatttataaagagatagatattttacagaaaaaccaatcaagcttctggaaatgaaagatacatttagggagttacaaaatgtagtggaatgttttgacaacagactagaccaagtagaagaaagaatttcagggcttgaaacaagtctttcaagtcaactcaatcagaaaaataataaagaaaaaagaatcaaaagaaatgagcaatgtctccaagaaatatgaaattatttaaaatggccagacctaaaaataactggtgttccaaataattggtgagggagaagagaaagcaaaaacattggaaaacttatttgatggaataattgaggaaaacttccctggctttgttaggcaaatttagatgtccaaatacaagaagctcaaacaactcctaggagagtcattgcaaaaaggacatcaccgaagcatatactcattgggatttctaaagttaacatgaaggaaagaattctaagagcagtgaaacaaaagcatcaggtaacctctgaaggaaaatctattagactaacagcagacttctcagcagaaaccttacaaatcagaagtattaaggtcttatctttagcttccttaaatagaataactgtcagttaagaattctgtattcagcaaaactaaatttcaaaaatgaaagagaaacagttattttcagacaaacaaatgctgaggaaatttatcactactagaccagccctacaagaaatgctaaaagtagttctaaatgttgaaacaaaagtcctatatgaaacataatagaacctcttaaaagcataaaactcacagggcccataaaacaataacacaatgaagaaaacaaagtatctagataacattttgcctgaaataatacctcacatctcacattaatgttgaatgtaaatgccctaatactccacttaaaagatacagattggcagaatagattaaaaccatcacaaaccaaatatgtgctgtcttcaagagattcatctaacatataaagattcatataaactcaagataaacagctggaaaaagatatttgatgcaaatggaaaccaaatgtaagcaggagtagctgttcttatatctgatcaaaaagacatggaagaaacaacagtttaaaaaaaagacaaggtcattatataatgataaaatgatcaattcaacaaggagatattataatcctaaatttacatgcacctaactctggagctgccagatttacaaaacaaatactactagacctaaaaaatgagatgaatagtaatgcaataataatggggaacttcaacattccactgacactagacagatcttcaagacagaaagtcaacaaagaaacaataacttacactacactctagaacaactggacctaagagatgtttacagaaaattctacccaacaactgcagaatatacattctttcaccagtacatggagcagtctccaagatagaccatatgataggccacaaaacaagtcttaatgaagtttaaaaaaaaatgaaatcatatcaagtaccttctcagaccacagtggaataaaactagaaatcaactccaaaaggaaccctcaaactagacaaatacatgaaaatgaaacaatctgctcctaaattatttttgggttaacaatgaaatcaagatggaatttaaaaagttatttgaaatgaatgataatagtgatgtaatttatcaaaacctctgggatacagcaaaaatagtgctaagagaaaagtctgtagtgctaaatgcctccatcaaaaagtataaaagatcacaaattgacaatctaatatcatacctcaggcaaccagagaaacaagaacaaaccaaacccaaagctagcacaagtaaatacacaacaaagatcaaagcagaacaaaataaaattgatacagaaaaacaatacaaaacatcaatgaaacataaagttgcttctttgaaaacaaaaacaaattgatagaccattagctagattaatcaagaagagagaggtttcaaataagattaaaaatgaaaatgaagacattacaactgacactacaaaaatacaaaagatcatttgagactaccataaacacttttatgcacacaaactaaaaaatctagaggaaatgaataagctcttggaaacgtacaatcctcctaaattaaatcaagaagaaatacaaaccctgaacacaccaataacaaccagcaagactgaatcagtaattttaaaaaatgccaacaaaaataagaccagggccagatggatccacagctaaattccaccagacagtcaaagaaaaattgggaccaaccctgctggaactagtccaaaagattcagaaggatagaatcctccctaactatctatgaagccattatcaccctgataccaacactaggaaagtatataacaacaacaacaaaaaagaaaaccacagaccaatatccctgataaatacagatgcaaaaatcctcaatagaatactagctaactgaatccaacaacacatcaaaaagataataaatcatgatcaagtgggtttcattacagggatgcagggatggtttaacacatgcaagtcaaaaaatgtgataaatcacataaacagaattaaaaataaaaaccatatgatcatctcaacagatgcagataaggcatttgataaaatctagcatcactgtatgataaaaatcctcaacaaactagccatagtaggggcatacctcaaaataataaaagccatatatgatggatccacagtcaatgtcatactgaatggtgaaaagttgaaagcattcccccgagaactaaaacaaggcaaagatgtccactttcactacttctattcaacataacacctgaagtcctagctagaacaatcagacaggagaaagaaataaagtgcatcaaaattgaaaaagaggaagttaaactatcattgttcactgataatatgattgtataactagaaagctgtaaagattactccataagactactagatttgataaattcagtaaactctcaggttacaaaatcaatgtacacaaatcagtagcacttctatataccaacaatgatcaatctgagaatcaaatcaagaacccaattccttttacaatagctgaaaaaactaaaatactttaggatatacttaaacaaggaggtgaaagatctctacaaggagagctaaaagaaactgctgaaagaaatcacagatgacacaaacaaatggaaacatatcccaggcccttggattggcagaatcaatatcatgaaaatgaccgtactgcccaaagcaatctacagattcaatgcaattcctatcaaaataccaacatcatttttaacagaactcgaaaaaatatcctaaaattctgtggattacaaaaataaccttaatagctaaagcaatcctaagcaaaaagaacaaacctggaggtatcacattacccgacttcaaatgatactacaaagtcataactaccaaaacagcatgacactggtatacaagtaggtgcatcataaaccaatggaactaaacagagggccccaagtaaagccaaatacttacaaccaaaactgaggcttgagaaagcattcaaaaatataaattggggaaaggacaccttatttaataaatgttgctgtgaaaactggatagccatatgtagaagaataaaactggatccctatctctcaccttatataaaaatcaactcaagatggaccaaagacttaaagctaagacctgaaactataaacattgtataaaatagcctagaaaaaagctcttttggacattggtctaggaaaataatttatgactaagaccccaagagcaaatgcaacaaaaacaaaaataaataggacctaattaaacgaaaaagcttctgcacagcaaaagaattaatcatcagagtaaacagacaaccacagaatggcagaaagtatttgcaaactatgcatctgacaaagaactaatattcagaatccacaaagagctcaaataaatcagcaggaaaaaaaacaaataatcccatcaaaaagtggccaaatgacataaatagacatttctcaaaagaagatatacaaatggccaacaaatatatcaaaaaatgctgaacatcactaatcatcaagaaaattcaaattaaaaccacaatgagataccatctcacccatgcaagtgtggtcattattataaagtcaaaaaaagaatagatgtttgtgcaggtatggtgaaagggaatgctcatacactgctggtgggaatgtaaattagtaaaacatctaaggaaaacagtatggagatttctcaaaaaactaaaagaagatctagcattgtatccagcaatcccactactgggtatctctccaaaggaaaataagatattatatcaaaaagacatctgcatatacatgtttgttagagcacaattcacaattgcaaagatatggaaccaatctaagtacccatcaaccaatgagtggataaagaaaatatggtatatatacaccatggaatattactcagccataaaaacagaatgaaataacatctcaggcagcaacttggatggagctggaggccattattctaagaagtaactcagaaatggaaaaccaaataccatatgctttcacttatatgtgggagttaagctgtgggtatgcaaaggcatacagagtggtataatggactttggagacatagaagcgggaagatgagagggaggtaagggatagaaaactacatactgggtacgatacacactactcaggtgatgaatgcaataaaatcttaggttttaccactatacaattcatccatgtaatcaaaaaccatgtacatccccaaagctattgaaataaaatatattttttaaaaaacatgaaaccatgggcaaaaattaatagaaattatcaaaaaatttgggacaagattagcaatgttatttcatgacttctgtaactagaaatgtctcatatctgatatttccactcctattttctttgccaccgatatgtcctcctcaccacgcagagaaacattttcattaaataatttaccctgttcaagaatataaaatatttactctgaacttctctatttggatcttgtgaaaatcaatagttttgttctattctgaacaaaaggtagattatttaacctatcttgctaagaaagtcatgatagatttcagtcaatttatgaaaatttacaaacaaaatatttgtagtatgtgtactatattttaaaagtgagttgtatcaatttaatccaaaacacactgagaatttgtcaatatgtacatatttaaaactacttacatgtaggcaccagaacttttcgaaataatttcactgatttatcaaatgtcttcattagcatcaatgaatactttaaatgcattttaacgtagctaaatttttttttgtatgataaatctggtccttttgaatacattaccaaatgtttttcaatgtaaaaagaattttctccagaattctaaccttttcaattactggcattttgagtcaatcaacagttatgtagccataatttttatttttcaggtgctatggaaatcttgactctcagattaatttgactagaatagctgtcactttctaaaaatgataatgattttgaaaaataacaataattttattgaattt

SEQ ID NO: 4807 - DNA, 1069 bp, Homo sapiens
gtttgggaaagagaatattggaattcatatttctttaaatcattcttttaaacttttaatttttatgtagttttagtacatcttatttgctagtactgtgtcatctttttggctgtatttttcactggctgccacctggccaaatcaccacttgggttataacagcagcctctgactggtctccttccgtctgaccttggcccctgcactctactctcaacgtagctctcagagtgatggaactcagaacttgtcactcctgctcaaaaacttccagtttcacccaggggaagtatcaaggtgacatgaggggacaggaaatattgtccctaaatgttctaagagtggatctcccatgtattcaagcaatcgaggggtgtttaatgagctccatctacatagcaatgatacagcatagctctgctggggctctctgctctccccttctccacaaaagggaaggacaggtaagaacaggcacaataaaatagaaaccagacagaaagaattgggaacaaggagacaagacaagaatcatgctttacgtgatttaatcctaatatttttatgagaggatggctatcatcatttcattttaaagatgaggaaaatgaagccgggtgcggtggctcatgcctgtaatcccagcactttggaaggccgaggaagatggctcacctgaggtcaggagttcgagaccagcctggccagagagatggccagagatggctagagatggttgctgcaaatgccattatttcattcctttttatggctgagtagtattccatgagggaaggaattaggagcgggaaggagattgactgttagtttcttaggattggactaacaaaagtggaggttgttacttacactgcaaaagaaacaaccagagctgtgtcactcagaaggctgaaaagaatcaggctgacagcataatgcagtgaagatgggtgaagagagatgtgtttcatctgaaatttgaagggctttacaactcttctcctttaactaacttaccatcctttaactaacttaccacccaaaatgaattctgtagcctttgtca

SEQ ID NO: 4808 - DNA, 1576 bp, Homo sapiens
acttccggttgctaacggttcccaaacagcccccgaaaacgctacgtgagctgggccctgggccagaggcagaaaacggacggaagaaaaggtctggccggtgagtgtcagagtgagggcgagattgggtggtgttctctgccggtggataggctcgaccgtccggtttgggattggggttaggtattagggagcggttcaaaattatgctaattgttaagattacgagtattatttaaaaagatacacaacagcaacaatacaatgagcccacgaagatcaaatgccagttaactgatttaagcagctttgataggaagaaaatgctgaatttaatgctaacaaaaagatctaagtgcgctgttaggggctaagactttaacattatgggccagccactgttctaaacccttcacatttggtcactcatttaattcctactttatgaggtagatatcattataatactgttttacagatggggaacctgaggcacagagagaaaaatgtattagccaaggtcatataactagtaactggcagaacaaagattcatacccaggcattcttcctttaaattctgtactctggcctttcattgataacctggttttatcagcttaggaaatttgctatccagatggaagtataagtttctacagagatatgttattgcagcagtgttctgaatctcatcgggtttgttggcaatttgcctttcaacaaagggtttttttttttttttttgataagggtggcttccacagagatttaaggagaacaataaaaattttcattttaataaataagccccatttcaacgtcccttctcctgtatcattcctctgattcttctctgtcgttatttgtttctattaggttaaatcattttacatttctggtatttaaccattttgacccacaaaaacagggatttcatttgtttaacctaatacagaaacatcttttcaagcagaatttaggaatctacaacaatgagcaagattatattttcatctccaaaatgtacgttaagtctgtttgtttctctttatatccactgtgaacccatggtccatgccactaccttctttcacttgggttactacagtagcctctggactgatttccttacttctgctcttttctcattcttgcctctttaaggagccagaatgatcttttctaaacaaacattggattatgttcctcccttctagtagttccccatcacgtttagaatacacatcctggcccctgttcacctctctaacctaatcttgtgtcaccttccccttaatccagtgctttcaacacgtggcctttttcagttcctgtaacacaccaaattcatccctattcagagactttgcattacctctccctttcgtgtggaatggttttctgcagaactgaaggtcagttctatctaataaataggaatataatgggattcacctatgtaatttaaaacattcttattaatagccatattaaaaatgtaaaaagacaggtgaaattatctttagtttaaaccatcatatccaaaatattactatatcaacatctaatcaat

SEQ ID NO: 4809 - DNA, 477 bp, Homo sapiens
ggtccacggccggaatggcagcaagctcagttcagcaagacgcttccagttacttcctgctcttaaaaaaaaaaaaaaaaaaagaataaatctctcatgactctatatccttcttgacacctaaccaagagaaattgagatgacagttaattgcaaattaataaagaaggccatcatctactcagcctttacctaagtggaatcctgtcttttgcgcatttaacttacaagaatttacctgcatcagtcagttatgtgaagaagaaaagggaatatatttcagcgtacacaaggcccttgtgctttttaggaggagttctttggagctgaagtgggtctgagaagagacattctcatgatagtggagacagtattatagaagctggaagtgatcatttttctctgttatttatttcacttattacctcacacacatattgatataaaactgatcaataaagttagaatttctacatt

SEQ ID NO: 4810 - DNA, 3158 bp, Homo sapiens
agtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaaaactttattttggaaatttaaagacatacacaaaagaggaacaatataattaacctctgttaactcatcaccaacaagactcatgaccacttttatacttcatgagtgattgtatttgtatccactgttttctattattttcgagcaagtctcagacacaccatttaatctgtaaataattcagcatgtatctctaaaagacaaagacctcttaaataacagttcattagtataaaacaaattgggtaaacttttgttggtcatcaaactatattagcactggtccaatagtttaattttcattgagcctttcaagaggaccgaccagtctgctgctcaagacatcctctcctctggaatgtagagataatacatatcatgctcctttttgttaaaacgtttttttttccccttcaaacacagtccattcatttttcagtttgggttgaaacatccttttcttgatcttgagcttataataacctagtcatattgctcagctcagatatttttactccctctccttaggcattctggttccttaaatatagttagtgtcacagaggataaataaccaaccttatttctaaggtctgagaacacttggaccacatattggttgagctcagccaccttctgattaaagttttcagacttgtaagaactgaaaatttttatggtggaagttctctgagccctcatccattctgtttttaaaaatgcattgcagatgggctatgtgaatatgtttttaaacatctgatatgtgcatgaaacaaaaaacacttgaagttattatgtatacaattctgtgggatgggacttcatgcaggattggttttcaagtttgatttcctgagggattttttagttgtttgtgaaagaaccccaggtctacttttgaaattttgtattataattgtaatgttgcccatggttaaaaaaaaaaagtgttcagtgatctatgtctcctactactcctatttctctgtttttcctctgcaggagcttgctgctgttaacagttattcttccaagttgttttctttgtggggagatgggaggtgggaggaaatataaacatatatgtatagatctttcaaaatatatgacggtatacccgtatgttctgagtcttgctgtttttacctggtaatatttagaaacatttattttgagataaaggagagcacttttaagttgaacctgtagttttaaaaagtacatttcaagtaagccaaagcagagaagtaaatgtatttttcattgttgtatcagaattttgaatttactattttaaaaattcaagagttttgtagctgatctatttcttcccctcagccatcccaaataggtcatttgtcaacagatttaagaatgtttagaaacaacaactttgggaaacgggaaacaatttggtataagtgggtgtgccataacctctctcgtagccattcattcccggatacataccctagagaaactcttacacatgcgtaccaggggatggatttaagcatttgtgtgtaataggaagaaaagaagaaaaaacccgggaagatcccaagtgtccaccaacagtgtgttggataaatactgtggtatattccaacagtggaattccacagaagtgaaactgaactgcagctgtgtatgtgaacatggacaaaactcaacaatagaaggatcaaaaaaagcaagtcacagaagaatacatcactatggttccatttcaatgaaagtcaaaaacaggctgtcaaatacatgataaaaggaaacgattaagacaaaatttaatgttagccgttttgatggagggagaggtgatcatgagggcacaggggtcttcagaagaactggtgagggtctgtttctgaagcctgtgggcatttccttttttaatctgtatgtttatgtgcttttgtatgtatgatatttcttaataaaatttaaaaagaagaatggg

SEQ ID NO: 4811 - DNA, 4062 bp, Homo sapiens
ttttgcatcaggcagataataaaataaataatgataatggtaacagacacaataacagcaataacataatatcaaacagacaagttactttatctttgggtttcttcaaacactctttggaatagtcttttaaactgcttaacatttagtatgaaaactggctagaaggcctctctggccaaagacgctgtcttccccacagtctacattttatttccaccactcataacatataactagaaactttcttcatatcccacattggccaaatatagtatgataaagtctgagcagagagaagattcattcataaacaatgaataagcacagaaggttctgcagagctaaacttcagctactcgccatttctgattgccttttgtggccagggtaaccatcactggcttcctggtctcttacttaactctgcaaaacagaagaacgttatgtagaatcaagaagtatacaacagactgaagaatacagattaaaaactggcttttaatgctatgcataaactttcataaaaggatttttattatatcattctaagtaaaattctgtgttgatgaacggtaactctaataatacctataacttacaatgggccaggcacgaatttagccactttacagcaactctatgaagtggatgctatcattatccccactttgtagaggaggaaatagaggcctagagagattaacctgcccaagtttacacagccagcaggtggcaaagccaggatttaaacccacagaattaatacatactatgtaggtaagactgtgtaagttagtcttattttagccattaacgaaaccattccaattctccaaggaaaattcaacaacttttataaaacccaattaaagggctatggccagcaggaattacaatgtcaatgctaaacgtgataagaggtgacatgctgaaaccctaaattaatggaaaagctactccatctccttactctgtttttcagtctttgtattctttctcttttatcttttatttctcataactctctcctttttccttaagaccctgtggaatatagagaaatggttgactaggaaattgaacagaacatcacaacactggactcacgagtcagaaaagttttatgtttgaggatggcttggtccctataagccatgtgactctggcttggaaaaaaacacataaattatttgaatcaaaactcctcctctgaaaaatgagagatctgaaccacatgatttctaattgccctcttcactctaaagcagtatgctttagcactttaaaatactggatttttaaaatgaagaaaaaatgctgtgacctattcttatttaagaggtaatttggtcttatgtaacctgtttgtttttagcttgtcattttgaatggcccttaattgctttctttaagaactataggctagtggccctcaacagaataaagggttgaccactctatgcaataccatccagaacatcacaatttagtctgttcatccaggtacttttcatcttgtcacgggaatgacggtgaagacccagaggtcacagaggtcactaatctattgatgctggctacctactgcagaggggtgacagcaggggggtgagaatcaggcaattcctgcataaggggcctgctcactccagggaggttttccagtgaagtctaccaggactgtgtccatcaggctgtcatgctagctggttccgttcactctttgggcagcaactgaacttctcccagcctcattctcatcgctgttttaataaaaatgaagctgctgatacggaagtgctgggaagggaatagcatgttccctttaaatgatatgaagcagggaagggaagagctgggtagaggagggagtggtccctggctagggctccacccccacggatcaagatgaggacaggcactcctgcctttgtgtccagatgctgcatttccaaagacaaccctggcccatgacgcccccatcctgtggctataaagacccgaggccctctagattttctagtttatttgcgtagaggtgtttatagtattctgatgatagtttgtgtttctgtgggatcggtggtgatatcccctttatcattttttactgcatctatttgattcttcccttttcttctttattagtcttgctagtgatctatccattttgttgatcttttcaaaaaaccagctcttggattcattgattttttgaagggttttttgtgtctctatctccttcagatcttctctgatcttagttatttcttgccttctgctagcttttgaatgtgtttgctcttgcttctctagttcttctgattgtgatgttagggtgtcaattttagatctttcctgctttctcttgtgggcatttatttagtgctataagtttccctctacacaccgctttaaatgtgtcccagagattctggtatgttgtgtctttgttctcattggtttcaaagaacattttaatttctgccttcatttcgttataaacccagtagtcattcaggagcaggatgttcagtttccatgtagttgagctgttttgagtgagtttcttaatcctgagttctagtttgattgcactgtggtctgagagacagtttgtcacaatttctgttgttttacatttgctgaggagtgctttacttccaactatgtggtcaattttggaataagtgcaaggtggtgctgagaagaatgtatattctgttgattttgggtgaagagttctgtagatgtctattaggtcccacttggtgcagagttcaattcctggatatccttgttaactttctgtctcgatctgtctaatgttgacagtcgggtgataaagtctcccattattattgtgtgggagtctaagtctctttgtaggtctctaaggacttgctttatgaatctgggtgctcctgtattgggtgcatatatatttaagatagttagctcttcttgttaaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtctcctgaatatagcacactgatgggtcttgactctatcaaatttgccagtctgtgtcttttaattggagcatttagcccatttacatttaaggttaatattgttatgtgtaaatctgatcctgtcattatgatgttagctggttattttgcttgttagttcatgcaatttcttcctagcatcaatggtctgtacaatttggcatgtttttgcagtggctggtaccaattattcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactttctactggcttgtagagtttctgcagagagccactgttagtctgatgggcttccctttgtgggtaacctgacctttctatctggctgcccttaacactttttccttcatttcaactttggtgaatctgacaattatgtgtcttggagttgctcttctcgaggagtatctttgtggcgttctctgtatttcctgaatatgaatgttggcctgccttgctaggttggggaagttctccaggataatatcctgaagagtgttttccaacttggttccattctccccgtcactttcaggtacaccaatcagacgtagatttggtcttttcacatagtcccatatttcttggaggctttgttcatttttttttactcttttttctctaaacttctcttctcccaagactaaaccaggaagaagttgaatccctgaatagaccaataacaggctctgaaattgaggcaataattaatagcctaccaccaag

SEQ ID NO: 4812 - DNA, 7174 bp, Homo sapiens
ttttagttttttgtctagttttgtatatatgaattaagtttttggttgacacaggttgctttagttgttgaaatgtaccttcagattttttaggaatatatttattatattactttatggtcaataaattctgttgcctgccttcattgtgtgaaccttctagcttctgccattgctactaagtaatagtgacaggttcagactcatggtagtgctacattgactgtattagtattagcccatatataattgcatgctatatgggtgtgcatttagtgatttttcttgataattcttaatacttacctttttaaattcatacttaatctaattccatgaaatgcagcttgccttccacttcatgttccacttccagatccaaacaaagcatgcccacaattgttgattgattgtgctttctctcatttacataatcttaagaagtggagttgattggttatcatttcatttatcctttgaatgtcagacatctccacatgaatgtgtcaccagtatcttaaatgcaacaaaaaactcagtaatccaaacttatcttccttttaaaatttcttcctatgtgctccatgtctcagttgttctaacccctacccttccggttacctatgctagttggaatcctggcaaatgccttaacttctttcttttatactctccctaatctgtgatcaatgcctatccatcctgcctctgaatgtttttcacgtttgcttccccttcccatctccacttttagtagttttgttatcacttaccttcactattgcagtagtctcttaactgacctcttttctaatctgtcttccgtgctgttgttagaaatatcttcctaaaacacagatctgttgttactggagtggatggataatagcaaagtacaggcagtgcaggcaaacagataccaagtagcaaaggcagggaaattacagggtcctagactcttagtacattctcacagaccttaatctgtagtttaaaatagtaatgggcttctctcttttgctttttgcatttatttccctaaggatgagagtgaacaacttactaccccacactgacacttcagtgagggcactgtggaacctttctaatcagaagatgggaccaggcttgacaatgattcaatcaaagcagttttagtgtcacacttgtctcatggaggctatttgtatttctgaagaaattccaatcaaataacagcttactagatttttttcctggtctaaatattatttttgggcattttccacaaaaagctttttgggaaaggtggttcttacactggggcttggaataattgtatctctatgcttggccttggaataattctgtctctgttggaattgtgcacacgttgaggcctgaggccttatcttttatagggccttcactatgtagcttctcatatattcagcatcttaggagagaatcatattcaacatagttttgctttaagctttttacttggtatcagcagttttgccttaagttctaaagcttaataatgaaactctgttgaatgagaacctttccaaaagatatacttttctacataagctgagtttattcatccagagtcatcaagaatagattatatttagaacatatggaatgaataaatattagtgaattcatctttattggacttttaaatttctttacatataattccattcactcatttattcagccatctacacttgagcaactactttatgccaaggactgtagtaaacatttaggatctgaagaaaaatatgacttgattactcttaagaattttataagtctattttattatttattttctgtagagatgaggtctctctatgttgctcaggctggtgtcgaatcctggcctcaagcaatcctcctgacttggcttcacaaagcgatgggattacaggcatgcaccaccacacctggccttagagtgatttttcttaagtgcaaattcgtgctcttttttctaaggcctcagcttggaatgtcctcttgtattacccacctctcttctttcaggactcatctcttaggaaccttccctgtccaaggcagctgagtacccttcagtatactcatcctaccctctccctctcctgttgtggcagttagtaccatgttttgtaactacctgtttatttgggtctccccaactagactgaaaaaggcgcttgaaggcagggctgtttccgtccttgtgtcctgagtgctgagcacaatactgagtacagtttgtgacctatagaatttgtggagggaaggcattttggatggaggctgttggttaagtgacctgcaaaactgctccagtatcatgccaggatcagtcttctttgctcattattgatgagaagcaacactaacttatgtctttattcctaacttaattatactccaagtacacatttgcatgcttcattacatgcctgtagtgatatcagtgacactgataaagtattttttcatattttagttctcatgtttttgactctttattttaactttgttgttgattgaattgagtatttgagttgctgttagtataaataaagtttccatcttggatgacttaccatgttaacaaaaaaaaaatcacaagcagtattatgtgctagtgataccttgtgatttaaaatgtattttgttccagcaaagaaccagtttgggtctctttggagaatgggcatacatctgagttgacctcaacttttctgtaggagagattattgaatctcctataaaggattatatgtaaatatataaattaacatttgtctgttttacaaaatagagtgtctgaaacaagaatacataaaatgttattttcaatgtactagagtagaggagtttggtatttaaaggagttctgtactttggtaaagccaaaattcctttgattacactagtggtcctaaaccttactgggttgatcataggaagctgaagggatgctggggctatgatacatgacaggagatttactgacgtgactgtagttgatttgggggctgtggggtggtgacagctagatttgtttacatgctgctgatgtgtagatggtgtcctaggtatgcaggcaaacaggtatttgctaggttgaattaacccaaattccttttagtctcttgagtaatgcaagcctttgtattacatgttaattaaagagtttattacttgtaaattaaagcctaatatccacatcaaataatacaaggcacactgctgtaacacacaattatattaaccataaacttttacctgtttccagtctctttttgtttaaacatcattttttttttcctggcaagcctctatattctcattcacaccccagtaaatcactaagagattattgatgaagatatgtgtatttgggtgtttgaaggattgtaacaaaaatcaaaagtagaatagaattttagaatatatgctttctgcattgaggacttcatttgctttatagccttctttatatttgttgatattctttcttgccctgtgccaacattttagaaatacatttttagaaatttcttacaagatttatcagtatgctaccaataacaacacacactctctctctctcacacacacatacacacacacacacagacacaactttttatccatgtaataacaaatatcttgaatttataatgtgtattttgccagaagttaagtggttatacatcattgctttagctttacaaaatcactagatcactgacagattgttttaatatttttagccaagttactatttagaataaaactatgtctaaaactaaattcatcagcctgttatctacgattactgctcccatcctactagaactgactctccttgcttgaattcttcattttatccatgctaccaccaccactttgcttattacgtagacttcaaagtctttatgaatctgttcttgacagttccaactcatagagacctcttctgataaactcacatttaccttaccatttatttttcacttctatcctttgtgttattattgcgttattaattacattgccccccatgattagactatacagtaagtacatgataactattattatgaataagcataactggttttgagtccaagtcatcttgttacttgtaatatcaaagacagtcttttgggccatgtttatagatgagtgtgatccatcttttacattttgagttattttcatcctttaattcttttcatttaattcttcaattttatttatccttaatgttgaatccatgagctaattaggacaatgcctttgactgtatgtgatcttgctattgttttaactttaagatttttattcttttaaatttcagtttcttgctctgaaataccccattctccacatttcccccacctgtcatgtgaatctgttggaagagatgatcttgaagttgctgctcagttccagaatacatttgattttacatcttatttgagtatatgatgtcagttgtagccatttccatctaactgtgcttgccttcattttaagctctgcttaaattctttctcatagagtgtgaagttattttgaaaatggtagcaacatctgaatccttagaaggatggccatggcactgggaggttgtgattgaaaagtccatgggtaaatgtaggatttcagcagtcagcagtgacactacagacctgacagatacacaactgacaaatcaaaacatttgtgtgaaaatgagtacagaaaggaatgattcagatgagtcagttgatcaccccagcaaaaataatcattgtcagtcttctctccatccatctgggaagtgagttattcttttaagagttgcaaagaagattcaggaaaacaggaaaaattaccacagctctttctggtgcttgtaaaaatacataatatggtgcatttttaaaggtggtggtctcagaaccacattttgagaactgtcaaagataggaaccattgtcagagttcagaagagagatcatttcaggctgcagtagtcagggaaagcttaatgaaagagactggctttggtctaggtcttgagagatggacaggatttgaatagatgagagcagggagaaaacatttttcgatgggtgaaatgccaagaacaaaagtacagaggtgggaaacaatagtgtaaggggagtgcagaatcaaatagtttgactcaaaggttcttaaatgtggtccatgaaagaaaattaaggccctacttctgtcaaatgacatcactcacttcagacttggaagaaatgggcagctctgcatatttctcttcagcatgcaaatgaatgaagatgaggaaaggattgctgcacgtcattgtgcctcggtgctttccatatcagcagctgttaccacctttccaaaaggtgttgccaagaaacaggagcagggtaagatgtttttctctaaccagacagaaatctgctgactttccagaagtctaattgaacttgaaggcagaggaaataatgtgacttgaatctaacttgaaagtcttggaggaatttggtgttacagtgtgcaggccaccttaacctggcaaattccattctatgcaattctgctttcgttctattaaatacgtacctttgtgagtcaaggatttcagcacttgttgccatagggaaaaagttgtaatgggttatcaaagatgaagtatatgttgctatgtcaaaagccaaagcacagtttcaactcatttaaactagatctcattgagatgtactactgaacagtcagaattttctaaattttttttccaggaaacagtcatttttctttcaaaagagaacggaggcataatcctttacaaatattgcttatgttcagtaaatcatcttccagtgcagtgaaacgaagtaaatggtgtatgcacttctgcgcatgtttctggaggaggaagtccatatctttagtcagaatctctatcgatttagctattgtggaggcagtaggttgctctggataaatctgagcaaaggaatgagaggaaatcagctcatttgaagaatatgggatgcgaagctttgacacgacaatggcgagtaatttagggattcaggccgagagctccagcacgctgcccggggcctggggaagcccgcggctccgtgagcgccgccgcctggccgccggcgggacctcgccctcgctccgcaccgccgtacctcaggcgcctcgccgcggccgtctccacgggccgaccagccgtccgcagacccctgagtcctctgcctcgcctcaaacccctttcaccccttgccctcgccgtccctggtttgagccagaactctcccgcgaagccctctagaggaccacgtgccttagggacaggctgggggcggcctccgtgcgagtcgtggttgttcgcagagcagcacgtcctctgcctgccaaaatcccggcttctttgagaatcttgtcactggacaataccatccttttcctttcagcctgtaatttatagatttcctattcctagtgagttttgtcatgattagttcttcaaagactagctcctacttgaaccttcacctcaaatcctggcatcgacaaactagtttccccccgcccacctccccacccccccgccacaaccccaaatattgccatctgccagaagattgttttaataactgtccaaatcctcagtgactgtggggtgcttgacacaacttggagttgtgttatgcacaactgtggttgaacttgaactccaacatccagtcccctccttcctgtaacttcatctccagtaattatttctccccttcagaatcagtccttgctaccacagttctagaccatgtcatcattagaatccgcatcctctctacagtcttgtctgtggtgaccatggcctctcagatctcctgctccacggagcggaagtgactgacaggtccccctgccttcccaaggcatacactgctgggtttgcactgaagccatgcttctctggcactactcccagtcagtgagcgggcacagcacggggtgttggtggtggcacgttcatggaagatgtaggactcctctgatgagcaagtttggcttggaaacacctgagccggctggttgaaactttctgagaactatgctgcatgcagcctgaggctcttgggcccagttcccctctcct

SEQ ID NO: 4813 - DNA, 17380 bp, Homo sapiens
agaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgcactgagaaaacttcagagacctaaactttttccagagaagagaagctttactggtgttccagccctaagaaacctttgttcaagaaaacggcagatgctctgttgaatccactggagattgttctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggtcaatggcacatgcgtaggtttgttatgtaggtaaactagtgtcacagggatttgttgtgcagattatttcaccacccagctattaagcctagtacccattaattgtttttcctgatcttctgcttcctcccaccatccaccctcccagaggccccagtgtctgttgtttccctctatgtgttcatgtgttctcataatttagctcccatttgtaaatgagaacatgcagtatttggttttctgttcctgccttagtttgttaaggataaagacctccatccagctccatccatgttcctgcaaaggacttgatctcactctcttttatggctgcctaacattccatggtgtatatgaaccacaaaataaagatggttcttaacttttaaattaagatttttaaattaagatgaatcttgatttttaaattagtatggttttaagatagttttacagatagattagataatctatctagagatagatagggagagatatctatcaatacatatctctatctagatatagatagatggttttctatatagacctatctatctatatatgtatacatctatatatgtctacacatatctctatacacatatatatatatttatatctacatctatatttctacatgtatataggtatgtatatatctacatgtatatatgtatatagatagatatatacataggtatctgtatatatgcatatacatgcctatctatctttatctacatgtattacatagatagggtaattactgataaatcctttggccttctttgtaaatctctgggctaaagacccctccagtattatacatgttctggtctagattgctcactcaccagttctcctcactatctagagaagatccacttagcaggcctccccttaaagaagggcaccttaactggactcactcctcccatagtagactgcacagtacacaagcagaagaggagagctcaataataaagtcaccataaaggataatttttaaatgaataaagaaatcagaaaatccagtattggctagcacatatggctatcagcaagctcaccctacaaaaaaatagtgagaaaacagttcgaatattggccgtttggggcacatattctataaaaaggaaaagttttgaaatgtatatatatttaatttaactctaaaatatttgtaaggcaagcccagtggctcacacctataatttcagaactttgggaggccagggcaggaggatcgcttgaggccaggagaccagcctgggcaacatggcaagaccccatatctacagatggttttaaaaaattagccaggtataacacgatgaaaccccgtctctactaaaaatataaaaattagccgggcatggtggtgggcgcctgtagtcccagctactcgggaggctgaggcaggagaatggcatgaacccgggaggcagagcttgcagtgagccaagatcatgccactgcactccagcctgggcaacagagcggagactccatctcaaaaaaaaaaaaaagaaaattagccaggtatggtggcacacacttgtggtcccgtctatttaggaggttggggcaggagaattgcttgagcccaggagtttgaggctgcagtgagctatgatcatgccactgcactctagcctgggtgatagaacaagaccctgtctcttaaaaaaaaaaaaaaattgtattatgcaccaggtacaatgtgctaggtactggggagagatcttaaaaaaatgtattatacaccaggtacaatgtgctaggtgctggggagagatcaggggataaagcagaccaaaatttctgtcctcatggagcttgtggtctaaaggaggaaaaaaggcaataaacaaattaaaaaagaggaatacaaagtatgtgggtagggatgagtacaacagaggaaaatcaagcaggaaagatagaactctggaaagaagtagggccagtgtcaaacaggatggccagggaaggccacactgagaaggtgacaccaaagcaaagacctacaggaggtgaagtggtgagccattcaggtcactaaaggaggcatgttcccaggagaggggacgacaatgcaaaggcaagaaggagcaccagcgtgtgtgttgagaaaagcatggggacccaagcagctaaagtggaacacatgtaagaagaataaccgtaatgaggtctgagagacaactgggtgggaagtgtcttaatctgtttgtgttactataaaggaatatctgagtctgggtaatttataaagaaaaggaggtttgtttaggtcacaattctataggctgtacaaaaatcagcaccagtatctacatcaggtaaaggctggaggttgcttccactcatggcaaaaggggaaggggagccagtgtgtgcagagatcacagggtgagagaggaagcaagagagagagggaagcaccgggctcttttaaaaaaccagctcttgggaaaactaatagagaactcactcactactctcaccatggcagggcattaatctatttatgagggatccatccttatgatccaaacacctcccactaaacccgacttccaacactggggatcagatttcaacatgagatttgaagcggacaaatatctaaactacagcaaagagtacagatcgggaggcatggcaagctctgctggtcactccaatggagtcaacatttcaagaatgttacaagcagctgggttggtggctgatgcctataatcccagcactttaaaaggctgaagtagaaggatcacttgaggccaggaattcaagaccagcctgggcaacataaagagaccctgtctctaccaacaatttaaaaaaaaaaaaaaaaaaaaaaaaagccaggcatggcagcgagcacctgttgtcctaggttctcaggagcctgaggcaggaagattacttgagcccagggggttgaggctgcagtgggccacaactgccccactgcactacagcctgaacaacaaagtgagatcctgtctcttaaaaaaattaagaaagaaagaaaagaaaacagtattaaaccagttttctagcagcacataggggaagagtctgttgtcctcccagatctctggccaaggccctggcagaggcaagaattacaaagaccctaacctgttgtttcctagctccccagagacactagggaaagctatctcaagggcaaacacatgttgactggtctcaaggagtaaggggttattgttccctcccctggagagagtgcaatcaaggggagttggacaacccatctttgctctacttgctgcttccttttttcaccaactataagtcctttgggttctgtataaccagatccctgattcctctagccaaaattggtttcattttgaccagagactggttacaacacacctttctaccaccacctctattagaagatttaactctttgtttctctaataatctcttttcatacttaattgtgagccccttaagagacacatcttactacttattgtgttttctgtgcctaagtattctgtgtaatacttacaacttactgcatcttctgatgcaaaaaaaaaagtttaaaaggaaatggattgtcatctgctgaatcaggctaagggtaggtcctggaagatactccttccaaaccttataatcagaggtgactgcacagttggcttacaagagcctcttttcaaagtaattggggatgcagtgcttagaactgggctggcattgtaatttttttaggaatctgctcccatttacaagacgttccatcataaaaatcaaatcataaaatcaaatccaagtatgttcatttggtatattcattttccacttcttactaggggtggtgggggaggagaagctggtacaggagaaatgtcttttatttcccctctataacaatggtataattccaaatcttatagaccatcacacagttctgttagttgattgttttccgtggattctaccctgccaggagacacaataaataactttttgaaacttcattcttcagtcctgggagtttttacaaataaaaggacacacatgttgagacaaattacatgcttgaaaatctgtcactaacatcaatttcatgttaaaaagtactaagcaactattacagtggcatttcttttgttgttggggaaaataatgtgaatagctatgctaattcagagataattttcaaatttcgtgactaaataaaaaagctaagagtagttcactaggtaatgtttgggagggagttgttggttttgttgatttattatatcttgactggtatgattgaaatgaattaaatgttagacgtgcttaacattttatatgctatatatcatcataatagcaaagtgcacagatcacattattgagtgcctttggattttaaaaataaagattgctattcagatgaataccatttcattattgcctgcactactctgtcaaattaaaaaatataatagctatctttattctcgttttaaagcatgataatcatcaaaatgttgaagtttatcacagttctacattaaaaataagtcatttttgtagatgagttatccaatacagcaaaggccatcaaagagaaagccaatactttcatggagagctcagagccttaatagatcccagcagcaatgcttcaaccattcccaactccatgttccttgctagatgctcctcaccccaaactcctgcaaatttcaagaatttctgtgtatgtgtgtgttaagggaggagttttaaagtatctctgtattcaacaagatacgtcagcttgtaagcagcagaaacctacttaaactagcttacatgagaaaataacattataaagacataggagtgtttctacaccaagagctggaggtattgtttggtttcatgaaggattaaaatctgtaattcaaaagtagactcaggcagctgcacatcaatctgtgtctttctctctggtactgtggactctatcctgtctgacttgctttgttcctgggcatcattcttgctctggaaaacacactttccctgctcatttttttattttaatgcttaggttcaatctgctcatttttccctacagcagaagacagcttactgtgttccagcaaacaacagagcctgaccagcctctctgaatatggggcccccttctcactcacaagtattcttaacctggggtccatgtggggtttgtgaatttggataggattttaaaattacattttcatttccactaatctctaaccgaaattcagtcttttcttcaactgtgaatgtaggcagcaagccacagtggaacttgccgaacctataaatttgtcactgtgattgatgttataatgttacacctagatcttctttcagaaatgaggacttaccccagctactatgaaagctgttggcagagtgccctcagctggcagccccagggaaatggcctcagttgcagagagccacctcagctgggtaataaacacctggccctctttgattcagggcacttctgaagggtcatataatcttcagaccttctgtaaggttggctgaagcttcctctcagacttcatcacagctcaatgtcatccttctctgaccagttccaccttgccttccctcatgttgatgtcaagagcgttccctagcaaactccccaaatgccaatctccagcttagattctgctttctggggaaactgaactgtgacagttactaatacaaagaatcaatatttttatgtcacattatacttagatagcttgaaatatatatgctcatccccacctcaatatttcagccttctggatctagttacttaatacattattaaaaaactttttactatatcaaaaattactttttaaacgttttagtaactgtatttcaagataattttctgtgttatcctatgccttttattttatgcatcttaaaacatcattctgagaaggagcctataggctttatcactgccaaaggagtccatggcaaaaaaaaaaaaaaaaaaaaaagttggaggagtcaagaacccctgggaactatctcaggagatcttggttttttgcagggctttcagcaccatccattttccagcggctccttaatcgatgtcactccttccccattgctccagtgctactcagctgaactcaccaattgctcttaactgatcttttacatcaccgttcattgctcccatccattttccctacagacaccagaatggtttaaatatatatacatatatatatatgcagagcatgatagctcatgcctgtaaccccaacactttgggaggccaaggagggagaatcacttggggtcaggagttcgaggccagcctggtgaaacccccatctctactaaaaatacaaaaattaaccaggcatggtggcatgcacctgtaattccagctacttgggaggctgaggcgtgagaattgcttgaacccaggaggcagaggctgcagtgagctgagatcacaccagtgcactccagcctgggtgatggagtgagactctgtctcaaaacagaacaaaacaaatatatatatatatatatgcacacacacacgtatacacacacacacacacacacacacacacatatatatatatacacacacacacacacacacacacagaataaatatgcctggagttaattctaaaataatagttaacattccccagatttttactatgagccaaactctctgctattattgcattaatatatttaacaggcctatgaggtatgtactgtcattatcactattccatacatgtgaaaactaaagattatagaagaaaaatcacttttctaaaatcacatacctaatagtaagtggcagaattgaactggtaatctcagagccaaagctcactctttatctttttgaaaaataactttttattttaaaaaatttcaaacataccccaaaaacacaaggagatgtataacaaattcccatgtacttatcacccagtcttagcaactttcaatattttgacagttttattttatctgttatcatttcccttggcactcccacattttctttctttatatctggaatatttattaaagcaaactccagacatcacagaatttcacccaatacaatagtagaaccattagagcccagtagaatacttcagtagaataatgctttaaaaatgtttctctagtcatgccattccctgtttcaaatactttagcacattcctattctacttaggataaatcctccacaggacctgtagacttctgagtcacatggcccaggcctcccttccaaacaccatttgatgaccctctgccttgctcaagaaaacactgggcctactgaccttctcttaatactggtaactccttatcactgagtcaggaccttcttttcttaagcccaggagactttttcttccactcattctcctgtgtaaatgtcctctccttagagacatcatcctatgttgattcagattccaagttctctccagtctaattctccttcagctgaattctttcttacagcgtcctgttcttggctttcatttgatttctcacaattaataattttgcatatatttgcatgtttgtctgtctctgctactgggctgtaagagacctgtcagttttgctcactggtctatacctagtctcaacatagtacttggcatatagtaagcactcattaaactgtgaagtgtgtgtgtgtgtgtgtgtgtgtgtgtgtatgtatacatatatatatgtacatacacattttagtgtatgtatattctcatgtattctatgagattatgggcaagtgtatcctatattacatataaagacagtaagagaataacttacagagttaaaagtaagtgtaaaaggagcagttatattaaattttgaaaagaataaactattaattatgtaattctccattgttccatgaaaacagatgtgactattcattagcactgactaatgaaggatatgttatttcagataatctatcaaaaaaaataccctctttccagcatataaaatctttctctccccattgtcctcaagagctaggactttataacctacttttattttggtcctaaaaatattttttctcaaaaatgctttagaagtaattgagatcatcaataagaaatttatgcagctttcttggaaatgttatgagttaggtcctagcaacctatctctaaggctatgaagcactgatagtctggcatctattttatctgaaccaactccctgcttcagaaactgctgtcttgaaataccgttctgggctgaatatctattgcagtatgtataaaatggaattacaggccattgctacatttgctgcagttactggcatgatggattataggtactcagtcagactgcatttagcattatgatttagtaaagtagctgaaagaggaacatttgttctctttttgttttgcaataatgtttttattagaaatatatgtacattgttgaaaactggaaaatgccaaaaatagaaggaaaagagtgaaaattgctgatgataccaccaccaagaaatcatcaccattaatattttggcttttttgttttcagattttttccattatgaaattgttgatatttgatcctcttgacctataaaaatgttaatatcatatagcttactcgaacatatccaaataatgtcatatatattattttatgtaccaaaaagcatactaaacagattgttttatagcttacttttctcatttttaacattataatttaagcatttgttcataatattaaaactttttgaaaacattattatgaatgactatttcaatatgtggatgtaccacaacttacctaatgatttacctactggtaatcattgagttggactggttggacatgagttgtttctaatttgtcgctattacaaataatgctctgataaatatgtataattaatttgtgtttcagattatttttatttctagaaatgagattcttggttataggctaaatatattttcttggtttttttttttgttcatttgtttgtttgagatggagtctccctgtcacccagactggaatgcagtggcatgatcttggttcactgaaacctctgcctttctggttcaagcaattctcatgtttcagcctcccaagcaacgtgttggaccttccggagcttctcagaagacagagggttttcttttgaggatttaaacctcagacacagggagctgacctattcaccttagaatcctctggggcacccattacagtgtctgtaccaaggaggcaacaaagaacggcggaacagactggagcagaaggaccacccagcagagccaagccaaatcactgaccctcagaggcctgatgtgaatgcttatggcttcagtccattggattctgcagtaatctgccgatctacagtattaccacagtaaataaccgatagacctgaaaacgaatgcatgccttgtgccaaaattgcaggaaacctcaccaggagaaacaattttatatgagggaatgtactctctcctttgcattttccctcaaatctatatttttagcccctcacttgtctctacagagcctcagttgcttaatctaattgctgactgaacatctccaggaaactgtgtgtacgtgtttgtattcatagtatatttatttattatctgtttacttccatgggatatagtctccataagagagtagtcatcattgtatttgttgatgcttaataaataatcattgaatgggccgggtgtggtggctcatgcctgtaatcccagcacttttggaggccgaggtgggcagatcacaaggtcaggagattgagaccatcctggctaacatggtgaaaccctgtctctactaaaaatacaaaaaattagctcggtgtggtggtgggtgcctgtagtcccagctactcaggaggctgaggcaggggaatggcttgaacccaggaggcggagcttgcagtgagccgagattgcgccactgtgctccagcctgggtgacagagcgagactctgtctcaaaaaaaataaaaaaataaaaaacaataaaataatcattgaaagaaggaatcaaagaatgtggtcccgggttgggtgcccttagttcagtccctgagaatttatgagtataatgttttgctttttaaaaagtgaaaaaagggagcatagtttcattgaaggagaagttaaactatgactcaggcccccaaacagtctcacctgaccccatatgctgctgttggactaaaatgtctcaatagaactgtccttagtcagccgctttacacctgcttggattagccactggatatgaagcttccccagaaagtggagagaactcagcaagggtgctctccatagctgaagcaaccctgggagggcctgagagccaagtctatcttccaacagtattcccagcaaatggtgaaacaagtcattcatcaaggagggatctaggtggctgatgcctgcatcaaccacagtctgcctctgttcagcttgaatccatttcttcatttgtagtctgagggtgtaagacaaatgcatgtgtctgtgtgttcaggattgtaggaggtggaggtctgtatgtttagggtagtgtgtctttgtgcatacaaagttggagtttgtatgtatgaatttagggagtttgaggggctgtatatgtattagggaggaaagccaccacatatgtttgtggtagagttggagttttgtgtataatgtgaggattcttttggattatatgtgttctggactgtgggtagtttatgtggatattcagagtatgtgtagggagcatgtatatgtatttgaaggagggtaaggttatgtgaagtatgtgttgaattctggtgggatgaggcatgtgtgaattcatagcttctgcaggttttatgcagctggcctgagaaggttggagtgtctaatatatgcatttggagattgggagttggtgtgtctgtgcatttatttggatcatggaaggttgtagatgtgtatttctaactgtagatgattgaggatgcatatttggggagttttgagaggacgtgtatgtgtgtgtgtgtgcagtgtggtatttctctgtttttgagggtggggtatgcatccatcaaaatatctcagattatctgatgtaagaaaataattctgcatctcagtgacttccaacaaggtaggtttctcatgtatgttatgtgtcctccattggttggctttgatcagttactggtcctgtgtcttggatccagatggatggagcagcctcatttgggacaggactagaaggacttcttctgctcagagtcatatatggcatttctgctcacatttcatttgccataacaagtcatgtggccatactcgagttaaacagactagggatgtataatctctcagacagagataccacagagaaggaccatgaatactcttcatagtgatacatctgccccattgtgtatacattcagaacatgttccattgctgtgtttatatttcactaaggagtatggggagttgatgagggagtgtgtttaggtgtgtgaaggctggtgtgtgacgaggcattggcaggtgtgggatatttttatactaacacattttggggatttgtatctgttttgggtatttgtattctgtgtcatgtatatgtgttatatatttaagatatatatttatgtaggtaggttaagtattcagtggtgtcagaaatgtgtttttaggggaatatgggtgagtttttagtatattacagaagcatagtgggttttgggtttattctgagggtactggatagttatgtgttcctatttgaatggtgtgtgtgtatttgcatgctgggggtggttttgtgtattttgacggtactgtgagatattgtgaatatgtgtgcatacatttgaaaaggcaggtaatgttctatgttttaatgctttgtgttttggatttgtgtgtattcagagtagaggactttatgcttacggtgtctagatgagaatttagatgtacatttttggtgtgaagaatttggaggcagagagatggctgggtgtatttgggtgttaccactacatgtatgtaacctgaggatatggacagaatatttatagttttcaagatggaggcttgtgtatgtttgtatttgggagtatacggccatgtgtgtatttggatctgtgagtatatcgtgggtgtgttattcaagcatctgcatgtttgagtttgtgtaatctgaagagtgtgaatttattcaggaaatgtggtggctgtgcgtccactctagagctgtgagtgtgtggtctgtgcttctaccaggagagtataggataatttcctctttttttctatttttataacattttatgtaactcataaaacagtgtttgtataaaaattcacacaaagttgctagagagcatacgatttccaaaaatgtcctgggtttttcattacattaagtttttctaaggatgcactcaaatcaatggtaaaatgcagacattatgtgacacttcattatctttagcaaaactattctcactactttgtctcctcacagtattaactctgatacccactttgtgcagggtttgctagtactaggatgtcacaaaaccattaaggctggatctacaagaggcaaatatttccaaacagcagtaatagccccttggcccccacccccacttcatatatccatacagtctgtctacacagtgaggcagggtgcaagctcaccaccacttgggagtctcaagatcctccctctattgggtgagaagcaaacatttggggaaaatgttggaaactgaggccgtctctacaggaaaccacgtggccatgctctagtgtttttgggtcagcgacccttaccaattaaacggccactcagtacattcataactatcttcattctttaaaaacttactaacagagaaaccaatgaaccctaccacctactgtgacttactagttcagtcaacatcaaaacgtgtctgctaattttttagtccttgggatacaagacaaaaaaaaacaaacaagtaaaaaccaaagaatttagacagggggaaggaaagggattgccagtagatttcatggaacacattaaattttgaaaaaaatcagtattttctacttctcttccttcgtgtaaaaagtttaaaataaaaaaatgcccactggagccacctgtatggatggagaagtgaggacatgatatagacagggcacaggacctgcagtcgtttcctgacgacagtccagagggacaggaatagttcccaggatgtgtccatttctcttcacagaaagggactgtaacattttgaggcaagaagccctacacgtgaaaggtgttaagaaaatcatcactgaaatatggtttccaaaaattgagcatgctctaggttacaaacagacatatttaattcctagaacttgttgaacttctctgacatgggtagatgggaatttcaaaagagttattaataattgtggttctaaagttgcagggtcaacatttcaccctctagaaagcagggcaattcagggcttagagtcttcttgtttacatcatagaaaccagaacaaatttcatgggacccctcagccccaacaaccagcggccaggtggagagaaggccacagctgtctttgggtagggagcctgtgtgtgcatgctgtgtgcatgtgctggagagactaaggcatagagaagggcccaagcaatgaggtaaagtgagtctcctggctgcgctagtcccttctttccaggcacaaagaagttgaacttgttattcatgtaggcccccttcctctcacctcagcttttagtaagcagtgtgtgtgtgcacgagtagctgtgtgtgacagagtaagtccctgtgcctttctagatttcagcaattcaggtttgcagtttcaacagaaataatctgtaaatgacacgagcaaatttacaagttagattagcaactttacattgcttaaaatctgatattatatttttaaaaatgcctctgggtacaggcaaaattatgtcatatggccactggaactgaagtccttaccagctatgtgaagaatattcagattgtttctgttatctctgcattttaaagtagcaaaatactaagccattaggttattgaacctgtaatattcccacaggggttttatgtctaccccatgggattcaattaattttcctggaccctggttagactgtttcctttccctcttaggcatttggcccccaaagttaggtaggtaaaagtgtcatttttaaagattttacctgtcagggaatttcctggttggtgctcctggaaagcatgcagctggccggcgggagtctgacattctcagtcagtggggagagaagacatgtgtctcccaaagccaagaggtagccaggtggaggacagcaggactttctagggggtccaaggggaaagttctgagtggaccctgggaagggacatgggtgccccatctgagatgacctgtgtccttccaatgcctggtatccccaagaggggcccagacatggaccgccctggggaacgaggatgtggtgctgcctggaggagctaacactgaggtttggggaagtcaccacacagctcccagaacccagaatctctgacaagcaaccatgtgtggagagggaatggggacagtggaaggacacagctcaaatgaagacactgcggacatgtttccatggctttctacattcttcatcatcatcgagtgttctcctctacacagtgagcacaacattttacccacgtgcctgatggacaggccaagctgaatggaagccttctgaggcactggagcagaagggaaaacttgcacatggtcgcaaaggacttcacactgttccatcccctctactgccatccaagaggcctcttgactcttccagaatcagatgtaaaagacaagggcagtggcactgctcgtcgttgctggggatacattcgcagtgccacacctcctccaccttctccacggggtagacggcttccacctagtggcagatgagccgcagctgcgtagggtccagctgcttcttgttgcaagcccgaaaattgttgtactgcagctggaggttctcggcggtggaggagccccgcggcaaagttgcccacggagaggctctgctgcacgatcttgcacacctccttgtcggacagcaggtagggagagcgcaccgggaagctcagtgagggaccaccacctcatccaaggggatcttgcagaagtccttgctgctcctctcgggggcagcgggggaccctcagactcctctctgaacctctcaggattgattgcatagctcctcatgtctttacactcggggccagcacgtggaccttgcactgctgctggtaggagcgcctctgttcctgttccagtgcaggttgcccatgaactcaagggtccagacgcgattgtttttggtgcagaggtagagcaggtgcacttagtggcgaatgagcttgatgcaggacgggtccagctgcttcttgcccagggagtcgctgcagctgtgctgcttgtgcaggttgtcatgggtgaagagcttggggaataggggcaccagcaggcgcgaggtgaagttgccgatggacaggctgctctcgtagatactgtgaagatgctcgttgctgagcaggccgtcggcgccgggcacctccaagttgggctggggatctccaatttgaccaagtcgataggtaccagtcagatcttcttggagcggcaccgctcgcccttgaagctatcctccaccctgattactgagatgtcatcgggcaggctggaggagttgtagcagttgtcgcgtggggggctcgccttcgctgcctgcgtccagccccaggccctgaagcttgtcgttgatgcactgggcgcaccgctgcagccaggcctcctcctcctgcatgtgggggaagtagacctccgtgaagttgcagatgatctgcagcctctgcgggtccaggtcctgcttgccgccaggcctcctcctcctgcatgtgggggaagtagacctccgtgaagttgcagatgatctgcagcctctgcgggtccagctcctgcttgccgccgtccccgtagcagctgtcctgctcgcccagcttgcggtagtggaagagctcagggaagagccagtggaggaggaagacggcaaactcgcctgtgaagaggcttcatgcaggaactaagtgagggcctacatgtccaccacgtggtctgaggcgatggtgctgctccagtccagagacaggccctcctcctcgtctttgtggtccaggaagtggccggggtccactgctcagcctcaagctggcagcctggccaccgggctggctgttctccatctcccgctgggcccagaagtggctgaagaacttattcagctggggcaagcactcggcctgtcacacagccctctccttcaccgaggggtagtagacctccatgtagttgtggatgagctgcaggtgcagtgactccagcttaagcttggcctcaaagctgcaggcactgcagcctcgggagaagttgactgtggctgaagagcttggggaagagctgcaccagcgggcagcaggccaggaccccgcctgacaggctctg

SEQ ID NO: 4814 - DNA, 472 bp, Homo sapiens
ctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgc

SEQ ID NO: 4815 - DNA, 626 bp, Homo sapiens
agatgaacacactggacttatatacagctggacatgaaagtaaccaatttaagtgccttttccttcaacaattttaacttcagttgcttaaggatgatcgagccaccgatgtcaacaaaatatcctttacctttaaatagtttttctttaattaagtttaaagaaaacctatttaacgagtgatattaccgggaaagttcacacagaaacagaaagaggcaatattgtcctgaaaattcacctactgtatgtatttaaggaattagcttaagatgtaatttttgtcctcaaaaatagccattagttctcaaaactttcccttccagagacatctctcaggaatctaaaaacaaacaagcaaacaaacaaaaagacacaagctagacataaagctgcttctagttaatatacggcctagtctctgtgtgtatctacaggacgctaactctcaccctttgtcttttgcaggaaccaattttccattaaatactaaaggggacatttaaaaaatcacatagtacacaaatgaataaaacgcagttcagaattttatctttgttaaactgtcactgttatctcattgttctgttaacttttcaaataactctcttggaaacaaaaaaaac

SEQ ID NO: 4816 - DNA, 1158 bp, Homo sapiens
agacggaagtggagcgaggacaaaatggctgcgaaggttgttgctcccctcccccacccacgtccgaatcctcctttccatgccccaccttcgtgttccagacgggcctctaagtgccccgggtttcgcgaatctgtatttcatagcgtggctttggacaagggctgaccccgaggggctggggcgaaggttccggcttcagggtgccactagggctgctcgctcacggccccccaggattgggattggagggagccgccaggccgccgcggggtggggcgggttagctcggcaggcctcccagcacctgcatttccctacggcaactgtcgggaggcagcccccgacgcagaggtttaaggggcccggcttttcagaaccgcctcaggacgcggtcgtgtctggatccctccgcggaaaagaaggcgaaaccgcttctctgagccctgaccgttaggccccttcccacctccgtctagaacagattcggcttcttggctcagtccttccccaactagcccaagccctacatttccccgttgtttataaaataaacaggtttaaatggtggcgagtgtgttcttggttaggtgaaccaggcattaggaatcataggttccagtagccgtgcgtccttgatttagactttctgaacgtttgtattttcagtaacatgaggtgatatctttcctggtttgactttcatcaaaaattaaacgacagaccataccgacgctttgaaaacgtgactgagctggtgcacaaaacaatggtgcctagaattttgaattgtgcaatgttgtgcatggccgcggatatgtggggccttgtggttccaagagcctgtctcaggtgtaccggccctcatcactgggcttcagaggttcaatctgcaaggaggcatctcctgccaggaaattggaagcaaaggccactcggcccttctgttcctcagtcaagttattgtagacatgacgactggagtaagtgatcacctgtgggatagaccgaggcagagtcaagcagcgtaactctcagcctgcctttcctgatggtgtgaagaagaggaaagggagtactcccagtggcacaaagtagtcaagcctggggctgagagtccaagagacctctgttctaaataaaagttaaaaatacagt

SEQ ID NO: 4817 - DNA, 2226 bp, Homo sapiens
gattttccattttttttattctagtactacagtttacagccattagatgataaacaataaaacatcactttttagaaaatccatatccaaagccaacctcaagtacacagtaatttaagttaaatccactttttaaaaaaatttcctaataggtttggtacttaatttttctgttttacacacataactggaacttgtaaatgggcaactaccttcttatatgtggaattatagttttttcttgtcctttcccccaaaccacatatattaaatcatgggacattatatatcaaccctcacctaggctttgggttattctataaggaaaagcctttgtcagagtttggctgtctccttcctttcccattcccacaaaagatgtgtgactaagtggacaaagaactcagcactgggcctgtttaagactctgaccatattctccagaagattctgatggatgttttcttctacatatcttataactttgcacctatagagaagcatgttttagaaggtaaagcacttggggctttatataatagaatttaaacgcatgctatgtgtaggttttagaaagttcaatttcggtatttgatcactccttccaaatgctcgtagaaaaggcaacccatcaccacaaaaggttgatgaagagaagaatacagtaggagctttgtttatataggtgcaaattataagaattaaaataagttcaagagcacaggatcttccacttccatgaagttggtctaaacatatgttctttggacttaattttggttcaagtccaatctgtgcagggacctatataagcacacatggaatctatcttacactcttaattctggttttgccaagaaaaagataaagaattttaagagctggaagcgaaggggttatctgtgtccccaccaaagcagctgaaatgctgcaaagcataccagaatgaaaaaaagagaaaaaaacccaagtattttgtcaggaccttttgaaggaatgaaggcttatgtaaagcctgtctcttcaaatcaaaaatcatcttaaaaaatcaaactgtttataggattatttacaatgttaaagcctagaaagggttagtctgtggtcacttagaaacagaagccctgctaatattgcttgtggatatctactgggaatctatttttgtactaaataataataaagaatataagtttatcatttacttcctattctgaaatgtttttctaataattcaattattagcttcccagaacctttagcaaatccccatctgaacaaaaagtaacagaaactcttaagtaaatgtttccaggtaagaaatgacaggccaggcagaatatcatcattcatgtctataccctgtcctttttactccaatataagaaaagcaggatacgaaaaatgggtactgcatcattttttgttaataggagaggagtgtttttattagaattgttctctctgaactgcctaagtaggaagcggaattgcaggaaaacggcagaggtagaagatgacaaacatgaggagggtttccccaggcgtccacattattatgttatcataggttacctaattactaactttatttctatgtattttaaagaaatataagaaatcacccattaatccattcattcatatatctactgaatgaatgcttgtatattcaaggcactgcgacagatctaatacgggaacttaaaagattcgttaactaatctcagggagcttacactcgcatcggaggagacatatataaagagttaaaaggtacagtagacagtgagaagtgccataagcagtatagatagatatgagtatgaagctatgggagttcccagaaagacagatcatttctagctgcaaagaggtatcagaggaaactctggggaggtggcatttgagcctaaacttaaaaatgtatctgacgaataagggagtgggaagaattaggacatttctaattggtggaactattgggaaagaaataaatgggaaaaatgggaagtacagggaccagcagtttagttttgctcaagtgcaagaagggtgacaaacaggtgttaagggtagaaacatcaaatgaccttgggtaccacgtcacattcatccttgaagactcagccatttctcttggctgctaagttgccagagagaaaatggtggtttcacataagcacagaaagagagtagcataggaagaagatgtgctttgggcag

SEQ ID NO: 4818 - DNA, 2743 bp, Homo sapiens
atcgaatcacctcccttgaggtccctcccccaacatgtggggattataattcagattaaaattgaagatgagattttaggtggagcacagccaaaccatatcagagccattctctatcttttgcagattggaaaaataaaaaaattagtttaaaccacagcatttaaaagaaatggtcatagatgatgttaacatcagaatggaggttgtgtggagttcccctccttggaggttctgagctacagcctagcctggactcagtccagttacaatctaacatggctagggggaggagggagcatgatggggcagggcttgtgtggctgggacagctggctatggtcgtggtgctggtgactaaatggtacttgaaatttcttttagatctaaaattctgtgatatggtttggatctgagaccccaccaaatttcgtgttgaaatgtaatccccaatgctggtgggaggtgattggatcatgggggtagatttctcatgaatggtttagcaccattctcttggtgctgttctcatgatagtgagtgagttctcatgagttctggttgtttaaaagtgtgcagcatctccctgacccctcttgcgccagctcccaccatgggagatgcctcgctccccctttgctttttgccatgagaggaagcttcctgagggctctccagaagcagaatctactacacttctcatacagcctgcagaaccatgagccaattaaacctctttttaaaaacacttttattttaagttcaggggtacatgtgcaggatgtgcaggttcgttccataggtaaacatgcgtcatggggtttgttatgcagattatttcatcacctagatattaagtctagtatccattagttatttttcctgatcctctccctcctcccaccctgcaccctctgataggcctcagtgtgtattgttaccctccacatgtccatgtgttctcatgatttagctcccacttataagtgagaacatgcagtttttgtaaacctgttttctttagggaaagtttagaattttctagagactggttgtatggttgtgaccaaaatgccagtagtgatatggacagtgaaggccaggctgaggaggtgatggaaatgaggaacttactgggaactggagcaaaggtcacttttgttatgctttagcaaagaacttggctgcattgtgctcctggcctagggacctgtggaagtttgaacttgagagtgatgattttagggtatctggcagaaaaaatttctaagcagcaaagcattcaagatgcgccctggctgctttcaacaacctatgctcatatttgtgagcaaagaaattatgttaagttggaacttatatttacaggggaagcagagcgtaaaagtttggagaatttgcagccagctatgtggtagaaaagaagagcccgttttcagggaaggaattcaagcaggctgcagaaatttgcataagtaaaaaggagccaagtgctaatggccaagaaaatggggaaaaggccttgaaggcatttcagagacctttgtggcagcccctcccatcacagactcagaggcctaggaggacagaatgactctgagtattaaagtagatttaatctaaatcataaagtacaagctagagcaatccctccagtgctgcagaaactgcctgcatgtggctcccacattgtttcttggagctttggtggtggtaggggtggcaggggcaggtgttatgtttcttggtttctcaccttcaggtctccttacccatgtttcctttgtcagagtcattggccttgatggaggggagactgggttactctgagttgagaagcaagcttgactgccctgtggtttatatcagcctagcttagtttgttttctgaagtcttcacaaataaccaaatatccagcccagtgcagttctcaatgagtagtctccagttcccatcccccaccacacacacacaccaaacactgtgcccacctgggagacccattttcatttatcttcttctttgagtgcctggaaggctgaacatttgatcttttcaaacatttttctctcatctggcctgttagcgctcttgagcctttgaaaatgccatttcctctacatactattcttcctcagagcagccctctgtttttttttccaaccagtcttttctcttgcaaagttcagatcaaaattcttctttatgtaaagagaagtggcgtgccataggggttacaaacagggcttcaaggttagcactgggatcaaattccgactttgcaacttaactttcttgagtaagttgctacacctctattagcctcagtttcttatctgtaaaatgggacggctaagtacctatttcattgggctgttgaataatgatggtctcatctatgcaagggcttagtaccagctgggtgaaactcagtgaatggcaggcaaccctattatgactaggcttctgccaatgatcagacttgaaccctgtgctcatccccccatcactttgtggaactagatgtcctacgttgcacatggcttgattcatggtttggagttgttttctggttgtttcctgtgtgcaggtttaatctcaacctgtgatcccttgaaagctgcaattttatccctccccgtcctcctccctctcaccccaaggccaagtttaatactgtgcattctgaaatcttgcaatgttgatgatgtaaaataaatcttctctcctgtgtttctgaag

SEQ ID NO: 4819 - DNA, 2477 bp, Homo sapiens
ggtacccaccaccatgcaacctccgcctcctgggttcaggtgattctcctgcctcagcgtcccgagtaactgggattacgggaacccaccaccatgcctggctaatttttgtatttttagtagagacggggtttcaccatgttggccaggctggtctcgaactcctgacttcaggtgatatcctttcatcctattaaacggaatcaccatgtgacctagcaaatccactcctaaggcatatatcccccaaaaccaaaaacagctactcaaatggatacaagaaagaagccagacacaaagggcacatactttattaattatattgacacaacatgtccatgacaggcaaatccatatgatagtaagtaaattagcagatgccaagttgggtggaatgggaagtaggaagtggctgctagtggattcagggtttcttgtaagcgtgataagaatgctgtggaattagatagtggtaatggctggacaactttctgaatacagactatccctgacttaagataattcaacctaacaattttttttagcttatgatggtgcaaaagccatatgcattcagtagaaattgtacttcaaattttgattcaaaattcattatcaacattataaaactggctttgcgttacattattttgtccaattgtaagctaatataagtgtcccgagcatgtttaaggtaggctaggctaagaaagatgtttggtaagttaggtgttattaaatgcattccaacttaacaatattttcgactcacaatggctttcaggacataattctattgtaagtcaaggagcatctgtacacacacaaaaaatgggattgtatactttaaagatgaattttatcatatgtgaattatatgtcaatacaatcaatagataaatgtatacatgcatatagacaagcatgcatctatacaacggaccatagaactaaatggaaaacctaaaactaccaaacatctagaagagaacaggggaaaatcttcacagctttgaggtggtaataatttctcaggtaagacacaaaaaaaagtataaatcggccgggcgcggtggctcacgcctgtaatcccagcactttgggaggctgaggcagacagatcacaaggtcaggagatcgagaccatcctggctaacacggtgaaaccctgtctctagtaaaaatacaaaaaattagccgggcgtggtggcgggcacctgtagtcccagctactcgggaggctgaggcaggagaatggtgtgaaactgggaagtggagcttgcagtgagctgagatggcaccactgcactccagcctgggcgacaagagtgagactccatctcaaaaaaataaaaataaaaataaagaaagaaaagaatacaaaacataaaaagaaaaattgatgaagcagacttcatcaaaattaaaaacttctgttcttttgaagccattattaagaaatgagaagacaagattgggagaaaatatctgcaaaacacttatccgataaagaactagtatacccaacacagattaaaaagttatgactagatcataagaaaacaacccaattttaaaaaatggacagatttggaaagtcactttaccaaagaagatatacagatggcaaattaagcacagagaaagctgctcaatatcatcagtaagtcatgaaaactatgtactaggaattaaactcattaggaattaaaactacaaagtctaaccttttaaaatcactaaaaacaaaaccaaacaaaacttatgagacttaagtgttggtgaggatgcaaagcatttgcaactctcatacattgctagtggaaatgaaaaatggtacagccactttggaaaacagtttggcagtttcttatacagttaaacatacatttaccataccatatgacccaacaatctcatccctaggtgtttatccctccaaaatgaaaatatatttgtctagacaaaatcctgtatgcaaacgtttctatcagctttattcataattgccaaaaactggatacaacccagatgtccatcagccagtgaatggacataatggacattatgctaaaatcaaagaatccagactgaaaaggctacttagtgtatgattctacttatatgacagtctgaaaaagacacaactgtcagaaaatagatcagtggtatgccagggtttggcaataaggaggaggactgacaaatgaacatgaaggaactttttggagtgactgtgattatatggccgtatacatttgtcagccatataatactgtacacataaaaagggtgaattttactatatataaattatatctcagcaaacctgactaaacaaattgtatcttcaaggccaatacagtaggataaagctaaaataactataatagtgtgagaacagctggacacagtggctcatgcctgtaatcccagcactttggaaggacaagtggtaggactgcttgagtccagga

SEQ ID NO: 4820 - DNA, 1614 bp, Homo sapiens
ctaccttaatttgataatttcctcacaattaccagatttcattttttaaaacagaggagctatttatcttttcagtgtgataagtattctattatagaacattgtttgcctttgttcggaggtgcagagaagaaaacagtgattcatttggcaattctgacaaaatccaaagatgtatacaattacttcattcatttagaaaatattataggaactataatattctggacactatattaaatagtaaagaaagatcaatagacacaacctctgccctcaagaacttatagcctgtggagatacatcaatgaagccttcaaaaatttcaaaacagaaagcttaatctttagaaataaatagaatgtgtcttaaatattatgctgggtgggagaaagaagtaggaattataaagtttaacaaaattgttttattgacatgattctgtaatttggcaactcacattcaggtctcttactgctaaccacagcatctagcagcagtcctgaaatactgacacatttcaagacaattttttactaactctaccatttgaaagatcaataaacactaaggtgttcttgtgatgtctcttattcaaaagtcatattccatcccagtgtagttcccaaacattttcaagtcacatttctaaatctttaatcttccataacatatctggaatgaaaacaagcaaaaagtggtttccgacagccattgataaaaactggtgttgaaggataaggaattatttgtggagatggtaagattacacctcagaagagagtacatgaagacacggtaaaattacaagagaataacattagaaacaaacctcagcaaaataacttggctctatgatagggcttgagttagaagtcaaagattatacatactctaggaaagccccaagtttgattctgatacaagaagggtagaaagtggagatgggagcaaataatgtctgttataatgacagattacctaggaaatattggcctaaaactacttttaaattctaacttttagactgacacatcctttagagttaccactgtgaaaaacgaaactcttcaataaatgatcaacatattttgcaaatatattttgaagcataaggaactccataattttaaaatattaaccaatctggtcaagactacctaatagtctttttacagtattactgtttattttagaaactatttttcctcatcgtcaattatatgagaagtcaccatgaaagcaaaaaggaaatctacttttaattgaatggtgactgtaagccttttaggttacatgtacctaaatactatgcaataacaggaatttatcatttattttccttccttccaataccactttcctcaaaatatgcttctgcacaagatttccccatattgctacctagaaatctaacaatgaagggaaatattatacttaaacagaagaatgtcagaaaagaatactgatcatgagagaagtataaaaagtaagtctgatttgggggtcacgatgaaaacatttgtatttaaaaaaaggaaaatatttgcattaaaagccactttaaagcagactttaggcaaattaaacatgttgcatcctatgtcacaaaaa

SEQ ID NO: 4821 - DNA, 2967 bp, Homo sapiens
atcgagctacaaggttctagactaagtaagtgttttgtatacatattagctccatattacctccatgacctctttccccatgaagccttccctgagcctcagtatccactctttcctgtaccatgaatccatttttcttttactttttcttttctttctttcttttctctctctctcgcttgctctttctttctttctctctctgtctttctttttttgttttttgttttttgttttttgttttttgagacagggtctcactctggcacccaggctggagtgcagtggcacaatcatggttcactgcagccttgacctcacaggctcaaaccatcctcctgcattagcctcccaagtagcttggaccacaggcatgcaccaccatgcccagataatttttttttttattttttgtagagacggggtctcactatgtcacccaaactggtcttgaattcctgggctcaagtgattctcccacctcagcctcccaaagtgctgggattacaagtgtgagccactgcacccagcccatgttttcaataaagatggtgctatttgaaactatggcatgtcacgtgtatattattttatttcaccatgtgtttaaatgagataaccaggtgccaagaaagcttcaatatttgcttaaatagccaatgtgacggagaataggtaacctcttttctttttttttcttatgatttgctttggctattagttttgaaacatacatgttatattcccaattagatctcgttacatccttcacaggctgtccaaaaatttccatacttctaacaagaacttcggttgactgagtttatattatatagtttttctgtcctttgccctatttctttcaaggcctttgagtcagaagcattcagcaccacggcgtacgatagccaccatttgctttgcccttttaactttgggggttacttctgaccatagtccaactgctcagaagggctttttcacaaattgtttaccgtggcagttgctaccctattggggtttgcattcagaacccataagcagagagcaatggtgtcagtataacaaataatgtgtacaattttttaaaatgctgaatttaccaaatccccatattatgttttcacactgctctttcagaaactgtgctaatacaatactcctataaactgatcttggtcctggcaggccctgttggaactaatggggcctgacagttcttcagttaaaaattatacatgagggccactttcccttaaattatctattgtatgccagctgttcacaactgcactgcttcactttctttgcagtgctagaaatgtctaattttctcataatatccatagcaactattctcatggagggcattgaagttagtaagacttcaaacacaccttcacagaaatcatgctagagttgcagtttccattttctttaattttttggttctgaaaaatgtttagatggctcattttgccggtttcatgccatagcacttgagttatatcataatttctcatttgctgcacaactttattctatttttatgctcctaaatgacgcagctctaagtacccgtgagtggcacttccgtgctgtgagtgctatcaaaggcaacctcagatggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtggtggtaggccctgtaatagctagcgtaggaagggtggtgaaaattgatatgcactattactacacgtataaaacttaacactggggccattgcacaggtggggggttcctgtttattgatttttatgagtttgttagaacatgcgcttaatgcttttatactccgggagctctgggagggctcaccttaggtaataaacctttccgtactttgcaatcgctcacaatttacatggggactcacattatccagtacaaagcccagcattccccttctacttggttttaggagtgtgat

SEQ ID NO: 4822 - DNA, 2614 bp, Homo sapiens
ttatatttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttgaaaaagagtgaggcagtttgattctgtttctctgagtgaatagtgagactaagtggggtgtaaggatgtttcatcctcaaaatttattttttctttcattactatgtcagtttgaaaaagaaaataaaaaatggttgttgatcctgaagaaactaatcctagaatgtgctacatctttgagagtttggaaagagacagttaacatacaacccttcaaaacagtggaatttggtaaaccctggaacactgttcttgctgatctaattcatgacattaaggccttcctcggccttatgaggaagcagatgaaaataatccttttgcgatgactattttcccccttttctgatttaactcttccattgcctaagactcaccaattctcaaacttctaaattctccacactgccttatctctgccatcccatggcaagtcctaaagctgctaacattttgtaacaactatgtgacaaattgttgtgcttttattcaggtcggacatctttgccaggcttgcttgttgtgttttctgtttggctgtgtcatgggaccaaaggtgcctgcctttgtacagcatgtcaaatctggttaacatgcagccatttatctttaaaaccactcctgcacaatggcagaggtgggccaagccacagggctctaagcacaacccaatttttcagaccatcttttctgcatatagggagcacgttggacagcagacaagacattttgtgatttggggaatctcttagagacaaattgtagagtgcaagtgcagtgtaactggactgctgggtgcccagtgaagtgaggaaaatcagatacagcacaggctgaaagaatgaagcaagaattcatatctctgtgcagaacatgcacagtactttgctcacacagagagttcacacatagacaaaagcatgtttgcttgtgggttattttcaggggattctatagccacagtctaggcgtatatatttgcacgtaagctttctttctgcattttgtactggtaggtgtgtctacatgtgaacatgtaaacatgcttatatgagaagacaatttgctgttgctgatttaagacacgggaaaggcctcctagttcactgaggcgtttccctcctaatgtagtagaagcagaatctttttgttttctacaattgttttaataaaggactctgtgtgtgtttaaggaagactcagagccagagtgtcaagtgctgcagtgaaaaatactgaagatttttctttccataagacagctgcaaactttataacccagttcactctgggttttcatttctcaattgtttcaaggtgtcttgggaatgatttgcccttaaataactagttatcaacaaaggagaaaaaatagcaataaaaaatgtgataaacctgcatagactagtttaactaaaatgaagaatttccttgcttggagcagttcaaggaccgaacatagcaaaactgtgtgatttaaatgaaatattcagagtggtcaacataaatacacatgtagacaagagatagtatatgtgtgtgtgtatacactgaggttacttcttgaagaaataggcattttttcctttctttttgctttttctttcttttctttttctgagtaaaggaccccagagattgtctttcactttgaaaacaatctctaatatcaggaaaatgcgctgtttgtttatgcgtacataatgcaagtttgtccgcctgggaactgcagcaaatgggagaagtatgcatggatttcacaggtaacaggattacgtgggcacataattgatccatttggagaaaaaaaatgacagtgctctaaagatgcctaggctttggagatggagtttatgaaacaggcatttgtaaattcaaaggaatcaatatgtcaattttattacatctcagaaccagctgggcattaaaggaacagtagccttaaaaaaaattacagctgcatattcctacgttgtctacctttcttaaaggccctagaatttaaggaaatgaacttagagatgtgtaccttttcagaaatgaatttacattgtccaaagagaacaacaatttaacattatgtcagttatcaacctaaaaatttgattgaaatgtctgccttatcattacaattgaagtctattaatagatacagataataagcagaatagtgattttcacataggttgcactgtcaaggattcattggaattcatatttgcattgtgcttttcaacagtctagattttacctcttcactgatgataggacata

SEQ ID NO: 4823 - DNA, 7481 bp, Homo sapiens
cgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcactgaaatc

SEQ ID NO: 4824 - DNA, 2614 bp, Homo sapiens
gaaaacaattctaatcaaagaacttctattaagtaaaacaagacaaaatgtgtgtaaaaatatgcctaacacatagatttccttgattgtattttctactgaactattttcaagtattcagctttatactaatatattaatctcaaaatacctttgtttcattgttgctactccttaaacttttttctttattatctagatctagtaaagttttctgcattcattgtattaatgttggttcaaaagtaattgcgtcctttgtcgttatataaattgttttataaatggctttaactatgacataagccttttaacataatcagctttctttaaaggaggaagtcagatgagtagagaaggaaagttatattcctttacaaatgctcttaattttaatgtcttaagggaattatagagacttccattattctgccttaaataagggatgttacttcagttttcttgtcatggctccctgcatgggcagtcatgttaacaagagtcagggagatagcagatattccataatagtgactgcagataggccagtcaaagtcattttgttttaaaggaagggaggttgctggtagttaggtgggaaaataacacctgtgaaaaggaagtccaagtcactggctcagggactttggaggcattttcatatcatattcactagtcaagaaacgtgtagattatatgtgtgagtgacatagtctgtttcaaagtattagaaaagagacaatagaatcacccaccctcccttcgacacacacttccttatgtaaaatcagaatcaaataattatcattcctaaccctcacagtgaaggatttggtttcatgtaacaatgaaagtagataatgggtcagacatggaaatagcaataaaagggaattacaacaagataaatgtgagtaatagttcattttcctgcatttttgatgagggccatgaagataggtcatggtaatctatggagaaggtccttaagagcatagaacaatataaatataatatgggccatatatataattttaaaattttctacagccaaatgttaaaaagtaaaaaacaattttaataatccagtagctccaaaatattattttaatatgtaatccaatatattgaagttataagatattttacattctttttttgatatctgatgtatattttacactttcatcacatctccattcagaccggctacaatttgatcagttgtcacatgtggatgactagtggctatgataatggacagcataggtttagacaatgcctattcaactattcaacttgttttacatttataaatctcaaaatgcctttatttcattgttggtactcttttttattacccagatacaataaagttttccaagtttcattgtacacatgaaatgagtttactgtggaaatgaaaatgcagagtaagtccaacagctagtttatcatcctgaacccagtgaagaaatcaaagctgaataaaagcgactcctagttgttactctcaagggcaggtataatttatgtgcaagactttgtagcataatgttttgcaagtagtggatgttcaatatctacaataaatgaattgtagtactatattgcttgaaggaagtttataacctgtctagaacaactttctcaattttacaactaaactaggagatccagggcttaaatcatgattgaactgattattcctgttaaatttatgtgtgaaccatatgtgaacattctttgaaaatgtatgataagcatttcaagatttctgttttaattattaacatttagaattctaggaaatcttttgggatacagagaacttatttcttccaactgttgcttcagacgctgataagattgtagaagatagggaagctgtagtttactatctagttttttaatgcacatgaagtaatttaaaatgctcttcttcctttcttgtcacatacttttaaaaaattctctaaagattgaataattttaagtatttcttaactgggcaaaatggaaactttgtaactgaagccagtcaaggtgaatacacagaaaatcattttcttattaaggtcagttaatgggataaaccgttttaagagagttgagaaaaaataaagttctattttaaatttatacatgtaactttaataaaaactaagtcagacaaaatttaacaaaactaaattgccttcttactgcttccatagtcagtctcgagttatcttgattttaacctactcttattttctagatcttcatttcaaatattctcactatatatgtgtatacagtgtgtatatttgtgtgtagaagtgtgtgtgtgaatgcaacaggcttttaaaccaaacttaatttctaaattgtagttttaaatatgtcccagccttctgtaactgagacacaaagccaaatgcttatgtttttagagttatattgcttaggtgtcataatttcactaagaccaacttgaactgattccacttttgaaatctctgcccttattttatttccattgtctgtctcctcagggtcaagatcttgtggctgggactatcttgagtctcctataaaaactattcttgccgggcgcggtggctcacgcctg

SEQ ID NO: 4825 - DNA, 2358 bp, Homo sapiens
gaaccccagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaaggttgggaagccctgggacattgaagttacaactggacgataaaaacagagttttttccttgtgacgtgaccactgtgatgtaaagctgtatctccttcatttcatcaagaaattcttaaaattctcccccaacgtgctttcatctttcccttcattgccaactctgtaagaagtaccacgccttttctttgaatctgattctcctccaagaagcaatgcttctctgaggctttcacctttgctcacatcaaagcccccacactgaataaataccatccttacatgcccttccagagactccactaatggacgagcttcatccagcaaaagataactggggaaacttcagcaaaaggactgttgatgaaaatttgctgtatttgattatatagctaagactaaaacagggaacatggttggaattatactaagtaaatatgatatgttctcacaaagtagaaagaatgcaactaactaatatagaagaagagggaaagtaaaatagtattgtttacaattttataggtattgggtgtgagttaaattataccacttaaaatgaacagaacagacagtaaaaagtgaagtaagaaaaaaggacagaggtatcataaaagatacaaattcagaggtattgaaatacttatgcatcaaaacaactatggcaaaattttactgattcagtattatgcctatgaaaattattcagttcagtgatttggagaagagggtaaagaaatgtttacacatcagaatctgtggaggggagaatgtgtgtctggaaagaaaatggtattttgtctcattggtttgatttgtttttagttataatatttcatctattttgaattttataaaaataacagtaatgtatgtgatttttatgctgatgaagagaaaatggattcaaaaaggttaagaaacactaatccaagggagcctccagaataattgtggccatctgaatttgaacctcctcacagaacccttaaattcaacaggagcacaagataatcacccatggtccatgccttcagcgttagtggaagatggaggataccgcaaatgttaagtgaccaataagtagagaaacaaacaccatattcccaatgaactcccatcacttatacccactgtaagctgtgtgcagagagtgggagagagaagacttaaaatccccaggaaaaagaggaaagaggcagagaaaacttagacatagcataaacaaaatcacctccagaaagtaaaagtttcactgctaagtgacacattcacagcacagttaaagggaaggggattgaaaataagcagaaccagaagtagcagcttcaaaggagcattgcttcttggggagaatcacataaactaagaaacagtagtgctccttagagacttgatagtgatgagaaagaaggagctaagagggaaaaatagaggatcttgcagaaattagagagaaataagacataatggcccactatcccattactacccatttctgcactgcactgacaggagaggatattcctgaattaagaacctgtccaaaaaattttaaaataaattttaaaaagcaacctaattccaaaaagagctactattagaagaacacatacacacacaaatgcgaatcattacagtttaactgatgagaattcttaaccaaaaccaaccaaagagcagaagaaaactgtaacccaacattccaaactgaagtagttatcttcaaacaatgggacgtatttagaaaaaaaaaaaaacccagaaacagaaatttgataactaaggccatagtgggcacaaaataggaagacatgcaatgagttgattgagctatggaatgaaattcaagaaaaatacaaaatcatttcaaaaatgaagaatagattacaaggtagtgagggatagtagatttgaacattgaacaatttcaacattgaaaaggggcagtaaaataacgaagggaataaagaaggatgtaaacagggttaaacacaagtgattggaatggaggatgggcaaataggatccaacatacatatgataggagctcctggagaagaaaaacaaagcaatggaatggaactgtaattcaagaaaactttccagaaagaagagaaaatataatgtatgtattgaagaggcccactctatatctagaaaaactgacctagagagaataactgaga

SEQ ID NO: 4826 - DNA, 605 bp, Homo sapiens
cattctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggatagaaccagtgggcctcctgcatttggtcgctttgtgtaatgagaatcgggggaagaaaccacca

SEQ ID NO: 4827 - DNA, 3848 bp, Homo sapiens
cgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagctgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccaaccctggtgtcggtgtgtgtcgttggcgacgcgctgtctttgagcccccgccgagcttcctcgtggcgccgggggtcaatctgcagcgctagagcatgtgcttgcgcataactggggccgcctggcctcccgcgggcggcctttttaaccgcgagcgacaagaagtaacctgactgtccggctgctaggctgggcaattttccagctgttttgccacgacaggcctcaatccgtaataccaaggctggaatggcgtgttaggggggcggtggctgacggggatacgcggactcttgatgcgtaaggagtgcccctctgctcccatacgttccccagcccagccttccctgagtgtatcgcgcgcgctgtgccttcgccgtgagttcgacataagtcccaggctgtcgcgtctgccatcagacgcgcagatttagttgaaggcagcgtggaatggcgtctgcagggctgttgtgtacttgacataaacagattcggtgtggaactgcattgagttaactcctgactaaagggtaatcgacctgtttacaaataaccatgcaggagtactgacaagcatgggactaaagctttgggcaggttaatctgtcactcctaaacagttcaaaattatagggcggttgtgaaggtgaattagattttatatatggttggggacaacatagacacctagttacacagtccagattcagtgattggtaaaagatcttccacaagggctccagtgaaaggtgcatcagttctgagtacagggcagcaatggtgggcaaggatgcacgtatgcgttcactacatggacattcgatgaatgaaggtgtcccgaattaacattatactagacaatgaagggtgtaaactgcagcccaggagcaccactgccctaccccctcagttacgaactttcactggattctttaaatgtgggctgaagataatggcacatagtttgaaggatgtagtgaggatggctttgtagccttaggactgggcagtgatcaacgcagtaaatgaaagctgcgattgccaggtgagggccccggtgctctgtactcattttattgtgcccctatctgaacaggattccgtagaaatgacttagatgcttatctagtatttgacattgagatatttattttgtgaaacaatgcaagcgattttaaatccccacatactatttgattaagtgcaacatggtacagtcatgtgtaatctctttacacgatagtgcatctagtccttagcctttagttattgcacaacaattataaagaccagtgaccaggacacgtggactctgacaggcagatcggcctacacaacgaaaaatcagaacagtacaccaactggaatggtcaaacaatttaagtcaaatgttttaatggtgcaattaaaataagggttcaaacatgttttcaatatattaatttctttaaagtcatgttcaggcaaggtgctgtttaaaaaaccactattagctttgtccacacatgtaagttatcaaaagttacccaaggtaattttgacgttgaatgcagctttaaacaataaaaaaatggtattaggtttacttctcgaagcaaagagagcccccaaccttgtaaactaaacattctgacacaaatgcacaaaattaagttggcaacattaattttgagatgtagtgtgatgctgagcaaacttttggtcttgactcttgaaataattaaagagagcagttctccgttttggccttcaggaagggaaatctgcccatggaactctcccaatcagattaacaaactgtttcgattcccatataaacctggaggacacaggaaacgccagatggaaaaactggctctggctttctaaccccatcccatctgtatgagaggacccatcctgtcatgtgcagtgtttgatgttttcacatacgctcctgtctcaggaaaacattcaagattagctagcccccaggtggttgtacctcattggtgaaaggcttgggatggtttgatctcatggctttgcctgatgttcacataaatcccactgtccttacccaagctgatagcgtgttgtgtgtgtactatggctacttgcttcccaaatgcacaatttaatgtggaaaataagttgctctgcccatctcttctgtcaccgaaatgaaaaggctcacagaattcctctccccaccctccagacacattgcacactgacattctctggaagtgtggaaggccgcatacaaagtatagaagtgaaaaagtccactgtgcaccggctgcctgaagaaaagctttggaggagtagaggaggcaagttgttcagctttgctcttactgtgctcatttgctgccacaaacatgggtagacttttaaaagccatggtgtgggtcacgtataacttctggatccaccatgattcttccatggtctcctttgccaaatcaaagctttgcagcaggcaatccagacagttgtcactagatgcagggaatgacacctcacagtggaatgggcactggcaggcagagggcagaagcagtcctttaagaaacagtagctgtggcacagaggccagtgctacagtacagatggcggccaagaaccccacacatccagctcgatgtcacaatatggggaacatctgacatcacccatcatggctgatcagcagcctccacaggtgggtctttcaggaggcaggaagtagagcgagggtccatggctgagtgcattatagtgatataaacatcatccatgtttggcatgacaaaaactttctgtaggaagatattaaagaacagctatgtggaagaatgccttgccaggctgtcaccctcctttgttctgataattttagggcttagactgatttttaaaagtacatataaaaacttgctatgcattccaaactaattctcccaccatacatactttagaaagagttgaggaatcataccagcgcatggatacgagaatcctctaatatatcagctcggaggcagaagtggcctttgattttgtatacatataataaggttgcccatatgcactgatatatatccaacaatttaagagaattggcttaagctgttcacagtagttcccagttactatgtctagaacacatattccatgtgaattatccttttattaataaatcctagcgataaaatgtaagctaatggccaggtgcgatggttcacgcctgtaatcccagtactttgggaggccaaggcaggcagatcatctgaggtccagagttcaagaccagcctggccaacatggtgaaaccctgtctcaactaaaaataccaaaaaattaggccaggcatggtagctcacacctgtaatcccagcactttgggaggccgaggtgggcagatcacgaggttaggagatcgagaccatcctggctaatacagtgaaacccccatctctactaaaaatacaaaaaattagctgggtgtggtggcgggtgcctgtagtccca

SEQ ID NO: 4828 - DNA, 4012 bp, Homo sapiens
ttggcaccgtgtttctgactcctgcagatgcctcttcccaagcagttgttcctttgagtagtcagtctcatggttctaatcgtggcgagagcggatctgaccacttccatgtgcctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactgggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctatttta

SEQ ID NO: 4829 - DNA, 711 bp, Homo sapiens
gtcataacttatccgtcacttaccatatccgccgggacattactggacatcttgccgtttgatatacacccagatgtttacgaaaaaaacaaacaaagaaaaaagagcagaagtcttcacgttacagaaataaaccacgattttgactggttcgtgatgtgctttctcccccaaaaataaagttattttggagccaaagtgccggtcaggccgaggttctggttcgaagaggaacaatccccaggagctgtgtggccggagcaggaggaaactcccgggacagcagaggcagcccccgtcgtcgtcgtcgtcgtcaacagcagcagcagccccaggaccggccgcgccaggtggaccgagccgagtgacacacggacatggagaggggtgggagggggttaaatgcgccttcctcctttcccagccccggcaatgattcacacttgctcccgagtcaagtcctcattaagcaggagaaaaatgccccagcgtggatgtacacagataactatgtagctacacatcgacgcgtgagccttgagtggcggccgagcggtggccggacgctggccgcggaccctgcagagccgctgtcggagcgcccgcgcggacagcgcggggaaacggctcaactcgcgccgcgggggcgaagagccgggccgcggaaacccgcgctcaagggcatttaactagttggaagccaaagcgaaa

SEQ ID NO: 4830 - DNA, 1664 bp, Homo sapiens
gtctgggaagcttgcttggctgggccgggacggactcgacagggcgcggaagggagcggtgggcgcgccctgggaggcgagcgcgtcgcagcctcaccttggacaccattttcttgagctggctctccgacaccgccatgacggccgcctggcgactcccttccccgcaggcagagggtcagccgctgctgggctgccccagaccgtcccacacaatcgcacacccccaacccggcctcaaacaacaggaagtcggcaccactacaccacttccgcttccactacgtcacttccgggccgccgtcctgcgggcaagggtggacaccgtgtgggattgagaggggcctggtggggtgggttccaaccaacccgcccctcgagtgccggaatcagcaggacgaatcgggtcccaaagatgtgggcaagactgttccgagggtcgaaactctggttcaggataagattagcaggtatttcacagagtcgacttaaggaagctagtgccggagagggaagaagtacgaagggcttgccagtgagccttaatgactgattgatcaagtgggagggcactgcactggcggtcagagaactgttctgtcactgacttgctcttgtgataatggtaggctagtgcatttctagctcaggcgcaaatttctcccgactctaaagtcatacacttgccttagatgatgcccagtggtcctctaattaatgattttttttaagcttaaagaccttcatactatacgttggcaagggtaaagtgtagagcctttgtttcacaagaagccagatagtaatttcttctccaggaaatcattccgtaagtcagaatttctcctctgtacccacccataaatgataatacaggccgtattttacctggtgctgtatttgtgtacctgtccgctgtcaaaatccaagcccttgaaggcaggcttccttcagatcttcattgccttgcacaatgcaagggtaggtacttccatcttaattgaatttttacttcccataaaaattcttcatggtgacttacattagtcatcattacacatcaccgtcagttttgtaagcacagtgtcattcaaggtattgtaaaattttgagtttgatgatgtgtgacagtttcaattattttagtacagccctaatgagaacaaggccgtagtattgattcccttcaaagttggcgtctaagtgaaggtcacattcacaaggagggcctaactgaaagcatgtggaagcatcattataaactgttgctaacacgcacaaataaaggctattaataggtattgtttttctttttctttttcttttttttttttttttgagtcactctcactccatcgcccaggctggagtgcagtagcaccatctcggctcactgcaacctccgcctctgtttttcagctccttagttaagcatacagctccagtcaaaccaaactagaggtctgtctgtccttccattttacttgctgttttatgtcttttaaaagcaagaaggttttcaaactgttcttaaagccacggcttaaccaggagtccctttaattagagcaactgtacctttgtgagttggaggaatgccaggtaatatatattatttatatattttataaatgcaacatttataaatattaaaataaatttta

SEQ ID NO: 4831 - DNA, 728 bp, Homo sapiens
gagcttcctggccgtaagcgataaggctttaactgagaaccaccttgtgctgtaggctttggcccttttcctcacatctgtgtagttatttttgggtcgcggagaattgtggcccgagaaggctctgctccttgagagtgtggggagagaagctgcagtcccggaagcggttttagggggccgcttccttggcctagaggagctccccaacccgagggggcaagggaaacgacccccaggaggcccctaaacagtggccggcgtggtttctcctccagctttacagagccttctcttcccctccagaaacagccaacctccgggtttctgcctgccacgcacggtttattcttatttccgcctgtttgtgcactgcgttatctccacttcagctctgttttcaaaatatttcacagcaagtgggctcttgtgaaaggcagtgacaggagtgacgtttatagtcatgctgcttcaaaaaaccctaccataacttttattctgcaccatggaaacacactcggacagatttgcataacgtaaccttaaggctcagggaatccgaaagagtcccttaatatttaacagaatgagattatggtatttctaaaaccctgaacaattcaaaagccaccagtgtgaagataggaaggttatttggagatatctgtgcctgctaaacacaaatgcatcggcccacagaattgccttctctgctgttaaaatgcttg

SEQ ID NO: 4832 - DNA, 1167 bp, Homo sapiens
tcagaggacggctgaatggagttgcatttcagtgcccacagatggaggtgatgactgaagtgtgtttgcttatgtggggagtgagatgatggctttggtgtctgagtggatgctagtgccttgagtggccagcagagggcagtggtgacccatagctgtgacaaccgtgaggcgtgtggtcagtgaatctgcatgggcacaacctgagaggggcttttgttggagtggggagattctttcggacttaagctttgtgcgtggtatatccagaatcagatgggccagtgccaagttcagtcaggttctcagccttacagtgaaggaaaaggttagtgacttgtatttcagcccaaagcctactggaagtgtcaagctgccagctcccctctgccctccccgttgctatggcagccatgtctctgtgtgtgaataggtgaaccaggctccaggttaggacctctgcccacctagctccaggttacatgcaggaaaagatctgtctattgctgcatgtgaacaaggagatcccatatttctagcaggtcacagaggcagcagtccattatcacttgcctgcccacctaccctgggcaaccagcacatggctccttagaccttgaagatggaggcctggggacagaaggagcagagttgggggctagtgatagggcctgggaaatgttcttgtctgtttcaagtttatcttgtattttggggccctggtctcctcagtcttccagcccaacaggtgtgagcgtccagggccaccacccggaagccagctgcctcttcatggggaaatctttgaaattcaaggcttggccatctggatatgcaaatgttccagatttgctgagcccaccaagtggctgagccccaggcatgggagagcttaggccagcctgtatgtgtgtgtgcagaaggggactgcacatgtgttcaggagcttgagagtgagaattgtgagcatgtacactccttagtgtttatgcatcagggtgtgatgcataaacacgaaggctctgtagcctttgaagaacaggatcagatctgggtttgaatcacaagaccatgggttttcagttgggcaataaacttatctgtcttttgctttgattttctcatctagaaaacgggcacttggtcaccagcctgacccataggcaa

SEQ ID NO: 4833 - DNA, 6392 bp, Homo sapiens
ggcttccggcccatggcggtggttggtgactcagtgtccttccagcgcgctttatgtcccggaactgaaaggcaatgaacaatttccaatccaccccaaccctaaaaaccctgcggggcccctagggtatccctcctacttaaccctggcgggctcctagtctcgggaggtggagggggcggggcggctgttttcctggacctactgctgaaagaactcagaacctggggaaagattgaggctgcagcaggcagcgtggaggtcagatagctggaagcacttaacggccccggggagaaccgctgcactctcttttgcttcctctcgcggtttggtagaaaaaaaagaggcctcagagtagtttgtttttaatgagctggttgctgaagtaaatgttaaaatttgcaattaagcccagtcacctgccccagccttctctgatcgaggtttccatcctgcggcagcatatgcgccatcctcctcgatcttcacaggtctctgagcggagggctgggctttccagccctactttctgaaactcttatggtcagcattggagttcactggttcccctaggcgttgatcagaggatgggaaccagcccggccgggcccaccttcactcactggatcagtaaataccctggcggtgcacctggtgttggaagctggtgctgcacaggcgtgtgaggattagatcagagcagaaaactcgggcgatggcagggtggtgaggcacaggtgaactttatgggcagtaagtgaggttcactggttggggaaagtttattggaaaggtagaaatgaattgtacgacagaaataacgataatagtaagttagcaaccatttctggaggccgccatagatctcgtaccggtgaaggggctaaattatctcagagggtgctcaagtggatggggttcagacagcctactcagatttaaatcctggttctaccaggtcctagttagtgaccctcagcaggtttagttatctctcctgggcctcagttcctcatctgtaaaataatgataatggtacctacctcatagggctcttcggaggattcgaagtgttattattggtaaaatagggccgggcttggtggctcacacctcccagcactttgggaggcgaggcaggtgggtcacctgaggtcaggagttcgagaccagcctggccaacatggtgaaaccctgtcactactaaaaatacaaaaaaaaaaaaaaaaaaaaaaaaaaaaaaaaatagctgggcctggtggcgggcgcctgtaatctcagttacttgggaggctgaggtcggagaatcacttgaacccggcaggttgcagtgagccgagatcgcaccactgcactccagcctgggtgacagagtgagactccaactcaaaaaaaaaaaaaagtgtaaaatagaataggcctggcacagcataagtgctgtataagtttttgttaaataactttcctttaatcttcccaaggtatgaggtcgctgatattttccccattttacatcaatgaagtaaggatcaataggtgttgtgaagagacggagaggaagaaggaatacatttttaagtggttataagactgggaaagggccacattatagatgcctttgtgtggctttcattacttttgcagacattgatttcaaaatatggctcttgtaattttttttctttccttttcccatttttggcattttgccaagtatgagtggttatggcatcatctgactttctagcattttctatagagaagtagtacagggaaaaaacgttaagacccttgcagagatgggaaggctatccttcattttctgtgccatccctgtcttgatcataaataacaggaactggacgaaacatggtcttaactgggcatagggtgattatatatgtgaattatctgtgagaaatgcctgtctctcctctctcctctccctgcttagcatgtgatttgtatattcttatttttctttggttttgtttttttctagaaatgaggtctcactgtgttacccagtctcaaactgagctcaagtgatcttcccatctcaggtgcctcccaaagtgctgggattataggtatgacctaccttgactggcctgtatattcttagagattgcattttgtgggcagggagggaggtgagtccgaagcttgcttgccttccctaggcatgccgtcctccaggaacctccacatgttcagctgtccagagtggcccattagattgaaagaatatggaaagccattggggagctgttccgcagtgcacaggtctatgcacacttacccccaaagtccaaggaagctaagaggttgaggaaggaggctgacaaatccagtttcttagaaatatttaataggaatttatgaacagaagccatgtctgtgtcttgggtagtggtgagacacgatggtggatccccaggacatcatcccctggagtaagtcctgaccccaggacttaccacagggaaggaacctctaggacaattgaagtctaccctgcagggaaaggcaagaatactcagtaagccaggctttatgatcaagattgttttgatctaaggagaaattatggtaagtacatgctcttacacaaagaacagtagataaaatagaaatcttagaggcattcccaaaactggggttaatcagacatgaacattcccagcactttgggagtccaaagtgggaagatcacttgagcccagaagttcaagaccagccatggcaacatagcaagagaccccaactctacaaaaaaaattcaaaaattagccaggcatggtggcacgtgtgcctctgatcccagctattcaggagcctgaggtgggaggatcacttgggcccagtaggtcaaggctgcagtgagccatgtttgtgccactgccctccagcctgggcaacagagtgagaccctgtccttaaaaaattttttaaaaaaagcaggccgggcgtagtggctcattcctgtaatcccaacactttgggaggccaaggaaggtggatcacctgaggtcaggagtttgagaccagcgtggccaacatggtgaaaccctgtctctactaaaaatacaaaaattagccaggcgtggtggcaggcgcctgcaatctcagctacttgggagcctgaggcatgagaatcccaggaggcggaggttgcagtgagctgagattgtgccactgcactccagcatgggcaacagagggtgactccatctaaaaaaaaaaagagaaaggctgagcgccgtggctcatgcctgtaatcccagcactttgggaggccgaggtgggcggatcatctgaggtcgggagttcgagacaagcctgaccaacatggagaaaccctgtctctactaaaaatacaaaattagccagacgtggtggtgtatgcctgtaatcccagctactcaggaaggctgaagcaggagattcgcttgaacccgggaggtggaggttgtggtgagccgagatcatgccattacactccagcctgggcaacaagagtgaaattctgtacccccctaaaaaaaaaaaaaaaaaaaaaaagaaaggtggaatgggtgggaagtgttatgtggaaataggctcccagagagcacagtggaaaaggttgagaggaagagaagcagaaggagattgtattagggccctttagctgctctcttcaagcatgtttattcagtatacgttcctttttgtgttttgtttgggagacaggagtcttgctctgtggcccaggctggagtgcagtggtgcatcttagctcactgcaacctccacctcctggtttcaagtgattctcatgcctcagcctcccaagtagctgggattacaggtgtgtgccaccatacctggctaattttttttttgtattgttagtagggataaggttttgccatgttggccagggtggtctcgaactcctgacaggtgagccaccgccttggcctcccaaagtgctggaattataggcatgagccattgcgcccggcctctgtatacatttcctttcctctcccccgagaaacaggggcttgctctgttgcccaggctctggatgcagtggcacaatcatagctcactgcaacctcaaattcgtgcgccaccgtacctggctatttcttatatttagttgttatagtttttgtttgtttgtttgttttttgagatggagtctcactcttgtcacccaggctggagtgcagtggtgcaatcttggctcactgcaagctccgcctcccgggttcatgccattctcctgcctcagcctcccaagaagctgggactacaggcgtcccacacccagctaattttttgtattttttagtagagacagggtttcactgtgttagccaggatggtctcaatctcctgacctcgtgatctgcccgcctcggcctcccaaagtgctgggattacaggtgtgagccaccgcgcccagcaatttttgtctttttagtacagatggggtttcattatgttggccaggctggtcttgaactcctgacctcgtgatccgctggcctctgcctcccaaagtgctgggattatagtgttggaattacaggtgtaaaccacggcgcctggccccacttaaggaaataatgtgagatgtatataaatatcttcatggccaggtgcaatggctcatgtctgtaatcccagcactttgggacgccgaggcagacggatcacctgaggtcagttcgagaccagcctggacaacatggtgaaacgccgtctctactgaaaatacaaaaattagcccagcgtggtggcgggcatttgtagtcccagctactcaggaggctgaggcaggagaatcacttgcatccgcaaggtggaggttgcagtgagccgagatcacaccattgcactccagcctgggcaacagaatgagactctgtctcaaaaaaaaaaaaaaaaaaaaagctgctgctggcctgacacggtggctcatgcctgtaatcccagcactttgggaggccgaggcgggcagcttatttgaggtcaggagtttgagaccagcctggccaacgtgatgaaaaccctgtctcaaaatacaaaattagctgggtatggtggcaggtgcctgtaatcccaggtactcaggaggctgaggcaggaaaattgtttgaaccccgaaggcagaggttgctgcaagccgagaccacgccattgcattccagcctgcgtgagaagagcaaaactctgtctcaaaaagaaaaaaaaagaaaaaaaaaaaaaaggctgctgcagttccagacataatatcctcataccaataacctacgcagaaaggaaggggcaatgagggctttcttctttagatgctacagtccctgacttcctctaacatcttgttgaccaaaactgggtcagggtcatttcaacttgcaagggaaagtgattattcagcaaaggggatcttgattaatttcctggggctggcatactgccaccagggacattctgggattctgtatgtagggaagaggggaaatggctgttgggtagacaactgtgttgccacacctagttaactacagcacgttgtttggtccaataaaaacacattccaagaggatagtatttgcaatcagtgatagcgtaaccatatgcagtcatatctttctccagaaaaggtgtgcatcgtgtatgtgtgttaaaagtcagttgtttgagaaatgacagaagtatatttaattcatgtgactaatgacccttaaaatgtgttccatcttcatatataaatgtgcaattgtgttttgtgtctcatcttgtatgtatttagttgttttcttttttctggttgttatctttttttttttttttcttttttttggagacaaggtctcactctgtcacccagggcggagtagagtggtggcacgagcctagctcactattacattgaactcctgggctcaagcgatcctcctgcctcagactcctgagtagctgggactacaggtgcataccaccaagcctggctaattttttttaagggtggtagttttctctggatcctctgcctcggccggcctccccaagtgttgccattacaggcatgagccatcacacttagccatcatcttgtatttaatatgtatagtagtacctcttcccttatatatattgaactcaaaaaggttaggaaagagtagggacccttctgggatggaagaatttgtgccatgtcctctagttttctggaaatgtaattacttgaagtgataaactagctcaagaatgttttcttaaaatcacacattacaaaatcctaggttgtattatctgaagccagctagaacagcaggccttgggctgcatgcccagctagtatctagaattttttttttttttttttt

SEQ ID NO: 4834 - DNA, 8709 bp, Homo sapiens
tgtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaa

SEQ ID NO: 4835 - DNA, 10362 bp, Homo sapiens
gggtcaccgcagcacgtccaggccgccgcgggtgccgctggggccgccggattccgagagcggcgccgggctctttcgggcccacgacggccccgaccgtcctgaggaaaccgctgccgccgaggaaaggccgcaaaaactgttccgcccggaagggagaagagctgcggggcgaagccagggctcgcagggggcagcggcaggctgctcgcgttcggcctcgtccactcggcccgcggagagcgcggggggcgctgggaaccgcagtcacgcatgcgccgcctgccaccgagcgccgcggggcccgcgcgaggcgtcctggcgggcgaggggctgggggagggggggggggccgtgcggtggactctcgcgagagcgcgcggcgcggtgactcgtcgctgagggactttaagattgtagaggggcgcggagggtcctccccggggcggagggacacagagggattctagggaacctgccgtcgcgagtcccgcttcaggcggagaatctaggcggcggcggggcctccctgaggcggaggagtcggcaccggggcctggctgccggggaaggagagcacgggagcggggactcctgtgtctggcggagggacacggcgttccggtggagggatctgttccttgtacctggtccagggttgcggtcggggatggagcggttaccccgaccctgcgggaccttcttcctctggcggaggtgcacggcgcggcgtggtgtttttctggcggaagtatctgtgcgtggccccaggcccttcccggcgcggtctcatctggggccacttgttggccctcgcgttggggaggttcatgtggtgcatcctgatgagaaggggggtcacaggggtctcggggccagggttcagccagccaggccccagcttgctctcttctggtgctgcccctgtccctgaattcatagacccggctttccctctcttgagcacctactatgtgccaggctgcgctttgcgcatgtagcagaggcaacagtgtcacctgggaagctggtttcccccaaaggaactcttgtctgtccgttgttgcagagccagcgcatgagaccaagtataaaacacacagacccgcagctttgggaacaggctgatggcccctgcacagtctagtcacaaggcattgaccaagaaagtaatgactaactgcccatctgagactgcgcatgattcacaagaatgtttctttgttttgttttttgagacagtcttggtctgtctcccaggctggagtgcagtgatgttggttcgctgtagcctctgcctcctgagtagctgggactacaggcgtgtgccaccgcacctggctaatttttgtatttttagtagagatgatgtttgactatgttggccaggatggtctcgaactcctgacctcaagtgatccacctgcctcggcctcccaaattgctggggttacaagtatgagccaccgctcctggcccacaagaatgttttgatcattatttctcctaattttccttaaaatccctggatctagaggcacaactgagaaaggtggtctttgaatgctagtgcactgccttttgcaggttgctggtttctcgaataaagctaactttgctttcaccaaagcttgtcttttgagtttttggctttcaggcgacgagtggcctggacaccagttcggctacatgtatgtcagtgggcaaaacaaaaatccttattctgggaggtagatagcttattagaaaacacaacctaatcacttgtttcccaaatgttaaaaattgagccaattttagccccagaagcttagggtaccatgtacataacaggcattacctgagggtggggcagagagaatcagtggggtacctcgtatatgccaggggttgtatcagcatccttacacagctcatttttctttttaaataatacttattgaggacctatttaatgccagatatggtggtaggtagggagcaaaagcaggattcccctcccattattgagttttcagtctggtgggagaggcaggaattaaataagtaatccacaaactcaagtacaattctaagggagatgggtgccaccaagaagagacatggtgctgagaacctatgtctgtcagagggatttgatctatttgggaggtctggaaaggtttttttgaagaagcagtgctaggggtgagatccaaaggagaagagctaattaggcaaagcctagtcctcacaaaaatcctataaaccagatatgattaccttcattttagagtttagggcattgagacttgagcaaggtgatgtcactgcccaaggttacatcagattaaatggcaacccaggattcagattcaaataagagtagggttctttatattctccttgggctatttggtggttttaggagaggcaagtatcacaaacagcttggggacatgagggagcaggaatcacaaacttgaaagcctgcagagctcaggcagatagcatagagtgaagtagggcagagtgtaagacaataggggatggtggggagtgtggtgagctgaaggccacatttcctgtctaaaggaagcagccactagttccagtctcttgttgccatgcaggattacagaccaagccctgctggatcttctgatgatattattttgagggcttggcgcggtggctcacgcctgtaattgcagcacttagggaggccgaggtgggcagatcacaaggtcaggagatcgagaccatcctggctaacatggcgaaaccctgtctctactaaaaatacaaaaaattagctgggcgtggtggtgggcgcctgtagtcccagctactctggaggctgaggcaggagaatagcgtgaacccgggaggtggagcttgcagtgagccgagatcgcgctactgcactctagcctgggcaacagagcgagactccttctcaaaaaacaggctagagtgcagtggtgcaatcatagcccactgcagctgggactgcagacacatgccactacccggctaatttttatatatttttttcagagacagggtctcactatgttgcccaggctggtctgaaactcctgagctcaagtgatcagcctgccttgacctcccgaagtgctggaattacaggcgtgagcccctgcgcccggcctagatcttctgatttctaaaaagaagctggcagtatttttaggtgaagttatcacacttctaaataattggcagttacatgagtttgcctcactataatgttaactcagtgaagcaggacattttatgtttttaaccactgtgtactgggagcttataaagtgccttacgcatagtaagcactcaacctcatctgtggtatgtagcctctgagcgattcctcccttgtgcgcatggtttcacagtttttgaagcagttttatggtcattattttatccaccagtttttcagctggcacctcatttgtcctgatgcggctgctgcaggaaaagtccccggaaaggctccccagggaaatatttagttgtgccttccttttgtacctttccgccctctttgtattttacattttctccatcctaatgtgcctggcattataccttggctccctctagttatccagcccattttatatttaatattttgttgttgctttggttctcacctagactttatgtattgacctggggcccatgaccacacttaggtatactttcacttactcttggcccagcccctgctcccagctgcttgtcagggaaaagtgcatgaaaaggtttcatttcttagaaattgctgtcctgagacatcttgcgaaagtgatcatccctggacatctgaacttcctactccatcacatggacttgagcaagagaaaaatctcaggtctgcatggggcatttagaaccttgcctcctgaaagctcctcagggtgcagagggaatcaggtttgctctttattatttcttaggtgcaggatcataagttgttcaggaattgttacaattttgtggtagcctctcagtaacacacacaagtgcgcacacacagactcatatatacgcatatgtctgtgtatatatatatattttttgcatatgtatatatttaatggaaaatttcgaacataaaatagaatcctcacgtttctgtcctccagctttaacaatgagcaattcatggccaatcttgtctcacctgctctgatcctggattattttgaagcaaattctggacatgatattttttatttgaaactatcagaatgtattgtgtaaagacaggaactcttttttttttttttttttttgagacagagtcttgctctgtcgcccaggctggagtgcagtgatgcgatcgcggctcactgtaacctccacctcccagttttaagtgagtctcctgcttcagcctcccgagtacctgggagtataagcgtgcaccaccactccaaggtaactttttgtctctagtagaggtaggtttcgccttgttggccaggttggtcctgaactcctggcctcaagtgatccgactgcttcagcctcccaaagtgctgtgcctggccaggaactcttattttaaacatagcttcaatatcatcataagctcttctcaattgtatcaacaattccttaataccatttaaagaaacagcgtgccaggttatttctcatttcttttattttcttttcctttctttctcttttccttccttccttccttccttccttccttccttccttccttccttccttccttccttccctccatcacccaagctggggtgcagtggtgcagtcttgactcactgcagcctccacatctcaggttcaagagagtctcatgcctcagcctcccgagtagctgggattatagatgtgtatcaccatgcctggctaatttttgtatttttttgtttttttagtagagacagggtttcaccatgttggccaactggtctcagacttctggcctcaagtgattcacccaccttggcctccgtaagtgcttggattacaggtgtgagccaccgtgcccagccttttcatttcttttatgccaaatctgatctacttcttaaaaattgaaaagtagaaatgagaagattgggtatgtgtgtactggtgtctacttcagacatagtattaatattttcaaatatgattccttaactaagctacatgcctctttataaagcatcatgccaggcactaatgggataggcagatacataagacatgaccattttacttaaagtgttacagtaaagtggaaaaaatttgagacggtgtcttgctctgtcctcagatgatatcctcaggcaattgattcccctctattttcagctctgttttttcctgaatcaaccttattttcagtaggttctccccatgtagtagctgctggtcttctgaaagagagtacacttccctgaacccccagtagtttcagcaaatgtcctggggctgaccctcatagggttgacttgggtcatgtgcccatcctgaaccaatcactgtgaccagggagagggaattcctgattggtgaggcctgggtcacatgtccactctggagctgcggtgtgttgtcagctctttctgagccgcctggtccaagagtttggaagggtttttttttttttttttttcctaaagaaaaattgagtggtccatttttcctaaagaaaaattttcctaaagaaaaattgctactaccagaagaagggataaaggatgctatacaggtaaaacgaagggatgttcactttccctcaaggccctagtagaagaggtgtcataaaaccgtacataattccatatgattatatcaggcaattagagctgtcaattcagatgttttggaagtggtcaaaacaaacttcatggatgagactgaaatttagttaagcttgaggaatgggcaggaattgataagaggagttctagaggtgggcaggactagagtacattcaatggaccagggtgaactgagtgggtagttggtgaagggagagaggttgcaaatgccagaactttgattaccttgataggataaccttggccaagagagttgcaagcaaaccttttgacaaaatttgcttgagccagcctgtggtctaatccttattcttgtctgtgatgcatggatagccctttgggttctagctggcctttgtctctggagttctgggaacacctcttactgacctcattgcctactttgtgatgaggcttctagttattggaaaagtctaatgtccatgtatgccctcctgtgaccaatccggttcaccccttgtagttgattgtgccaagtcattttagcctgggacacagaaaatatgctgcaggcctttccctattttcagagtaaagccttgggagagcttgctgcaacactgtcaaacagaagaaaaatccctcttaatcagaagagcaaatgcagctgttttcaatggcaaagtcatggaaccaacctaagtgtttgccagtggttgacaggcagaaaatgtggtgggctggacatggtggcctatgcctgcaatcccaacactttgagaggctgagtcaggaggattgcttgaggccaataccatcctgggcaacataatgataaaaataaaaataaaaaattagccaggtgtggtggcatgcacctgtagtcccacctactagggaggctgaggtgggaggagcacttgaacccaggaagtggaggctgcagtgagctgtgatggtgctatgatggctggtggagtgggaccctgtctcaaaaaagaaaaaaaaatgtggcagatctataacatggaatattacatagccataaaaaggatgaaatcatgtcctttgcagcaacatggatggagctggaggcaattatcctaggtgaactaaacagaaaatcaaatactgcatgttctcacttataagtgggatctaaacaaaggttacacatggacataaacatggagagaatagattttggggattcctaatatggggagggtgggatgggggtgaaggttgaaaaattacctattgggtacaatgtctggtatttaggtgataggtccactagaagcccaacccacaccattatgcatgtaatacccttgtaacaaacatgcacatgtacccccaaatctaaaaaaaaaatcaagtgaagcacaagcaaggaacagctgcaaggaaatcaaagttccttatgtgcaagccacacttttattgggtgctcccactttgcctctgtgagtccctagagaggtccagtgttcctcttgggggattcacccaattaaccatgtgcgtgtagacaagggaatttccctggaggcagggaagtccaggttgctacttgtctaatagctaaaatgtattgaatttttattatgagccaggtatgattttgactattttatatgcaataactaatttcgttctcatgccaacactgggaggtagatgctatcaatattcccatttactaacaagaaaattaaagcaaagggaagtaacatgcccgagttcttctagctgctgagtagaggatcctggattcaaattcacgtgacctgactccagagtttgtgcttttaaccattactttatgctgcatctaaccctgttattttaacttacaatgactgaaaaagaaggcaaataagctcatttaattatcagaaaggacttaatgctcatcattgctagtcaggaatagattgagaatgtagaggctgctgccagcatctctttgttctgtgcattacctgtcaggctgagtttgccttttgtagacacaaggaaattccctttatcttgatttccatccctctattattttctaacaagggctccagcctttatctgcacctgctcctttttatctgtcttgataagacccattttccccgagttctcgcatttttcagagcagggtacccaaagaccatgaaacctctatggctaatattggtcaactctcataggataactttcatgtattatactaattatcttcttcccgctaggaaagaagttgaagaggaggaacaatggaaatgaaggggttaggggataggatcttgccccaataggatgggataaaggggctgtgtgattaggtagagccatgggttctatacttcaagaccagaatctcaggctgggattctatgagtatttcctataagaaatgctatagaggccaggtgcagtggctcatgcgtgtaatcccagcactttgggaggccgaggcgagtggatcacctgaggtcaggagtttgaaaccagcctggccaacatgatgaaacctcgtctctatgaaaaatacaaaaattagctggatgtggcggtgcttgcctgtaatcccagctactcgggaggctgaggcagcagaatcgcttgaacccaggaggcggaggttgcagtgagctgaaatcgcgccattgcactccagcctgggcaacagagcaagattccatcaaaaaaaaaaaaaaaaaaaaaaaaagccatagagacttggagtggcttagaaacagaaaatggcaaatagcgaccttggccagatgtgcctggatttgagtctgtgaactgcccattttccactgttggcccaggactgaaacaagcatgtgtaaaaggggctgaccggttatttccaagttaagtaaacttctccctcttgtcgctcagcacatgagttcgtatgggaggttgagtatcattcgtgaaatccatatcctgatgttggaatccccgatttttttctcttatgaacactgtcagatggtgccaggctgtccctccagccatctggtttggtttgggggtcagaggtctggcagtgtcttcatgtatgtggctgattctgtgcatgtcttgggagtttgggtaggtgtaagcaagtaggcaattaactacccaaatcaggaggtctgagaatgggctagtggacagagcaggagcattgctatcttggacaaaccccaccattttaaattccccttgattaaaaaaaacctgcctaaatccagcccccaaacatcagcctaatggctaatgttagcataaccagaaacattccaaccctaagataaacgccactccaaccagaaacatgccgaccccaagatagcttcacctccaaccagagactttccaaccccatgataaactttccctcacatcgaaacattgcgaacctacgataagctccccacttcctatatccttaaacatctttagtctgtaagagagagtgcccccgatcaaaactggtcagaaacccctcaggtttattctccaaaagaaactgactttgaatgttaagctgcttttcatgtttctttgctctttaactcttacactagtgggtcatttcccaagtgtgatgctatctacactagtttaccatggttgctgagaagataaaatatatgcctggacctgttgttagtctactaggttgctgtaaggagagtcttccaagaatgaggcaagataaaaaagcagagggtgccacagagtttgaagtcattatttgagctcctagatgcaactgcacctgaaactagacccctgtctctaggtttttgagccaatatattcctttgctttgcttaagccactttgaattcaatttctgtcacttgcaacccacacagttctgactgatatacaaaataaacatattacatgttatcttctgtgactcagaaattattatccatttttacagatgaggagttggagttttaaaggtgcaggtaacttgcagtgaaaagctaaggtctggcacaaggttgatcttgaatctgaagaagaaatggttcaaagtctcctttagagatgctaccttcctgctgctcacttccagaatttagtcagggaattattgggctgacttgagttgttgtgtatacagtctgtgaacttgcagtttatggtattttataattttgttttccctgccgttctgctaatgcagctttgtgagcaaacattgcctgtgatttaaatccaccaccgtaatgaaacgcacacacacacatgcacacacacttccttggaacagtccacagctctctgattaatcacatgtgtacagtacagtgtttacaggaaatcagcaggtggcaattagcatcttggaaattatctgggaaacacaactggagctgccacttcaggatggaaatgtggcaacaaccggcaaagtgacaaaccccttggagttggaaatgaatggggctgaaagcgctgccaggcacacaacagctggtgggggcagcccggtgtggactgcagactgcctgctagcttcttccttttcttcccaacgcatacaagattttagagacgggat

SEQ ID NO: 4836 - DNA, 1483 bp, Homo sapiens
caaacaagtgaattttatagtatgtaaattatatctcaataaagccattaacaaaaaaatccctttgggagcttgaggaggataaactggagggcatcaactgggggaggttgtagtgtaggagtttgggtgagggggcccgagcccatctgtttggacttgagggaaagtggcttggggttagagtcgggggaggatcagaatgtcttgcccaaggttaagaagctggtggaacttgatttcagaacccagagctccctggcttcagccctagtgctcctgccagcactacagctgctccactgactggtgatggaagcactgtcttccccgtctaagagaaatgcacttcagaaacatgtttccaaaaaatgtttctaagggttttatttctaacaagaggaaaataataaaataaaattaaaataggcttcagttggaaccaagtttcttgttttgcttttttttttcttttgaacaaattaattacacaccaacaatcttcttttattacaacatgaacccaggaggaggaaaggagacaggggaggacagggagggaggactgaggtggttgtgaggacaagcaccaaaagctttcttcagatcacagggagccctgttcagctccccagccaaattcctttaaaataaaaaactgtgagcacggctatgtgaagtttcctcctcctgggtggaacagtcaggggaagggagagggagaagggggtaggaaggaaggaaaagaggggaggagagtgggggcaggggttagtgtagcatggcctggccaggaccagaactggggagagaagggaggagagtcccccagtttgcatatacactggccttgtctctggaatggtgatggcccagccccagccacccccctgcccaccagcccatccatctatctgcctcaggtgtctgggaatgctggttagaggctaccagggagggaagactccaggggccggcccccaggagctgaggtctgaacaataccttggagtcagaatacaaaagtcaagggactcaggggtgggcggatcttgcaaatgcccgatttctctgcgatgggcctgattttcgcgatgtagccaagagggtctcggaactcggcccagctaggctcgaacaccgggcactccggtggcggtaggaaatcgtcggaccccggctccatggtgggcccgaggtctgggccagggatcgggaggcttggaccgcccttaaggactcatggcgccgccgctgtttgaagccgaggcaatgctcggaggctaggccctaagcggggcagccgccgcccgccgagggcctaagggggcgtgtggccgtcgtgctctgagagtctcaggctgactctactgctaccgcctcttcgtcccgctccgtttcttccaaactgtgtggttgcctccccactaccgcagccttcgccaccacagttacctcccaaacgccgcggccttcagcgccg

SEQ ID NO: 4837 - DNA, 4501 bp, Homo sapiens
gttcttgagcgtgcgccggcgctgcttcagctggacgatctcctccttggacaggccccgcaggtgctggttcagctcccgcaccgacatggtcaccagctcctcatccgtcaggctggtgccattctcacccggctcccgcttcacctggggcacagtgcaggtggtcacaggccaagcgggcacgcccactgtgccccccgaccccagcccacaggctcctgtccctgcccactcaccttcaaggccttgtttcctttattgggggtcgtcataacccgggggcacagcgagcaggcgctctctgcaagacacggagcaggtcagtaccctggagaccaccctcgccgcacccccccccccccgcccccggcccagttcacaagagcccttgccgcacagcccgccccagcctgctgtccaggtgcccagcccccaatacctgataggaggcagcccttggcctctcccaggctgggctgagctgcttcctgtccaccctgcccctagagaaccaggtgggaggtcaggaaggtctgacgggagaaggggaactgaaggctgttaggaaggcaggcgcaagacaaggggcaggggagagattagaaggaataagacgcgggagaggcaggcctagaaggaagccgggagctttaaaaataaccccggcactgcccagagcgcggctgttcctggcgagtcacgctgactcagcacattgcctctgcctccccgccgcgcccgcactccctggcccgccagccaacagcgccccacgagagccgcagcccccagcctggccaatagcaggtgagggccagccagtgaccctgtgtgtgcatcttccagggtcctaccttctacagccacctcccctgagccggcctcggacaaagccccctgctccctgggtgcacaggggccccacgggggacctggccagagaggaggctacagggaaccccgagtctcccagcctcctaactttgaaaagctgggggtgggccgtccatctagctctggtctgttggcaggactgaccagggagttcccccaccttccaggtggcaggccatcagctgggaggagcctggcccgaggcccctctagacctcccagtcggcctcctccactgatggagtaaccatcctgtggctttgggttgcaggaagcagcccctgccccaccccatccagggtatttcacaagggctcccacagtgagccaccccgggcctgcccaacgtgaaggctggcggagtcagcccctccgagctgcagcctgctctctggtccctgccccgggtgagtgcccacagggccagggagcaaaaacaaaagtgctggggtggccggacttaacaaccaactcttccccactcggggtccctccagcactctgctctcactttcttgctaaggatgtttctgggattcccagctcagcccagctcccaccagacccttgggcatggacccccgcctcatgctccatcccccactttccaggtttgatgcagacagatgggagactcctccagaggagctaggatcacttcaggaaattatgggctggggggcttcttactctcatcaggggagctgaagtgtggccaggcggatgcacacatcctcaccaggctcaagactccacctcacccagcctgggaccaggaggtgaggctgcaagcacagagcagggaggggaggccagagacccctccccacagccaagccagctcagaggcaaggtcccgaggctccagccactggattcttccagataaaggatggggaagacctgagctggaggtcagaaggcccacaggagccctttcctacacgtccggcacaacactgccccaggagacaggccctcagccaagcatggaggggccccccagccttgagtgcaagtcagggtgcagagacactgccctggcaccagcttctcccacccccatcgcccccacccctgctgctaagcacaatgacagtggtgacttcctgaagagatcacacggaaaagtgcctcctcgacagattttgccctccgcagaaggcctgaactcagcacaagtgcaagccatcgcctcctatcaaaggtgcgccggggggtgggggaggggcagccctgagcacagccagtgcgttccaggctcctggcctggcctctggacctgggctgagagggaccatgcagggatcccaggagctggactgaggagaagctgcccccgccctcctccagccctcaaggctgggcagagctggggcctgtcatgcaccctctgctcccagaggctaataagcccacctcacgcaggaggcacagatggtcacggctccgcaacctgcgagggtacctaggccacccattcacactgagagccaggaaagggagggagatttgggagctccgtctcctttggctaaagtagaaactcccgtgcctgaacacagacagccccacctggctgcaaagcccagcggccgaaactccccggcagtcatggcctctgctccataagctctcagctcctgaaagtcactctttgaacagaacctaaaacttagtttccactgatgcataagtgactgagaagatgtacataaatgggccgcgcggtggctcacacctgtaatcccaacactttgggaggccgaggtgggtggattacgaggtcaggagatcgagaccatcctggctaacacggtgaaaccccgtctctactaaaaatacaaaaaaatagccgggcgtcgtggtgggcgcctgtagtcccagctactcgggaggctgaggcaggagaacggcgtgaacctgggaggcagagcttgcagtgagctgagatcgcgccactgcactccagcctgggcaaaagagtgagactccgtctcaaaaaaaaaaaaaaaaaaagatgtacataaatgtccctccaggaccccaaaattttcccagggcatcaaactccaggccaacggtcagctaaaacattgaaacatctggaatctataagccccggggctcactgagagtggacctgtgttctgtgtgtatgtgtggggggtgctcactgagaatggacctgtgtgtgtgtgtgtgtgtgtgtgtgtgtgtggcggggggcggggggcatccctgagggcaaaccacaaagtagcctaacccagccatgaaatgaactcctgggcaaaggaagtcaaccttcgtgaatctccacatacccaaggaaaggtggctctggccacatcactcccaagctgccactttctaagcgtcctgggctgccaggccagacacccaacagggccactccctttgctaacttcacacaacgctgagaccccacttcaggtagcgacaactttagggtggctgggtgctgcgttctgccaccctgtgccatccacaccagcccatctgctgcaccccaaggctaggcaccctgaagctcccaccacctacagtctcaacccagactccagggccaactggggagagaggctgggctgcttcctcccctttgccgtttcctggtagagctgcccctgcttcctccctgcccagcccactgtcacccagggcttggtacacacacccctctttctcccaggacctcgatctctggccaggggctgtccaaccaggccagtcccagggaaagccgacttcccctttggctagctcggcccaccgaagctcctcccctccctcactcagggaactatttcccagtttggaaaactgctccagacttgggaccaggaccagctgccggaaaagagccgcctgggaaggggtggaccgcccggggcttcacctttgaccccgggagaacacctgcagcgagccacccccacttcctcttcaagcacccctgccttcaactggatcgctcggcgctcacttaaacaggcaccccaaggcgccgggcctggccccctcccacatccccacggctccctcccacctcccgctggcggccttttagtccccgaggcccctcgctcgaatcccctccggtatcagcttgagcaccgagtgacctcacgctgatgactcagcaagtctccctccgggctctggcacgcgactgacggaacccgagccccagccaggggcagggtcttccccgcagcacccccatcgccgcccctcctcccgggctcgccgcggacccccgcgccggggagagctgacgcggccaccggatgaatcagcagctgcgggccgggccgccgggccctggcgcggacccccgggcgcctcgctcgaccccaccctttcctcccgccgtccagtgcccctccctccaggacgcccgggtctccgagtccgctccgcactcgcccggctccgcgggtccgccgccgcccgcggcccacctccagtacccgggcgccaggggcaggaggagctggctcctgaccgctggggaaatcgaggcacgggccgccagcagggtgcgcggcagacccgaaaccagcggcccccgccgccg

SEQ ID NO: 4838 - DNA, 673 bp, Homo sapiens
taactctcactttgtagtggtatatttaggatttgatgtgacacagttatttattgctgagtgagcaaacccctagcccccaagtggggactacaggcttcagtgcttcccccacactgcctgagctaccagcccttctgcactggccctcctgccaatactgcctgcactgtccccactccctctggctcccatgatcaccagatccgccctgcaggctccctgtcacctgtggggccctatccagaccccctaatccacttgcctagcagccccactcttccctcgatggctcagatcctgagatccaaggaacaccctgggtttcccaaccactctcttactgcagaggtcctaggtgctcctggatcgtgtagtctttaactgctgccccaagggacctcaaggaataggaattctctttgttaggaggtggaatgaaagtgtccagcaaactccagccagcagcgttcgtcccttgatttagagggctatgatttctacaaagtggcccgactggcccgcgaacacgcagcagagacgcggcctccacaaggtcagaactaagatgtcctcagagatccccagttacgaagcaaagcgcgggcctacttcgggacctacgcgtccgggcgctgtgcgcggggaccgctcccgggcccagcgtcggggc

SEQ ID NO: 4839 - DNA, 3367 bp, Homo sapiens
ggagccagcagcgagggaggccacagtgacctgcactcaacagcatccggggctttccccaagatcatcactcacctcacagagccctcgccccggctcagcgctcacggaggccgagatgtttacaaaacaggagattttcccaaagtccaccaccgcaaacctgcaacaacctgctctttttagatcacagggactgagttttgtggctgagataaaatcaattagggctccgggcatgggggcgctggacccggagcctcggcggcccccctactccttagggtgaccccagctccacacagacctgaccctatcctccttccccaccctcccccggaacactccagccagagctgcccaccccacaggccctgcctcctgggcttggccctgcctttccccagccctccagactccacagctctcaagcaagggccggggccacagggccagctcccggaaagaggacgctgggcggtcctgcgcaactgctaaaaaatggacaccatttcccacaaaggggcccaagtctggcaaggcggccagtgctgccacccgagtccagggttcctccctgccccacccccatacagagagaatgctggccgcgtgacgtccgcacaccgctcagctcaggaattattcacggctcactgctacctcgacagaccgctggcaggaggtcaggaaagatcagatagggcggaggctcgcctctgcccaggacaaccccagagaacccctttgtcagccatggaggcctccaggcctggcctcagtggtcagactgcaggctcacagccaggccaccccaagcctcagtttctttacgagcaaaaggtgggggagaccagctcgtgtagctcggggccgccatgagtgccagggcacccaacctgtggcaggacctgggcactgagccgtgacctctaggccaagacaacccaccatgcgcttctcgggccctgggccgatgcaagaggagaagaaactgtactgggtgcccccagacaaccagggcagccccagccctgcaactggaaggacggaggcaggagggaaggagggcgggccgaggacggccatcagttaaaaccacacagcagttgcgttctgtcccgcccactggtcagcccttgtagaacacccgccggtcacatggcaggcggaagttccatccgggaaaagcagccggctggtcccacttccggagggagtgaaaccgagcttggggcgccaacgctagcgggcaatggcagacacccgcccccaaccgcgcccccactccgtggcggggtcaaaggaagagccacgccagcaaacctctacactctacatgctttttattacaagactactgaccatacgaggaaaattcatcatctggtaactacacctaaagcacaagtatttggaaaaaaaaaaaggataaacagattcattaaattatatgattaaatcactgacccaatagaaaatttatataataaagccagaaaaaaagttgtaaaatatagtttacaataattattcacattcaaggctgtacatcaatacatacaacaacgtggccccgaacatgaattcaattcaaataattcatatattagaatttaaataacacagactgaactagaggccaacaatagccagcaaataaccttatataagaataaaaatacaaaagtgtatatcctagtatcattgcatttgttttcataagttcttttaatttttgctttgtctgtacatcacagttacagctacagaccaggtagagaatattacgcatgttctgcttgccacccacctgaaagacgtactagtcatttatcctattttatgttgtgaaggaacagctacagcagctctaaatactgtaacaatttaattttgccaacatccaacttacttacagtcgtaatagaggcttttaccagcacaatgacccctattcgtagtcattctgccaggtggttaggctatgtgggttacacagcttaaaaaaggtctgccttttgtaaaaagttctctgtacatagtttggtgtttcttcatatggaagaaatgagttacggggaaaattcaggtacacacgtaggctcgttcagttgctcaccacagccatctcaacagatgaaagtgctctttgttggaaacagcttcctcctcacaccagttctccacaggcagcctcatctacaaccctgcaattttgggccagaagtggtggcccctcagaggctctgaagtgcctccagccccgattcaggcacttgccacgtgtgctgcgtaagaagggacccccacccagtgagtcaacataggctcatgtcaagtttgaaaataactggggaaaagtgtatgacaacatcttccagaacaaagtaccttcaccgtattctcacagcagctgcgatctctgaagtctcagcagtgaccaccccgggtctgtcaaccagccaggcaagggggggccctcaggcttcagagggcaagaaaccaaattccgtgcaatttggccataatctctggtagagtgaagcagcactgaacacggtgcctagaaaaacctcctgcacgttcccctgcacaatcaatggaccccaactacagtggagaaatgaagaatccaaccaaatttgggtggtctggacttgctgccagccaggcaatctgcaacactgtgggcagggagttggggggggcggcctgaaatctacaccagctgggacaaccacgccctacaatgaaaaagccagcctggctgctgggctcttgtgaaccactaagacctgaaggtggggccccacgggtggaagggggagacaaatgcactcttgtaaaacccaatcagctacgtggtttttttcaaagaggctttgctctgctactgattccaaatgtcctaatataccttctgagtctataaacttaattacaaatcactcactaagcatgtggcaaggtcagttcaacacttgttatctctgctgactgtgcagatgcaaattcagtaccattgtggacacgaagtacaagattctgccaagcgcttgaaagccacggcagcagggagggcagagagctgacatgcaggcagagccaggttcttgcaaccaaaacaaggaaattggctcttggaaaaaatcggccacagatggattgcagtagtgacatcctcttagcatttaaataaagagcggtcttattcagacattctttggaacacatggcttatcagaaaccgatttgttcagaatctgtaagacacaactaaggtggttctgctactggaagtgagcgtctacacatcaggtcgagagagagacagaaatatcttcaaaatgaacaaactctttca

SEQ ID NO: 4840 - DNA, 633 bp, Homo sapiens
ccagtgcccaggaaagaagacgggaggcagtagcagagcctgggagagatggcctgaggatgttgtgatggaagactgtatatgatcatatgcactgctgtccagaaatattccttcctgctggactcagagaaccccaggacctctacccaacgtgcctgctccaaagaaggaatgaggttctgcagagctgtggtccgagccgtgatcaggaaggatgcctcgggaagtatagttttccccagcaaactgcccagcagtgcatccgccggctgtggctggctccagtgcagacagagctcagaactcggctcctgcaagacccatcctggctcatctacaccatcgaggatgaagagcagccgctctggcctagacaggatctgtctaatgggagccggagtggctgtcccatcttttccgatgagctcagcgagactcaccaccttggactgggccagctctctgcagctgaagtagaagacatgctggaagcggtccccatacagctggcctctcccccaggcttccttcacctgcctggccagtgttgacttcccaattccagcagccccctgcagtatgactatgcgaggttcttgggtatccaggcctgggccaaataagtctctg

SEQ ID NO: 4841 - DNA, 2167 bp, Homo sapiens
cgccgccattttgggctgggaggaggcagcggagggactcgctgcgcagtgagagcaccccgtggggggtggtccgggcgcggggagaggccgggccgagtgggctacctgaagtggcggcgccgggagacggcgggaagtgggaccgggggccagggagggtgaaggttggagtctcctcggccgagcccggtcctcaaaccgtcccggcagccccgcagcctcgcctctcacagagtgcggggttcttcgatgttttacaactggattacaaaataggatcatcattgactagggtcctcaatccaaaactggaaccacttactcctaactgaagcttcagtacacttgatgcctactgtggtttgattttttacctacatatgacatgttcgctctacactgatcaagagatcatcaagaaagaaaaccaaggcactagaaagcaagcacacttaagtattgaagataattacatcttaaattttgcctgaactgtatattgtagcatacttaaacccattcaaggaaaaaattggcaaattgaaaattctcccattaaagattgatatttttgcaaactgacaaatttaacgatttcggtacccctccccaaaaatgcagtcacataaaatatatcaatactattttgaattagctctagaaatcacactgaaactatgttacatttacaaatattaaatttattataactaaaatgaatttaattgttctcagatttggccaccttatagctccgtttaaggaggggatttgttaaaaacaaaaatgcattataacttggtcaaattactttcacattaaggaaaaaaacttctaaaaaggaaaacaagaaaagcaactcttcagtttcacataattaaaagaacaggagaaagcacgcaagctacatatagctaaatttacgaaaccaaagccagggggatttctcttctgattatgtgtcataaaaaggtccactgtcttatatacacatgtatataatgttacattccatcactgtaaaaagtcccctttgccccctcccccaaaaaagtttcagtctagtctccaaacttggaaagcggcgctcgctcctgctgccggtgcagttcgttctcggtcagcagctggaggttctcggcgcgcagccggtccagctccagctccagctcccgcacacgcgcgtcgtcgccacccagccgcttgctctccagccgcagccggttgttctcgtcctccatgcgcgagaggcacttctccagttccaggtactccttgatgagctcctgcttgctcatgttctgcaggctctccgtgtggtaccgctcgtacgtctccgagaagtcccgctgcagaaactcgctgccgtcccctcccatcccatcgctgcccccatcctcctcacccccttcttccatgaagtcgtcatcgctggtgtcgtcggatttggcggcggcccgcttggagtacaggccggttttgagatccggctcctcctggtcgtgatcatccatgaggaactgcgtggtgttatagggcgcgaccggctggcccttggcgaacatctcggctcggatccttgaagctcgaaggctctgtttctcgtcgaactttttcttctcttcccaggtcagcttgtagtacggtttccaatgccgcttcttcttggacgggcgtctcctatgttttttcttccccagctgtctctgctgctgtccccactcctcttcgccccctgcggcaggagcccccaacttactggcctcggagtcatgacaaggctgggcgagcagctcggcctcgggcgtcggttccacttctgccggcggcgggaagtcgccgccagcggacgagtcgtccccattctggcccttctcgccctctctcaggcagctagattctggacaggcctgggtctgcaagggaggtggttgggattccaggctcccttccccctccggccccggacggccacccaactgggggaacgctctcgattgccacctactgtcctcctcgggcacccgctcctccgcgcctggggggcgctcagggttcagctcttcctggacagcagcagcacctgtacagttgctagtttgaggctggtgttgatattctgacaagaatggctcggccatggctagtagagtcctcgaagttt

SEQ ID NO: 4842 - DNA, 2187 bp, Homo sapiens
gtgctcagctcccgtcggcagcagggcctcatccggcccaggcctgccctccgccgccgcggcccgccccgcccgaaaaacactcacttgccagccgcggtccatcgagtcccccgctactgcctcctccgccggctgcggctccggtccccgggtcccccaggtccggcttcttgggcccggggggcggcccagctcccccgcccgcgacggctcccggcggaaagccggccacgggtgcaccagccagagccagggggacgctgttgctatggaggccgaggcccggggcagccccggcggcagggtcctcatgcaggaactgacactcctccccgtagaagcaagtcttatccttagcgtagtagcggcagtacttcagcttcactcctaccgccgccccgccggggacacccccgacccccggcggggccaccaccgccaccgccgccgccagcgaggaggaggaaggggaggcggcggccgaggggggcgggaggccgccgccactgttcatggcaacgccgcagcctcgtcttccgccgccgcccgaggagccgccgccgccaccaccatagacgggggaggaaaggaagacgctgccggtgccggataaaagcctgggcgggggccgcgcgggacgacggggtgagcgcgcgggcccagacggggacttcgagggcgcgggcaggggaagagggagcggcagcggcaagcgggtggggaaggcggaggggccggtttatttttaaattctgcctccactcgctctctcgcgctctggttcctccgagttgtttattccattttcctcttcctgagacggccgtcgccgctgcgcgtgcgcgctgagacgcgagggcttatgggtagcgggagcgctaggggaagcctggccggcgtcgggcccccgggggcatccgcgagctatcggcggttggaccggcggctctcggtggggttccggacgcggatctggcgccgaattctcacgagacctgataccttccttatttgtatattctcttacttaaaaagccagatgtcttttttttttttttcattgaaaagagaaaattgacaaggtaaacggtcgtttggaggggccacctggggacgcggcccgagccctggctctacctgaagaatatcttctatttgccacacttcctctccccgtttcctttcttcgcccctctcctctttccccttcccctcgaaggtaatgagaactactggaccgattacgctaacctcttggccctttgtcaaaaaatggagccaaaaaggttgatttagacagaccccctgctcagtgcagcacctgttattctctgtatttatattaccaagggccttcggtaaattatgaaaaataggatgccacctgggacaacactgcttagacagcactggaagacctttataaatatactaggttgcttttctccaatcagcctagccttgatttgaaattcatttttattttttttgagacggtgaaattcatttttaaaagatagttttaacctcagcgatctctgatgtttgcgctaatacccttttaaaggctttcagaaattttaaagaattgctatgaaaggaaaagtaacattctagtttttctctgtaaaagaggttcacaaacggcagatcgctgttatgaaaaggaggggtggaagtatttaaggaattgtggcaaacaaagtcacagaagaatggatataagcaaaagtagcacactgaaaaaaatggggaaaagtggagtctagatcacaaactggtaagcttggtgatgttctctagccaaattcgaaggtaataacattgtattatggctttctgtttaaaagcagtttcgcttatttgattattcaacaaatctttattaacacgcattacgtgtaccagaaactgtggtacacttaactgtggagctggggaagcaaaagtgaacatgccgccttaagtgagttcagatggcttatcttccggttggggaggcatcaagtacacaggtccgttgtaaaccagtgtcttaagtgctaaccttatcacatttgctattagaggatattaaacatgtcagacttcttggagaaagttgatattttcatgttccaagtttgggaacatcattgaattcagacagatctggattgaaacagattaaagtgcctacacttt

SEQ ID NO: 4843 - DNA, 2191 bp, Homo sapiens
gtgctcagctcccgtcggcagcagggcctcatccggcccaggcctgccctccgccgccgcggcccgccccgcccgaaaaacactcacttgccagccgcggtccatcgagtcccccgctactgcctcctccgccggctgcggctccggtccccgggtcccccaggtccggcttcttgggcccggggggcggcccagctcccccgcccgcgacggctcccggcggaaagccggccacgggtgcaccagccagagccagggggacgctgttgctatggaggccgaggcccggggcagccccggcggcagggtcctcatgcaggaactgacactcctccccgtagaagcaagtcttatccttagcgtagtagcggcagtacttcagcttcactcctaccgccgccccgccggggacacccccgacccccggcggggccaccaccgccaccgccgccgccagcgaggaggaggaaggggaggcggcggccgaggggggcgggaggccgccgccactgttcatggcaacgccgcagcctcgtcttccgccgccgcccgaggagccgccgccgccaccaccatagacgggggaggaaaggaagacgctgccggtgccggataaaagcctgggcgggggccgcgcgggacgacggggtgagcgcgcgggcccagacggggacttcgagggcgcgggcaggggaagagggagcggcagcggcaagcgggtggggaaggcggaggggccggtttatttttaaattctgcctccactcgctctctcgcgctctggttcctccgagttgtttattccattttcctcttcctgagacggccgtcgccgctgcgcgtgcgcgctgagacgcgagggcttatgggtagcgggagcgctaggggaagcctggccggcgtcgggcccccgggggcatccgcgagctatcggcggttggaccggcggctctcggtggggttccggacgcggatctggcgccgaattctcacgagacctgataccttccttatttgtatattctcttacttaaaaagccagatgtcttttttttttttttcattgaaaagagaaaattgacaaggtaaacggtcgtttggaggggccacctggggacgcggcccgagccctggctctacctgaagaatatcttctatttgccacacttcctctccccgtttcctttcttcgcccctctcctctttccccttcccctcgaaggtaatgagaactactggaccgattacgctaacctcttggccctttgtcaaaaaatggagccaaaaaggttgatttagacagaccccctgctcagtgcagcacctgttattctctgtatttatattaccaagggccttcggtaaattatgaaaaataggatgccacctgggacaacactgcttagacagcactggaagacctttataaatatactaggttgcttttctccaatcagcctagccttgatttgaaattcatttttattttttttgagacggtgaaattcatttttaaaagatagttttaacctcagcgatctctgatgtttgcgctaatacccttttaaaggctttcagaaattttaaagaattgctatgaaaggaaaagtaacattctagtttttctctgtaaaagaggttcacaaacggcagatcgctgttatgaaaaggaggggtggaagtatttaaggaattgtggcaaacaaagtcacagaagaatggatataagcaaaagtagcacactgaaaaaaatggggaaaagtggagtctagatcacaaactggtaagcttggtgatgttctctagccaaattcgaaggtaataacattgtattatggctttctgtttaaaagcagtttcgcttatttgattattcaacaaatctttattaacacgcattacgtgtaccagaaactgtggtacacttaactgtggagctggggaagcaaaagtgaacatgccgccttaagtgagttcagatggcttatcttccggttggggaggcatcaagtacacaggtccgttgtaaaccagtgtcttaagtgctaaccttatcacatttgctattagaggatattaaacatgtcagacttcttggagaaagttgatattttcatgttccaagtttgggaacatcattgaattcagacagatctggattgaaacagattaaagtgcctacactttaata

SEQ ID NO: 4844 - DNA, 1865 bp, Homo sapiens
acgtgatgccaagagttcgagaccagcctgcccaacacattgaaacttcgtctctactgagaatacaaaaattagccgggtgtggtggcacacgcctgcagtcccagctacatggaaagctgaggcaggagaagggcttgaacccgggaggcggaagttgcagtgaaccgagatcacaccactgcactccagcctgggcagcagagctagactccttcaaaaaaaaaaaaaaaatccccaaggacaaacaaaaccaccaaaaacaactccttagcttaagagattctcccgccttggcctcacaaaatgctgagattacaaacgtaggccaccgcgaccggcaagggccgatcttcatatcgtagccgccaacacctacttgagcgcggccacagagaaggccgctgcgcttcttggagacggctaagtcattagtgatgaactcacataccggaggggcctggacatcttgcacttcactgcaacttcggacttgcaacctttttctttacttcagtctttgacttgggagatagaccaggagtcacggcatgtacagtttcggacatgattgtaggtttggatatctaacagttaaaaaaaaaaaaagtcaggctgcgagtgtgtctgtgattacgtgtgtgtcacacacagacacgctgcgcgctgattggttcccagctcagtctttcagcttggcagcaacctagtctcaaccctgtttctgagttgtgtttgcggaaattcagaaaatcaaaatagtttaaatttcctgaggaggaatcacaccaattctattctacaatgaactggaacggctacggtgttatgatctttacattttctttctctagtttttacttaaggcagcctcggcctttatcaaaagttccaactttcagagattcacagttcagagggacaacttcttgattttcatttaaaatataaattcttccattcgtgtcttcaattgtttgctgtcttctaataatagcctacacatttttggcttctcatacattgaacaactacttgattttcattgagatttaacgaggaaatctgttttatatgagaagagaaacaacaggttctttttgaatttctccacaagaacagcagtacggatacttagaacaacagccctttctgataaaattagctggggctgaaaatatttcatgatagcttcttgtaactatttggacgtttagttactttgggagggttccagtaaatgttcaacgtttccttgggaaaatgggaaatacaatgatcactgattctcctgatattgggactgtttgcatagctgaactcaggagagatccacgaaaggacataaaagagacagagtttgactcatttaagggtcaaaaaaaaattttttttttaaatttttactgggggaaatttgttattaaaatattcatgagtctttgggttcaggggtctgtcatgcttggtgacacggggaaaatagactttggtaaactattcaagtaccaggatcaaagaatatacacacaagcaccacacacacacaaaattccctagagagagaaatttaaaaaacagccatgtttcatattcagtactacatttcttgtttaaacaaggatataggcttatagtgatgaagtacagcttatgttcgatatgagaagaaaatggagtgatggcagaaagtgaattaactgattttcttcactcctcaatgtcttgaacgtatgctgatctggggagcatatacatttctgttttactaagactatgaaggagataaatgctgggaacagacagagtaaagcccaaaaggtgagggtttcacactttttgatctcatcaaaatacaaatgact

SEQ ID NO: 4845 - DNA, 1377 bp, Homo sapiens
ggcaaaactatttcctgatggtggttgcagatcgttcacttcctaacagtgtgttaggttgtgcatttatgttttattcacttttctgtatgttgttttattctgcaggaaatgaatgaaaaagggattctgcctcagctctgagcccctcagagtggggccagggaagaagcagacggcaacgccagggcagctgtctggcagcctggaaggcctgcgaagcttcctaggggtccgaaggagggtagacaggcacggggctcaccacaatccttcggatggaaccacaggaagagaagaagcatgtttcaccctgggctgggggtgcttcccaaagccactggggcccttttcccaagccccagaactgagcccacctgaactcatcttgaaggtaggtatgtcagtgagtcctcccaaagcctcagtttccctatctataaaatgaggaagcaggactgcccctagggcaaggcctaggcctcctgccagcccaccctcacagacccagagggcaacgcagggtgaggcggggcagtttcactccccagtgctgtggcccccttggttgagtgaaagcacctccagagccctaaccctagccctgggagccaggcaagagacccccacaacgaccatcagaggtcgtgaggggtggcagggagcctggcagggagccaggcaggggccagggtctaggctcagagcagtgaaggatagatagggtcacatgccagttagtggcagaggtgggacttgaacccaggcctctgtgagacttggttctctcacctgtaaaatgggtctactagcagctgcttctccaagcaaatgatgtcaagcacccagctcggcacctcacagatgtggtcagtaaatggtaatcccaaccctacccttatatgtggactagaacacttatggcaagtctcgggaggtcatgggaactcctcatggctccttcttcatgctggaggaccacggcctgccccatcccaccccaacacactcttgaaactgaggccctcggcctagagcagctcacacagacgtggacagctgtgctagcaggtgcagagtctgggaggcgaggctggaccagggccccagctgggcttcgggtaaccacaggcctcaactgtccagttggccagagggacctatcacctggctctgggccccaggatgctttagccacttgagccggctccaggtgaccgtgtaagtgacataaagcaaaggtgtcctggactgcaccactcactagctcagcaccccaggcaccaggctggaaaccacatctcgcacccaattctccatttaaaaattttacaggaaggggccaggcacagtggctcatgcctgtaatcccagcac

SEQ ID NO: 4846 - DNA, 1893 bp, Homo sapiens
gcttacccggtcagcccctgggccgagtacccctgggagagaaagcgctaaattcccccaacactcccgtgatgggggcacagggagcgccgtgggacacctgaggaaactgaggcccaagtgttaattaacttgccctgatcacctagcacgtggagccacgacttgctcaagccctgcctgattccagccccggcctttgttcattcagtaaatgtggaaggcgcaagggtaactcgaggcctgcggagggaacgagatgagggaggccgcaagagtcaccgcagagaagagggattggctgtcttggaccctccgagggcctcggggaaggactgcaggagagcggattcttgatggggcttcacaggatgcgcaggagctctccaggctacagagcgcatttcaggaactggactgggatgtacagaggcaccatggtgggaaacagctgggccttcctgcaaagaggggagaggctcttggaggtgcagggcttgcgttttctcaacccagactgcctctgagaacagggcagggggtgtgaagagctgatgccctggccctccccactggctagctttccggggactaaggactaaggctgggccaggattctggggttctaggggctctgcctccacacgccagtgcctgtctgttgagttcacttctctctaaaatctcattttacaccacgacccagtacaaaccactcagaaaaatgtttcattaaaagttcggcatactacatgcatgcactctaatattttcatgtagtctattatttctctaaaaactaaaatgctgatcatgacccacagaattgatttcacaacccacattagttgtgaattacaacttgctaaggagtcagaaccaacatgtagaaaccctctgttcttagcaagcacattctggttacactgtgggggactagcaccaagtccaggagacagaggctggcccagactaagtgtggcaatgagatgcagagacacttaggatgaattggttcccaatccattacctcaatggagtgggagcatgatggttcaagtagcaggctttggagcagaaaacccacctcaaccatcctccaaccgtaaagggtgatgatgattcatgaaacagtccaggaggaggagggacttcaggttttgtttgattcatttcagtggcccaacagtggcatcaaggaccttggctctcccatctcctctgctttcacccaaggctggcttccccttatggccatgagagaacagaggagccttccaaagtgctctctccttcatgggttattagacaccaagctcattcccagagcagtcacgggagtgtggccttcacttttggccagagacagagccaactcctagaaagcggagggagacagtgtcccaacctaatcaatggctcccatgaacgccagggaaaaaaagggaattccactcctccatcctaggaaagttggagtccttccttagggtggaggaagtgggaaacagatgctgataagacctccacggaggtgatgtctggagctgcaaccagggaagacctggctgcagacatatttgagtctttagctcaagagtgaaccccaggctgcaataaagatctgacagttaccaatgctagaaggctgatggacaaagcaatgacgataacccagagagagactgtatgcaactgaaacttcaattgctaaatgtctgtagggctgttgagacagttgcttttcagtgtatccattgcctgaaaattaccagatgtcagaaaaattgaaggagtcttaaatggcaatttcatggacattaagtgatattaaattttttaaagttacaatgctgaccccaataaattacttagaaacagcaaaaaaaaaaa

SEQ ID NO: 4847 - DNA, 1711 bp, Homo sapiens
ttgctcaccccatttatacagcctcactctagagtggattctttgatggtgaatgagccgagtactttggccaaaggctttcccacactggtcacattcaaagggcttcactcccctggtgtgaatcctctcgtgctgagttaggtatttgctgcagctaaaggttttctcacatttgttacacttaaagcacttctctttctgttctgggttctgatccaagatcttcccactcacaaaaaatccttgtttttctctggcgtgaacactctcgtggcacttcagggttgagccgcaaatgaagcgttctccgcactcctgacattcatatggggttttgacagtgtgcattttctggtgttgcacaaggcgattgttatcgctgaaagtctccttgcattcagcacagctatagggcttttctgcggtgtgaatggcctgatgtcgcatcagatgtgagggccggctgaaactcctgacgcattcctgacatttgtggggtctgtagcctgtatgaattcgccgatgttcattaaggtgagtgtgccggtggaaggccttcccacactcactgcatttgtaaggcttctctccactgtgaaccctctgatggatctttagggtagagttatgcctgaaggatttcccacgttcgttacacttataaggctcctctccagcatgaagagcctggtgttcaatgagcagcgaactgtgcctaaaaatcttcccacactcctgacactcagaggtagtttttgcagcgtgagttttctgatgttggatgaggtgttttctcaagttgaaggtcgcctggcacttggaacactcatagcgtttccgagtgtggatcttctggtgccgagtaaggtggaagatccgggtaaaagccttgccgcattcgttacagttgtaggacttactatctgtgtgagttttctgatgctcaccaggctgtgtgtcatgactgggtgggtggtcactatcttgactcttacatggtttttctccagtgtgagttttctgatgccacaggtatgtactctgactaaaagttgtcccatattcattacacacatagaatttgtagcccgtgtgagttttcggatacacagaaagggaagcattccggtcaaaaccttgctcacactcttgatggacagtgggtttctccctagtatgagtgatccagtgctgggtaagacggtaactcccactgaagcttttcccacattcactacattgatatggtttctccccttcctgaacagaatcctgctggctgtggtcggagtaggagaaaaactcacccctatattccttagacttagctggtgtgagggtcttttcagaaacattatgcaccatggaatcttctcccgtggaaacggtggacacaggactgagtcctctctttaattcatgactcttgcattccgtgggactttccccgttggtggcaatatcagacctcagaagactttctggatcgcctagcaaactatctaaccaggtgtcctctatacaggcttctccgaaattggagttccagaagccatccttggataacatctctataatctcctgggagaatccttcttcgaagaaatcctccatcagaggagagttcttggtctcagtcacatctgaaagagcaagtgcaaatgtctcctgttcactaagggtaagtgagcagaagactgaggatttg

SEQ ID NO: 4848 - DNA, 21995 bp, Homo sapiens
ggggcggcgcagccccgcgcggttgtgggatcgctcccgggggccgctcctctctcgggcactggggtcgcgggagacgtcgtcgggagctcggtttctggaggcccttccccacccggcctctgcctcctccactcccccgggctggacggaacggggcccagcgcgggatgcgagaggtatgatttcgctctgtcgcccaggctggagggcagtggcgcaatctcggctcactgcagcctcgaactcctaggctgaagcgattctcccgcctcagcctccaaagtagccggtactacaggcgcgcgccaccacgcctggctaaggtgtgtgtgtgtgtgtgtgtgtgtgtgtctccaaagtagcgaggactacgggtgtgtgtgtgtgtgtgtgtctccaaagtagcgaggactacaggctcccgccactacgccaggctaaggtagggtgtgtatgtgtgttaactttttgtagagatgggatctccctttgtaacacgggcgcccgccactaagccaggctaaggtggtgaatgtgtgtgtgtgtgtgtgttaactttttgtagagatgggatctcgcttcgtaacccgggctggtatcgaactcctgtcttcaaggaatcctcccgtctggactcctcccatgggattacgggcatgagccacggcacctggctattttttttttctaagcatttaaataagctggggcttgatttgggagttttctattgtattttgagctttgccgaggacttgatagtgaccttgctttaagctgtgaaataaatcttggggtcccagagctattttaatattgaattcgctgtggagttgttttgagttccttggaggttaacatgagatagaaaactaagttaacacaactcatcgactgcccttgctttgctttgctttgcttttagaatgccatcgggttttgtcatgttgggaacaagttaacttaggccagttgactaagatcaaggtatgtgaacatgcctggctgggagagaagtagagtaaatgttggttcgcattccctcccgacgcccacaatgccagccatccctgacttttcttgcctttattgggaagaatataaggtggcagaaacaaacttcccaccctttttccaaatatttactgaaggagtcttgaggagagtcttgtggggtgggggggtgggggtgggagctgggaatgtttttgaactagttcttgaaaaaaaaactagtacaatagtacaactgtcttaattttatatatgaggaaactgaggcccagagatgaaatcatgccttgatttatgcagacctcagtacctgttcgtgacaaatccagttactaaaaggtaagagaaggaataagggacttgatatttatctagcatcagcaatgtgtggacatcgtgtgaacggctttataaacatttcatttaattctctacatctagccattttttaacctgtgctttccctccctctcaaagtactgtttatacatttattagtccatattttaaacgctccatgctctcaactgtattaatgctatttgttaggataagtggcagatgtccatggaaaataagtggctgcaaagtggtaatgctgaccagatgagaaaagaagtgtaaaagggaagttctaaagaattaaagccctggagagggtgggtagacaacaacagtccaaaatagtgctcttcattgaggctgtgtagattttcctgcttcctgggaaaactggggcatatttacacttgcatgtgtgtattcagattgtctggggctatggagtttgggtcagattgctgaacccgtgggagagaagttcccttgttgtctgttgttgtctgttctgattgctgctttgtaatttgggccacatatgaaagtcagcatccagtcattggaccataggtgtgtggcatatctactcagatgcattaagctatttttatttcattataaaatgtataacatttacattcaaattatggtttgaagggcttaagaggagaaagagacagtggcactaaggtgacagcatggctggctgcatgcttcctgtccaagaaggtcactgggcagtgttaactgggaagagcatctggaggatgagagatcagtgtagccacatacccttaacaaagggtggtacagcctctggtctgccaggatttttgtgccccgcccccctccccctctttccctatctcctctttgacatttccaccatattccccttaggtatgtacctgtttggactttaatttagagtgtaacttttggtcaagaatcctggagagaaaagacgggtactaaagcctcgctagtgatttacctgggtgccgacccccacaactcatccaccctacatgcatacttcaaactcctccaggcagatactccctgcctgacacacagtgacactttgggaaaaattgcagaacagtaaccaactctgagcagataaatgtgatgtcaaaatgatagtaatgagagatgtcgttcgttgaaagcctgctagctgccatgcactatactatttcttacatctaaatctgattaagttataccccattttataaatagacactttgataagtaaacctatctaagatcaaaatactgagaaatgtcctaattggggatttgaacctggttctaattccaaagtccaagctacatccaccccaacctcctacctcctatctccaagactttgtgagtaaaaaaacaagtgtcacttctctccttctcttttttctgtcctaaaggaagctgggagctaaccacttaggactagtactaatctttcagagaaagggatgaggggagccttgttatttctgtggggttcagctctcagaccagagtaagacaggcaacaaggttgaggagtagccatatgcagaaataacctgtgtatctagccacaggatctccaacactgtgtcactcgggaatcaaaatacagagacagttcctcaatagagtgtggatctagcccagaatgtggacaaggggagtggagaaggggagaggtacacactgagcattgtaacaaggcctgtcctcaagcttgaggaggattaggaagatggcttgagtctgggagtaggaggctgcagtgagctatgattgtaccactgtaccccagcctaggtgacagagtgagaccctgtctcttaaaagaaaaaaaaaattgacctggatctactcatacccaccctggtctttgagcagaaagaatcatttgggaattattttgtctcatctttctccatgatcactgttgaagaatttggtcactgtaaccaggtaaatataaaactcaggtgggccgggcgcggtggttcacacctgtaatcccagcagtttgggaggctgaggtgagtggatcacgaggtcaggagatcaagaccatcctggctaacacagtgaaaccctgtctctattaaaaatacaaaaaattagccaggcgtggtggtgggcgcctatagctccagctgctcgggaggctgaggcaggagaatggtgtgaacccgggaggtggaggttgcagtgagccgagatcgtgccactgcactccagcctgggtgacagagcaagactccgtctcaaaaaaaactcagatgaactatagctaagtcagtgctcttgacacttttttagcaatagtagctttgtttctcacagaaaaaacaaaattttctgtggaaccacactatttaaaacataagcaatattagtatcaacttgtataatttatagatctactgataaaaacaatcaagaatagtctaccttaattgaatcaggaggagataactgcagtcttacatcagccatactcgtatccatgaaatatgagtcagtcatttgcacaactccctgagtcaccttctggaacacagaaaacactgagccaagttagcccaggacctgaaccttttgtggaaaggaaaatctgtagtgtctcctcagagtatggctgccctttcacctggtagtcagtttctcatgacggttactcgagcatttataaggcagttgtgaaataaccaagacattctgtgtgttgtgctactgatgctcctcctgtcaccgacctcctctccaaatgaggcctgccttttgtccttggtagtaggcagtccacagtgtaaccagctacaggggaagtatttactttgatagccacttgaccttgatcaagtcaggtgactcatttctggataacatttttgagagtatactgagccaggcaccttgaggatacgaaagtggattatagtttccattctggagaaactcacagtccagtaagttaaacaatcacaagaacaagtttccagcaatgagagtgattacagccactgagtggtgaaatctgagaaatgcaaagcctgccgcctataaatacctacatttatcgcctgggcatatacctaaaattccaccatgagaaatatatttatatgaaattagaaactacccagaaattgtgcgtccaaataaaaattcccacaagaaataaggatggctaatagttttaagtagtagtgtcaagtcttttggaccagagtaactgccagggacgttgtgttgaggattctgaggtcatgttccagcttagccgagaagggagccaccatgagggaacgagtgagggagggtagcacttgtgccccatattttttcctaagtaaatcatttgttgatggaatgcatgatgaaacagggacagccagggtctctggcatctgggagaaagcccacttggaaactgatttatctacctcaccactgcaagttcaccatttgtccccagactaaatggccttaggaagcccaggctctgtcttgtcgaactctaccttctttatccttccatacttttcaagaagagaaatggtatatatatgtgggatccttgagaactaggatgtacctgtgagcaggcaaagtgtagcatctagcagggtcaggcataagttggaagtgagagaggtggctactgtgctccccaatggctgttctcccatctcccatagtttcaaggcctgttttgtgaggaacagcagtatgcccagctcaaagatgacagctggccacaggactaagtctggccaataagatgtgagtggacgcttccagaaaagctctctaaagaggctacctctagccaggcgcagtggctcacgcctgtaatcctagcactttgggaggccaaggcagtggatcacctgaggtcgagagttcaagaccagcctggccaacatggcaaaaccccgtctctactaaacatacaaaaattagccgggcatggccgtgccgcatgcctgtaatcccagctactcaggaggctgaggagggagaactgcttgaacccaggaggtggaggtttgcagtgagctgagatgttgccactgcactccagcctgcacgacaggagcgagcctccatctcaaaaaaaaaaaaaaaataaaagctgcctcttctctgcttcttggagtatggtcaggatagctggaattctagcatccagttttgaatgccaagtgaccttgaagatagaagccatgaactaagataatgtccctgtgtaagcttcttttacatgagagaaataaactgtgtgtataaatcattgttattttgaattcccaagttgtatgcaggcaaatgtaatcccgatctagccaggaattggtattattcattgataagagcttcatatattcatgttgacagttttccttgattggcccccagatgataggtattgtgaccaagacctgtggggctatcatgtgtacttggctccctataggagaatccaggatggaatggaatgatacagtaggcagcctctggagccaagatacggtataggtaggaaaaagaaatgattcacccaagaggcagattaggcccatgaaaattaggattgtcagatgcattactttaatacagcacttcttcagtattcccagaactgtagctaatggttcctctgaataggaagctccttgaatataccctggcaagaaatctttctatccaaggtgactggcattgggaggggatttattgagtgtctccctcgagccaggcactttcacataccttaatcttagttaactggcttcacttcagaccctgtccctaacaggacaaaacccaacagcattttgaaagcaaaacagggatagttgatgagttgtattaacgtacttgtctctgtctcacgttagtaacctccaaggaactcaaaacgcactgcagctataattcgacattaaaatagccctgggccccccaggagcagctcaatagaccctactgaagcaggcggtcctgtccctcccctgcttaaaatctgtcagtagcttctcattgtttttaactaaaaacccagcccacctgacagtcaggttggcctgctcgccaggctttctccccagctgctcaaacctgctcacaactccctctgtgtctgccactctggcctctcactttactcctgtgacctcgtccctctgagcaccattcctccccacctctgcatgtctttaatctgacttaagcttcaaggcctggcacaaacaatgcttttcctttgtccttcatactggagatcataaactcgcatagattctctctgaataaataaatattttccatgccagttagcatttttttaaaactataatgactgcaaaatatattgtattaggtgtactctaacttatttaacctctccccaaagaatggacatttcatttgtttctttttcaggatgataaaaaacagttacgggatgaaaaaatttttttttattttttatttttagtagagatggggtttcaccatgttagccaggatgatctcgatctcctgaccttgtgatccacccatctgggcctcccaaagtgctgggattacaggcatgagccactgcacccggccggggatgaacatttttatatgctaatctttgtcagcatctgctcatttctataaaaggaatcattagaattggaattcctaggtcattttgaccaaaaaggaacatttttaaatctcttaatattgccatatgacatcttagaaagtttacatcattttacacaaataattgtttccttatcgatgttccaaacctagagaacttttggtcattctgtgatctgtaattggagaaatttccattgctctagcagcattttatacatacttatcaagatgtattatgatttatacacatttatcaagatgtattatgttttacttgcatttctccaagtaagctctgaagtggaaaacagaacttgttttactctttgtagcacagtactgagaacagtaacacctaacaggccctttctaggtaaatctgcagaaacagtaattgtctcaatctcagtttccctgtggtagaccaaaataaagctttgcatacctaacctagggaagctgcatacagttggagagctggattcaactaaacctggcctgacagctcttcaacatgtttttcttttccaagttccacattgctcactgtgtccttttaacactcctgttttttattttatccatcacacgaagttgtagttggttctgcctgcagtgtttctccatgatgtaatataacctcattatatacactcaggagcctgagaaatgagtatcacaaaccacagagtcttcttgttgcttagttactatcctgcatttcctggagactttaccttggcaaagtatatgatgctacgttttaatgaatgttgattggtcactgtatgataaatgccaggaaaaacaatgaatgataaaaagaagtgtaaatcccactcttctgcctatatcccagctccattttcacgtcttttggtatcagccccaggatttggggtcttctgtttgaaaatgagatcagttccgtaacatctgtatagctttgcttgctatggtactgggctggaaagaggcaggtcaaagcgagtgcccccctcactggtgtgccctgaggatgcagaggccctctttgcctggtgataacaccttcaatgcccgttagggggcccaaaattgccagtttattatccctttgggactgatgccttaaaatctcattttgtctttgagaagtggtatttggaatattcacacatcaaagtgttatcgttctctgctagcacagtaccagctagtttatcttagccagctggcttacctctcaaggcactaaaggaacggaaaaacacagggcaatctctgtaagcctcgttccttcacttggtaacctctgaaaagctagagagaaaggaccagtgagagaacaggatcagctcttgctgggggtccagccaggagccaccatggagggcctggagcacttagaggaaaacatggggacatcaggtatgcaggagatcaggcaaaaaacagtaaagtcagcttaggaaagactcgtacctctcacccccactgcctcaacctcctccaaagtgtagagttcatagcttttccttgggaagcttctgtgtatacagtgctcaacagaagagaggaacaggatttaggttactatcttccataccctaaaagtgaacattgtaatattgcaaatacagtagcagaaggaaagcacttctcaggaagtaaaaatacatctactcctgctaacagttttctccattcacaaaatattactgatttttttaaaatttggaaagaatattaatattcatagatgttagattagttgggcaaaatatgctaaaaattgccatttaatttataatagtgaaaaacaatgcaacctaaatgcccatgaatgataactaattacatacagtggactacaatggaattctatgaagtcataaaaataaggatgtacatctgtatttattgttatagaaagaaagccacgaaatattgttgagagagaaagcagattgcaaaactgaatatatatgcaaagagatgtttttagggatattcactgttaaacagtgattaacttagttgacttttttttcctctgttccttcttttttcttttttactttaaatatttatcttttttaaaagaaataatacatttcctccctccaaaaaagaatagcctagcgaaatatttttacttcaaatgcttttccccttattaatctttgtataaaccattgtggtttgctaaaacaaggaaggttgtagagtagaatccatgcccacgttagaacaaaatccaggcaggaagacacttcatacgtggttataagaccaggaggacgaggagacaaagggaagcaatggtgtttgtttgtttgtttgtttgttttaagagacagtgtcactctgtcacccaggttggagtacagtggcaccatcatagctcagtgcagcctccaacccctgggttccagcgatcctcccacctaagcctctctagtatctgggactaccggtatgcaccaccacatccagccaatttttaatttttctttttttgagacagggtcttgctatgttgcccaggctggtctcaaactcctaggctcaagcaaacctcccaaagcactgggattacacgtgtgagccaccacacccggcctagaagcaatggttctgatccaggaaaagtgcagcctggaaactcagcaatctgtacagaatcctagctcttagactaaaaggcatcaactggtacaatttcttgcctttgggcactgaacgtgttagcttctattttatttaacttactgtaaaattatattagctatgctgccacttaagccaagatgctttctgtctagtcacttcggttccatccttttgagcgccctgccgtttcattgcctctcctttctcattcctctccccaaggctgtactttgagtaactgtatgtgcattttcctgtgccttttcattattaaaacactgtaaaaggtaatgtctccaaaatgcaaaccatagtcttctccattgaaaaatattttccaggccaggcactccactgtgccactgcactccacctggatgacagagtgagactctgtctcaaaaaaaaaacaaaaaactcattaaactgtaaaatgggcgcattttattttatgtaaactgtatctcagtaaagtttatttatttatttttgagacaaagtcttgccctgttgcctaggttaaagtgcagtggcataatcatggctccctgcagccttgaactcctgggctcaagcgatcctcctacctcagcctcctcccaagtatttgggaccacgggcatgtgccaccatgcccagctaatttttttttaagagatggcgtcttgctatgttgcccaggctggtctcgaacttctgaccacaagagatcctcctgtcttggcttcccaaagttttgggattacaggcatgaaccaccaggcctgaccaaagttgattttaaaaaatgaaaggggggccaagcgcagtgactcaacccttataatcccagcactttgggaggccgaggcgggtggatcacctgagatagggagttcaagaccagcctgatcaacatggagaaactctgtctctactaaaaaatacaaaattagctgggagtggtggcgcatgcctgtaatcccagctactcgggaggcctcagcttgaaccctgtaggcagaggctgcagtgagctgagatcacgccattgcactccagcctgagcaacaagagcgaaactctgtctcaaaaaaaaaaaaaaaaagggtctgtgcttggtggctcacacctgcaatcccagcactttgggaggccaaggtgggtgaatcacctgaggtcaggagttcgagaccagcctggccaacgtggtgaaacccctctctactaaaaataaaaaaattagccaggtgtgatggcgcacgcctgtagtcccagctactcaggaggctgaggcacaagaattgcttgaacctaggaggcagaggttgcagtgagccgagatcatgccactgcattccagcctgggtgacagagtgagactccatctcaaaaaacaacaaaaatgaaagggaaataagagtcattaccaatataattaggtttaaatttttagttaaaatcaaattttaactgggattgccaaaaatgtccttaacttcatatctccaaataaaatgtctgcagttaatttatgttgtttatacagctagctaattctctatatttttatagtatgttgacacttaaaatttcaatctcttctagtggttccatgagtgggactgaggggatgatgggtgttctcattatagccttcagaaggctgcctatatataagtgtgcacaaataactattattcagagaattagaatcatcacaaaatatcctttatgaaggataaatataggctaatttatcctttatgactgttaaatataggctaatgtttcttttattcttcagacccatttcaactttatagaaaaaaaagtatgcacaaaagcagcactctataattaaaaaaaattccttattggtcttttggattttggttctgcataagtatgagtttctcatcaggcctctctagactactaaagcctaaagtgatgcttcccccatctcagctcttagaggaattactgggtgtcttgtttatttggcaattccgtgcttacaaactcttttcaatgagatcttcagctccttgagaccacagtagatacctacgtatttgtcggtgtaattttgttgtgttgatttactgaattcaaagggtttgtacaaatactttgtttacagggtttcattacaaatccaaataagctcatatgcttagtaattccaaaaatgttataggtattcagattagcattgctcattcatgccatttaatttacagagctcagctgcagtaattttctccagtggatgatgtaaggaaggcattggcagaggagtaagagacttggcttcagagtgggcagtaatagggctaaatctggttttacaaagcaggtactgtaaagctctcattgcctttctgaggacaaggctttgagctatgagtgccagggtcgtctgtctaagtggaggcttcttaaaggaattgagcctcgtttcctgggtttgaggtgtattctttttcacattccctttgtacaccaaatatatttagtatttattatctttgaagtttagacctttggaatttttttttttttttgaggcaaagtctcactgtagcccaggctggagtgcagtggtgtgatctcagctcattgcaacctctgcctcctaggttcaagcgattctcctatatcagcctcctgagtagcgaggactacaggcacgtgcccaccatgccctgctaatttttgtatttttagtagagacagggtttcaccatgttggccaggctggtctcaaactcctgacctcaggtgatctgccttccctggcctccggacatgctgggattacaggtgggagccaccacgccaggccacagtttgatgagttttgagaaagtaatatacgcatgtaaccaccatcaccacaatcaagatctagaacatttccatcaccccaaaattccctggtactcgtccctggtcccaggcaagccctgatctgttttctgtcactgtggatcagatttgtcttttctagagtctcataaaaatgtgatcttataaaatgtatagactcttgtgtgtaaggtttcttttcctcagcataatgtttttagacttgtctatgttgcatgaatgagtggttcatttctgtttatcactgagtatttttccagtgtatgtatataccacaatttgtttatataccacaaatgttgatggacatttaggctttgtccagttttgtctattatgaataaagccattatgaacatctatgtacaagtttttgtgtggacatgttttctcttgggtaaatatctaggagtaagactactgggttgtatgctaagtgtatgtttaattttaaaagaaatggcagccgagtgcggtggctcatgcctgtaatcttagcaatttgggaggccgaggcgggcagatcacctgaggtcaggagttcgagaccagcctggccaacatgacgaaaccctgtgtctactaaaaatacaaaaaaaatttgccacgcatggtggcacacacctgtaatcccgctacttgggaggctaaggcaggagaatcgcttgaacctgggaggtggaggtgagactgagccaagctcacaccactgtactccagcctgagcgacagagcgagactccatctcaaaaaaaataaaaaatggccaaactgttttccaaagtcctggtaccatcttacatcctaccggtaaagttatgagagttgtagttgccctacattctcaccaatacttgctattatcagtctttttaattttcaccatcctaatggatacgtagtggtatctcactgtggttttactttgcatttccctgatggctaatgatgttgacatatttttgtgtgcatgttggatactaatatatctttgtaaagtgcctattcagtgtcttttccaatttagttgggttgctaaaaagtcttcatatattccagatacaatacctttggcaggtatgtagatatgtgttgtgtgactattttctcccagtctgtgacttgtcttcattttgttagcattgtcttttgaagagcagaagtctttaactttgtaaaagtctaattttttgctatcttcttttatagctcttgtctttttttgtttttttgtgtgtgtgtattcaattatctaagaactctttgactcccttcagatcatgtaaatgttctcctgttttattttagaaattttaattttacctttttttttttttttgagacagagtcttgctctgtcacccaggctggagtgtagtgacgtgatctcagctcaccgcagcctctgcctcccaggttccagcaattctgcctcagcttcccaagtagctgggactacaggaggcaagcactgcgatgcccagctaatttttgtatttttagtagagacagggtttcaccatgttggccagtatggtcttgatctcctgacctggtgatccacccgcttcgttctcccatagtgctgggattacaggcgtgagccaccgcacccatccaagttttaccttttaagcttaggtacatgatccaatttgaggtgaattttgtgtatgagtaagttaataatcaatgttcattttttcccatatggatatccagtttttccggtaccatttgttgaaaagactgtctttcccctattgacttactgtggccactttgtcaaaaattacttgcccatagacatgcgggttcatttattttgttccattgatccaaatgttgatcctttaataataatgtagctttatagtcagtcttgaaatttgatagtttgaatattccaactttgttgttctttttcaaaaattttttgcattctaagtcctttgtgtttttatataaattttagaataagttatgtaagtgcctgctgggattttcttttttttgagacagggtcttactatgtcacccagactgaagtgcagtggcatgatcacaggtcattgcatcctcaaccacccagactcaagcaatcctcctgtctcagccttccaagtaactgagaccacaggtgcgtaccaccacacctggctattttgctgctgtttgtttttgtagagatggggtttcaccacattgcccaggctgatcttgaattcctgggctcaagcagtcttcccacctcagcctccaaaagtgctgggattataggtgtgagccatcgtgccccacccctgctgggatttcagttaagattacattgtatctgtggaacaatttgggaaaaatggtcatcatcatatttagtcttgtagttcatagacatagtatatctccatttatttgcgtctttaattttcagcataacattcagcaatgtttttatagttttaattgtataggtgccttgcatgtattatgttaaatttatccctaactagtccatgtttttgatactatagtaaatggtgtttgtgtgtgtgtgtgtgtattttttttttttttttttagacaaagcctcactctgtcacccagactggagtgcagtggtataatcatagctcactacagccttgacctcctgagctcaagcagtcctcctgtctcagcctcccaagtagctgggatgacagtgtgcaccaccacacccagctaatttttttttttttggtcttgctgtgttgcccgggctggactcaagtgatcttcccttctcagcctctcaaagtgctggaattacaggcatgagccaccgtgcccagccagaggtattgtttttgatactatagtaaatattttatttaaatttccaggtggttattgctagtatgcagaaaatatttttttgcattaacctatgctaaagtcacttactattttgatttgcctttcataaagattccttaaatgtttctacatacacaatcatgtcatctgcagatagacagttttatttcttcttttcaatctgtatggttttctttgcctttttcttgcctattgtactggctaggacttccagtgtaatgtttaatagaaatcctgagactggacatccttgccttattttcaatctgaggagaaagcattcagttgttcatcattaacagacaatgttagctgaaggtttttcagagcttgtgtactctaccaggatgaagaaggtcccttctatttccagtttgctaagagttttaaaattgtgaatggatggcgaattttgttatttttctgcatctaataagagaatcatatatggtttttctcctttgttctgttaatatggtaggtatgttgatttttttagtgttaaaacaagcttgcattcttgggataaaccccacttagtcatgatgcattatccttgttatatattgctgaattcagtttgccaaaaatttaactaaggatgtttgcatctgtattcagtgaggtatactgtattcagtgaggtattcctttcaatgtcattgtctgggctcagacaatgactagagaagtcatctttctttgtttttagaatgagtttgtgtgtgtttgttattatttttccttaaatatttgatagaatttactgctgaagccacctcagtctgaagtttctttgcaggaagttttaattcataattaaatttccttagcatatatagggcttttttcttttttctttttttgagacagagtgtcacagtgtctcccgggctggagtgcaatggcgcgatctcagcttactgcagcctttgcctcccgggttcaagcaattctcctgcctcaacctcccaagtagctgggatcacaggcgcctaccaccatgcccagctaattttttgtattttcagtagagacagggtttcactatgttggccaggctggtcccaaactcctgagatgaggataattttttgtatttttagtagagacggggtttcactatgttggcctggctggtctcaaactcctgacctcgtaattcacccacctcggcctcccaaagtgctgggattacaagtgtgagccaccgtgcctggccttctttctagtttcttgaatcactatggttaatctgtggcattcaaccaatttgtccattttatctatgccattgaatttatttacataattataatctttttttgttttaatgtctgcaagatctgtggtgatatctatttcattcctaatgttggtaattttttcttttcctgcttgctcttattgtttgtttgtttgtttgtttgttttgagataggttctcattctgtcacccagaccaggctggaatacagtagcgatcataactcactcagccccaaactcctggtctcaggcagtcctcctgcctcagcgtttcaaattgttgggattacaggcatgagccactgtgttcagcctcttttaattcctatatgtattagccagttgaggtggcttgcttgaacccaagagttctgggcaacacagcaagacctcatctctacaaataattttaaaaattagctggggcatggtggcgcacacctctggtctcagctacttgagaggctgagacaggtggatcacttgagcccaggcagtcaaggcttcggtgagccgtgatcccgccactgcactccggcccaggtgacactatgagactctgtctcaaaaaaataaactatagaaaatctgagtagccctatatgtagtaaggaaatttaattatcagttaaactgtcacctgggtaacagagtgagaccacgtctcaagggaaggggaggggaggggagggtcttgtatttattatttccttccttttacttggttttactttggtttaatttggtttacattggtttaatttgttcttcttttactattttttttttactgaatcatcattattgttctaccactcgaatcaccgcattgctgttgctaaatgaccaatagaccaacagatccttccatagaaacaaaaaaaagcccttgcttttcaatattaccaaagggaaacatatagtcagaactgcaagaaaactgccttgtgatccggcttctgtcacattttagtttacaatacaggagcataaagtagctactcaactacctcgaaaataagagaatcatttacctttctgtatataacctaattaaaaccatgtcagatccagcaaaactgattttcatctctcctcagtagatataggagtatatattgatatttctacttcatgactagataggggactaaattaaaattcgctactcagttctcagttgtaaggcccacagttgcacatgggtaggtgggtagttgcacatgcacagagttggtggtcacaactctgctttcttgcccttctgcttaacatggagctatttaatcttatttatttatttatttatttatttatttagaaatagggtctgctctgtcaccttggctggagtgcagtggcacaatcatggctcactgcagcctagaactcctgggctcaagtgatgttcccaccttagcctcctgagtagctgggactatagacacacacaaccacgctctgccaattttgaaattttttgtagaaatgaggtctccctatgttgcccaggctggtcttgaactcctggcctcaagcagtcctcccacctcagcctcccaagtgctaggattacaggcaagagccacagcgccaggctggaactatgtaagatagcacttagccctgcatgtatgtgttactaacaatggttgtgtagatcactcctccaaagggaaagtctctctagatgggtttttgccccaattaagcaatagcttcctccaaacggtgctcacctatccattgactgcgatatttgaagacaaagtgagtcttcactcaccatcaccattccccacgtcccctttccctgggagcgcacacacttaggagggcagtgctgcttcctccacagcagtgacagctggccaggatttatgaaatgtctctcaaggaaatgtgctctcttccatgctcagagatgccacgtggtcacagtgcagtcttcatgcagttgtagcttagacttccagattcaaaggtcagaaaccagcttggaattttcctggtcctaactcaaacctggcataagtcaaagtttaaatccaacaggttccaaaggaaatcagattaaacacatgtgctgcttggtcatgcaaggaccctggagtagaaaagtaggtattgccgtcttggtcatgaaagccacaacatcaccagcaagaggacaggcacttagatctgttcactgctgtgccctcaactcctggaataggacctggtgcagagtgtgatcagaaagtatttattgagtttcaggtacagtggctcatgcctgtaatcctaacacattggaagaccaaggtgggaggatcacttgagcccaggagtttgagaccagcctgggtgacacagggagaccctatctctataaaaaataaacttaaaaaaaaattgggccctgcacaatggttcacgcctgtaatcccagctctttgggaaactgaagcggatggatcatctgaggtcaggaattcgagaccagcctggccaacatggtgaaacccccatctctactaaaaatagaaaaattagccgggcgtggtggcgggcacctgtaatcccagctactcgggaggctgaggcaggagaatcacttgaacccaagaggtggaggttgcagtgaggcgagattgcaccactgcactccagcctgggcaacagagcgagacttggtctacacgctttgtaatctaaaacattctctaccaatacctcaatcagtgaattcttgctttattgatacattctagtattcagttgtgattttaatatgctattttggtactttctgctttcagttttcattgctgtggctattgccttaaacagaaacaaaaaactaaaacaattttacaaccatccaaaagaggcttggaaacttttttttggctggatatccatagcacaatttaattcagtaaacataaacagttaaaattattccagtacacaaccatgttttaaaaaagagattacacccaattttggcaacaacacccaggaaataagcattcttttacatttggttcaaactttctgaatggcagttgtgcaacacttgttgtgaaaaactttagaatattataaacatgttaatcctgtatttccatttctgtgaattcatccaaaagaaataaccatggatatgggtagagacagagccatatggaatgcacactgcagtggtgaacacatggcccagctctgccatcaaggagaaggtgagaacatgggggaagattttatcgaagtttcttttctggggcatatgctcaggttaaacacctgctctgtatctctagcttctgactcctacccctggccagctctgttactctagtacactgctaggcaggcagagtatggccaaagtattcacaacagtgcatcactaaatcaactgggatccacacaatggaatatcctaatgcatcattaaaaatcacattgtaaaagaagattttataacagaaaaaaatgcactgtatatgatacatttttaaaatgttacttatgccagtcacaataaaagacaattacacttatatgggatagagtagtcaatattatagagacagaaggtagaaatgggtctgggtggaaattagaatgagatgttcttagcattccagttttacaagatgaaaagagtaacggagacagatggcagtggtggttgcatgacattatgaatgtacataattaaaaatgggtaagatggcacagtgagataccatctcacaccagtcaaaatggctattactaaaaagtcaaaaaaataacagatgctggggagcttgtagagaaaagggaatgcttatacactgctagtggcagtgtaagttagtccagccactgtggcaattcctcaaagaacttagaactatcatttgacccagcaatcccattactgggtatatacccaaaggaatataaattgttctgccttaaagacacatgcatgtgattgttcattgcagcactctttataataacaaagacatggaatcaacctaaatgctcatcaacagtagactggataaagaaaatgtggttcatatacaccatggaatactatgcagccataaaaaagaatgagattatttcctttgcaggaacatgaatggagctggaggccatcatccttagtgaactaacacaggagcagaaaaccaaataccacatgttctcatgtgtaagtgggagctaaatgatgagaacacatggacacaaagaggggaacaacagacactgaagcctccttgagggaggagggtaagaggaaggagaagatcagaaaagataactaccaggtactatggtagcttagtacctgggtgatgaaataatctgtacacccaaccctcatgacagaagtttacctgtgtaacaaacctgcacatgtatccctgaaactaaaagttttttaaaaagttatttaatatatatatatttttttgagacggagttttgctcttgttgcccaggctggagtgcggtggcgcaatttcggctcaccacaacctccgcctcccaggttcaagctattcccctgcctcagcctccctagtagctgggattacaggcttgtgccaccacgccggctaattttgtattttttgtagagacggggtttctccatgttggtcaggctggtctcgaactcccgacctcaggtgatccacccccctcggcctcccaaagtgctaggattacaggcatgagccactgcgcccggcaaaaagttatttaatattaatgggacaatactcattgcaagaatcagacttcaattgctagcataagtaaatgacaggcaggagatattgaaaatgcaatcttatagacattcaaggagaggacgcaggacatttctgtgtcataaatgtactatggaaaataaaaatgagaaaaatggaaataaaatacaagaaaaggttatgataaatttcatattattttaccacaataaaaaaattttaataaattataaatggtgtgatatgttttgcctgtgttccacccaaatctcatcttgaattagagctcccacaattcccacgtgttgtggctgggaccctgtgggagataattgaatcatgggggcagtttaccccatactgttctcttggtggtgaataagtctcatgagagttgatggtttgataaggggtttccccttttgcttggctctcattctctcttgactgccaccatgtaagatgtgccttttgccttccaccatgattgtgaagcctcccagccacatggaactgtgagtc

SEQ ID NO: 4849 - DNA, 1501 bp, Homo sapiens
gcactgccctcgcttcctgtgagtcttcaggtcgccgcttgctctcgttcctagggtttggcctgcagtggacgagcatcgcatagcctgcggggctggatgctgaccgcccgggccagcacctaggcggacgcggagctgtgcagaccagggttcgcgcgggccgggtggaggctcaagcggggaccccggagcgtgagccccggagtcggcggcgctggggccagaggggccgggagggagtcggctgaggtggcggcggaggcgaagtggcggcggaggcgaaggggcggcgggacccgggcctggcccgtatgtgtccttggcggcctagactaggccgtcgctgtatggtgagccccagggaggcggatctgggcccccagaaggacacccgcctggatttgccccgtaggcccggcccgggcccctcgggagcagaacagccttggtgaggtggacaggaggggacctcgcgagcagacgcgcgcgccagcgacagcagccccgccccggcctctcgggagccggggggcagaggctgcggagccccaggagggtctatcagccacagtctctgcatgtttccaagagcaacaggaaatgaacacattgcaggggccagtgtcattcaaagatgtggctgtggatttcacccaggaggagtggcggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaatctctttcagctctgaaacatcacacatgtaagattcaagagtttgccgacctaactgaagttgaaactttcggttttcagggggaagctctgagctcactgtgtgcactgagcgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaactgtgagtcaattaaacctcttttcttcataaatta

SEQ ID NO: 4850 - DNA, 2096 bp, Homo sapiens
acttggacctgatgcaaggaaacaacctccagccaccttcccccaggcctttagagtgctggtctttgcacagagaagcaccacagaggacagaagcctccaggactcacccttccccatttctggccctaccaggcagccacagaacagccaaccaggcgcaggtggttcctggtctcgtgcaccaccctcaagagaacacacagagacttagaattagagcaggactcagcccattccccagggctcgcctagctgccatcggatccacacatggacacaggtgggtcccgggtatttgcctccctcgctgcctctgccctgccagctgtgccctccacgcttgcccgccccactgcaataatgcagaagcacacagctggctgaggctgggaggcccccttcagagccgtagtgtggagcaccaacaacatgcatgtggctggggctgggtgacgcatgccacctatggtgagcgtggcaccagtcaggctgcagagaggcagaggatagcccacaccagggctctcagtgtggggaactgcccacgctctcatttccagtgtgaattctcttctatctctaagtggagtgaaggaacaggaacattttccccaaggcccagagctgttaaatcaggggttggaggtcagccctcgccacacattagaatcacctggagaagctgtactacactgacatccaagccctgctccagagcaattacaccagaatgtgtggtgggttggagtagaagaagcaggcattggtattctgatatgaggacgggtgagtgccaaggtctcagccccataacaaggtgaggtcctacaggcctcagaatgtggtagcacgtgggaaattgtcctctcttctcaggaggggccagtgttcacacaggcaggggatggagagtgggcctgatctgagaaggcggaacccaaaactcctgaaggggacagtgtgacagaaggttctacttaagggccactgccactgtccttatcccaggggcacctagtgttctcctaaaggagacttctcaatataaccaggtggaacggtagaaagaatccagatttgatttgattttacccctcaaaagccctgaagaatctagattgtagaggcaggcagagccacatacgagtcttgggtctgccacttactagccatgtgatgtgcagaggagacctgttctcagagcctcagtttcctcacctaggaaatagggtgatgatatctactgtatagggcaggtgttgtaggagtaaataagctgagctacagaaatctcccagccaactgcctggtccacccagggacagaaaaccactcctctgctcacaccccttcactcactcctccctctgcctcagggctccacaaagccctgggtcctctgaagcctagaagggccaggccaggccctgggctccaggagctcaggaggggctgttacctcatcctcttgccgtgtgtgactaaggacgcttgatacttctgcacgcactcctcctggaacacctgcaggagtcttttggctaaatgactgaaattcaccctagaacgacagagaaccaaggtgcagatgagctgccagaaccactatgcacaagcccaccatccctcagtctccgtcagtctccgtcaccaccttgtcgtaagtgcccaagccctgcgtccacagcagggctatgtctctgggaaaggaggaaggacggtcacacacttggattgtgaaggttgcagtggccagcaaagcccacatcaacagggagacgtgggagacacacagggggtcctcagggaacacacatgtgctcaagcttagtcctcaggaaagggaagggaaagtgaggcagccgtggaaagaaggtgtgtgagtgcgtgtgtgtgtgagacaaaaaggggtcggggtgcttgtagaactgggggagtgagttcccagataaccattaaatcagggagggcctcctggacgtgagtgtgtccgggaaacatgggagacagaggagcggggggaggcagggaaggttcaggcagagggcagaagcaggaagtggtaagtggtgcatcagtgaggacaactagag

SEQ ID NO: 4851 - DNA, 15957 bp, Homo sapiens
gcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactgggtaagaagttcagatatttgtcgttttattggtttaagtactatttatacctcatgcaagtatattaaaaaagagaaaagaatgttggctgggcgccgtggctcacgcctgtaatcccagcacttagggaggccaaggcaggcagatcacctgaggtcagaagtttgagaccagcctgaccaacatggtgaaaccccatctcaactaaaaatacaataattagctgggcatggtgcaggggcctgtaatcccagctagtcgtgcggctgaggcagtagcttcagttgaagttgggaggcggaggttgcagtgagctgatatccccccattgcactccagcctgggggacaagggtgaaattccatctcagagaacaaagaaaaaaaagaatgttgttatgctacttgtcactgttgggttttttttttttttgagatggagtctcgccctgttgcccaggctggagtgcaatggcatgatctcggctcactgcagcctccacctccccagttcaagcgattctcctgccttggcctcccaaagtgctgggattacagacgtgaaccaccgtgtccggctttttggtttttggttttttttttttttgagatggagtctcgctttattgctgggctggagtgcaggggtgcgatcttagctcactgcaacttctacctccccggttcaagcaattttcctgcctcagccctccaagtagctgggacgacaggtgtacgccaccacgcccagctaatttttgtattgttagtagagatggggtttcaccatgttggccaagatggtcttgatctcttgatcttgtgatctgcctgcctcctaaagtgctgggattacaggtgtgagccaccgcacccagcccaatttatcattttaaaaccaacaatgggccagttgtagtggctcatgcctgtaatcccagcattttgggaggctgaggtgggtgaatcacctaaggtcaggagttcgagaccagcctggccaacatggtgaaaccccgtcttgactgaaaatagaaaaactatccgggtgtgatggtgggcacctgtaatcccagctactagggaggctgaggcaggagaatcgcttgaacctgggaggcagaggttgtggtgagctgagatcgcaccattacactccagcctgggtgacaagagcaaaactccatctcaaaataaataaaataaaataaaatgaaatgggcgacaagagcaaaactccatcttaaaataaaataagataaaataaaatataaagtataaaacaaaataactaaaataaaaaataaaatgttgtacagcagcaatatccagtatttggcagtgtgcctgacaaaaaatattttcagtctttggaagaaaacttttttgtggagaaaagaaagccatctacatgtactattttttgaaaaaacccttcattatttgttttatttgagacggaggcctgctctgtcgcccaggctggagtgcaatggtgcgatctcagctcactgtgacctccacctcttgggttcaagtgattctcttgcctcagcctcctgagtagctgggattacaggtgaccaccaccatgcctggctaaattttttgtatttttagtggagacagggtttcgccatgttggccaggctggtctcgaacgtgtgacctcaggtgatccgcctgcctcggcctcccaaagtgctgggattacaggtgtgaacaaccatgccaggccaaaacccatcattattattattgttattattgttatttttttgagatggcgtctcactctgtcgccctggctggagtgcagtggtgtgatcttggctcactgcaagctccgcctcccgggttcacgccattctcccgcctcagcctctggagtagctgggactacaggtgcctgccaacacgcctggctaattttgtttttgtatttttagtagagatggtgtttcaccatgttagccaggatggtctcgatctcctgacctcgtgatccactcaccttggcctcccaaaatgctgggattacaggtgtgagccactgcacccagcaaaacccttcattattatgtgaaatttcaaacacggaagtatagtcacgaactaccatgtacctatcaatcagatttaactactgtaacagttcatggctagcgttacttctgtttcccctttcagatgatttcgaagcaaatcttggacatcattttactcataaatatttttgtatataccttaaaacgataaggattgttttaaaaaaagcttagccaagatatgtgtaagagataggaaaaaccaagttgtttcctatcctctcacactcctctcagtactttcccctccttttttttttttttttttttttaaatttgagacagggtctcactgctgttgcttagacaggtgcgcagtggcatgaccttgcctcactacagactccacttcccgggctcaggtaatcctcccacctcagcctcccaaatagttgggactataggttggtgctaccacaccccactaattttttgtatttttagttgagatagatttcaccatgttggctgggtgaggtggctcatgcctgtaatcccagcactttgggaggggcggatcacgaggtcaggagattgagaccatcctggctaacatggtgaaaccccgtctctactaaaaatacaaaaaattagctgggtgtggtggcgggtgcctatagttccagctacttgggaggctgaggcgggagaatggcgtgaaccccagaggcagagcttgcagtgagccgagatcttgccactgcactctagcctgggcgacagagtgagactcttgtctcaaaaaaaaaaaaaaaaattcaccatgttgtccaggccagtcttgaattcctgggctcaagtgatccacctgtcttggcctcccaaagtgctaggattacaggtgtgaaccagtactttatttctgacaccagatatgtaggagttttcccccacacatcaaccagttctccaactgggtatccggtaactcactttaattctgacaccgtctgcctggagactaccacaagactgccttcactcagacactaatctcaattcacaggttgtgaccagtgcttctaatctactggctataagtcagggttcccatgaccactctttttgctttgataattagctaggacggctcacagggaaacactttacttatgtttaacagtttattataaagaatattataaatgatacagatgaacagccagatgaagtaatgcattgggcaaggtatgcggtgggagaggtgcagagcttctgtgccctctctgggtgcaccaactccccagcatccccctgtgttcaactaccctgaagctaatcacatctagtggttcaggagtgtctaggctgggtgcagtggctcacacctataatcccagcactttgggggaccaaggtaggaggatcacttgatcccaggagtttgagacaaacctgggctaacacagtgagatcccgttcaaaaaatcttataaaaattagctgggcatggcggcgcacacctgtagtcccaactacttgggaggctgaggtgagagggtcacttgagcccagaggttgaggctgcagtgagctatgatcatgccactgcatcacagcctgagtaaaaaagcaagagcctgtctcaaaaaaaaaaaaaaaaaaaaaatttctatagatcttaatttccagcttccccagagattggtgggtggggatgaaagttccaattatctaacccgtcagtttttttagtgagcagcagtcccatcctgaggcctagggatcccacactaagtcacttcaatagcataaatttaggtgggatccaaaggggcttctaatgaataacaaaagacagctcctatcactcaggaaattccaagggtttcagaagctgtgtggcaggaacctgaaacaaagaccaaatatatatatatatttttgagacagagtctcgctctgtcgcccagactggagtgcagtggtgtgatctcgactcactgcaagctccgcctcccgggtgcacgccattctcctgtctcagcctcctgagtagctgggactataggcaccgggcaccatgcctggctaattttttttttttttttttgtatttttagtagagacagggtttcaccctgttagccaggatggtctcgatctcctgccctcatgatccgcccccctcagcctcccaaagtgctgggattacaggagtgagccaccgcacctggccaaatatatttcatattatgccacaatatcatcacatcaaaaaacaattttaatatcctcaaacgatagacaaagacatgctatctgaggcatttacaaatgttttaaacaatttagtgaatgtttgtactatcacagtataggtaccttgtatttgccattttaagcatataatacaacatgttttgaacaaggattgtcttatttggctatgtcggctttttgttgttatttacttatttatttttttgagttgcccagactggagggcaatagtgtaatctaggctcactgcaacctctgcctcctggttcaagcaattttcctgcctcagcctccccagtagctgggattataggcacgtgccaccaccacctgactaacttttgtatttttagtagagacagggtttcaccatgttggccaggctgatctcaaactcttgaagtcaagtgatccgcctgcctcaacctcccaaagtgaagctttttatttttaatttttttattttcaatttttgtgggtacatagtagatgtatatatttgtgggtatgtaagttttatagcccctggtactttgctttgtaaaataggttctcagtaatattttgagaatattaaattgaatttagacctgtaatactgtcttgttaaaaaatgaaatcttgctgctttggagaatgttttaaaatggcacaatctgggctgggcacggtggctcacgcctgtaatcccagcactttgggagcctgaggtgggtgggtcacctgagatcaggagtttgagatcagcctggccaacgtgatgaaaccctgtctctactaaagatacaaaaattaaccgggtgtgggtggcgggcacctgtagtcccagttactcgggaggctgaggcaggagaatcgcttgaacctgggaggcggaggttgcagtgagcctagattgtgccattgcactccagcctgggcgacgagagcaaaactctgtctaaaaaaaaaaaaaatgggcacaatctgttggaaagagcttgggatttggaattgggggacctaggtttaaggcccagccccacagtctactagatgagtaacattggatgggttttccaatttctgatccttcataaccctgttgtgtgtgtatcatctaccttggacgtttcttgaagagattaagatgttgggtgtagtagcttataaacagcaaagtactttataaatattattttaaattcttgtaatttttcttagtaaagcatgtatacattttacctaagaggaacttggggagttattaaatttttaaatttttgaaaaattgtctcaagactatgatctcctttgatttttgtggacaaattattgaactttcttgatttactattacatctttggactgcagtttctacctctgatctaaacacatgaatctaaattgattatctctttgaaaaatctacttagctttagcacgtaaatagaaaataccattgggataatttatggaagtagtattcatcattatatgggaagttactcataagagatttttttttttttttttttagtgttcttccagacttggcaattagattacatttagaccgtcgaattaaaagtgattccctgtgagctgtcctagcaaattatgaaattgaagagaggggttgcgggaaccctagtttcctaccatgagacagtttgacttacttttctttaaaagttgaaaattctcatatgggcattatttatctcatgcttggtattggagtctttccctgggtattcatagtacacttgaggaaactaagactttgacccttttaatagcaagtttgtctgtatgtgggggtatgagctgtcttggttgctaagtgcactagtggaaaggatgaattactataaaaccccgataaaatatgtgctgtgaagggtctggaaatgataatggtacaaattttttttaaatgttttttatgttcttgaaagctgtaagtgtgtgtaggacatatgaaatacagattttttttctttttcttgagacagagtctctctctgtcgcccaggctagagtgcagtgggacgatctcagcttattgcaacctccgcctcccaggtttgaggaattcttcctcagccccctgagtagctgggattacaggcgtgcaccaccatgcctggctaattttttgtatttctagtagagacggggtttcaccatgctggccaggctggtctcgaactcctgacctcgtgatctgcctgccgcagcctcccaaagtgttgggattacaggcgtgagccaccgcgcccagctgaaatacagactttttttttttttttttttagaagtgttatactaggctggggacagtggctcatgtctgtaatcctagtacactttgtgaggctgaggcaggtggattgcttgaggccaggagttggagaccagcctggccaacatggtgaaaccccatctctactaaaaatacaaaaattaggtgggcatggtgactggcgtctataatcccagctgctcgggaggcttaggcaggagaattgcttgaacctaggaggtggaggttgcagtgagctgagattgtgccactgcactgacacctggcgacagagtgagactccgtctcaaaacaaaaacaaaaactaagggaaaaagagggaggactggcatggtgtggtggctcacatttgtaaatcttgaggcaggaggattgcttgagcccaggagttcaagaccagcctgggcaacatagtgagaccccgtctctattaaaaaaaataatagtaaaaaagagggaaatggcagctgagtaggcagcctcaatatcttttcctgattagtaatataattgactgtaagacctgagggagaagatgagcctagagtacaaatgctgctgccaccccctgaggtctggagggattggctgaaaaaacagggtgaactaggagctaagcaggcccattctttttttttttttttttcttttcatggagatggagtctcactctgtggcccaggctgtagtgtggtggtactatctcagtttactgcaacctccgccttctgggttccagcgattctcctgcctcagtgtcccgagtagctgggactacaggtgcacaccgccatgcctggctaattttttgtattttagtagagacggggtttcaccatattgcccaggctggtctcaaactcctgagctcatgcaagccacatgccttggcctctcaaagtgcaaggattacaggtgtgaaccatcacgcctggcttcaggcccattctttttttttttttttttttttgagacggagtcttgctctgttgcccaggctggagtgcagtggcgccatctccactcactgcaagctctgcctcccgggttcatgccattctcctgcctcagcctccagagtaagctgggactacaggcacccgccaccacgcccggctaatttgtgcatttttagtagagacggggtttcaccatgttgcccaggctggcctcgaactcctgacctcgtgatccacctgcctcggcctcccaaagtgctggaattacaggcataagccaccatgcctggccttgaaaccatctttcaaaatgtggtctttttgcagtacagctgggatgtctctgtctttcccaccatgcacctttgtaaaggggcggcttctgtctcgctggtgtaacagatttcttccctgtgtcccctttctcttctgtcaatgaatcatgggtggctgtcggctggggaccactctcagtgtctcatacactgaatgcaacatggacacaaacttatgatagggccaggtgggggacagcaagaggtgagcaccggaaattgcatgagctaggagtcactggctggtggtgggtgagggacacgtggtagggacagtttagcagctggatcagggtggaaatccaaatcctgacagctgagaagtggcacagacctgcttctgtgaggacaagtgtcccctggccctggccaactggcctccagggggtattgttggaatatgcggtcatcccaaagcacttcagcttgaagaagatctaggacacagtttgttgttaccacctcagagcatttagatgggacgtgatggatggaattgaagttgaaaacccattcaccatttctagttagtacagtaggctcctaatttacagaaatgcttgtgaaattgagaatcatgataaaatcctcatacctcctcctcttttgaccaaatctttctaaaatgcacaattataatttcttatctttaggaaaaagtaattatgttatatgtgttatatacactatgtaaatatagttcattaaatcattctttggtgtttgaagactttctaattcattacttcattccagacatcaatgacaacagcacataccgagcaggtacacatatgagctacctactaatatgccctgattttgattgtattttgtgaaaaccttggtatgggttatttttaaatgaatgttttcccaaattttaagctgaaactaggatgcatcaaaattatcttggtcataatcttgtcaatgatgtcatctaaaggccaccaggaacacacctgtagcccagcaaagttgaggccatcgactggctcatcacaacaaggaaggctgtgcaccactgggacccagcagcagctcagcagcagcagtgagagggccttgggaaagacttggagggtttggcttatacaaggtgatcttggggagggtcaaggaaacaggctgtgatggttaatattgagtgtcaacttgattggattgaaggatgcaaaggattgttcctgggtgtatatgtgagagtgtggccaaaggagattaacattttagtcagtggactgggagaggcacacccaccctcaatctgggtgggcatcatctaatcagctgccacagcagctaaaataaagcaggcagaagttggaatgagcagacttgctgagtgttccagccttcatctttctcccatgctggatgcttcctgccctcgaacatcagactccaagttcttcagcttttttttttttttttggactcttggacttacagcattggtttgccaggggctcccaggcctctagccgcagactgaaggctgcactgtgagcctccctacctttgaagtttgggactcagactggcttcttggctcctcagcttgcagtcggcctattgtgagacttccccttgtgatcatgtgagccaattctcctgataaactcaccttcatatatacatctatcctattagttctatccgtttagagaaccctgactaatacacaggccatgctcagatggagtgctgtctggaaatgggagtaattctgtggttgaatgtcttaattgtcctggaaggtgggagaaatggaatgaggctggtgctacaattgatgtaaaagcagcagctgctcacataagccggggtggaggatgcctaggcgtatttgtggtattgaccatgttcttgtttttgtttgtgaccagaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttatttatgtgctactttgtctttctccctctctgtgtatatacacatacatacaaaaatgtattcattctatggaaaacatgaaagatgtaatattctttacatatttaattaatgtattttttctgatcatatgaacaccacaaatataattttataatttttttacctaacaataagtcttaaacataaatatacatggacaatatcatagttttttttttaatcataattaaaatggttgtgaaacattccactttaattcattcctcctaatccctagggtggtacattaagtgagggtttctcagcctcggtaccatgggcagtttgggttagcccatccttttcagagacactgccctggacactgcaggatgtggcttcacattctggtctctgcccactggatgccagaaacatcccttccccttagctgtggtaatcaacactgtcactagacattgccaaatgtcccctggaggacaaaatcaccctaggttgagaaccagtggcattttttttaaactatcattgtaagacaaagccacctgaacttccttgctgatgtctcttcacttcttttttttttttttttttgagacagagtcttgctctgttgcccaggctggagtgcagtggcatgatctcggctcactgcaagctccgcctcccaggttcacaccattctcctgcctcagcctcctgagtagctgggattacaggcgcccgccaccacacctggctaatttttttgtgtttttagtagagacggggtttcaccatgttagccaggataggctcgatctcctgacctcatgatccgcccaccttggcctcccaaagtgctgggattacaggcatgagccaccacgcctggcctcaacttctatctaattctattcagagggaaaatttctagaagcgacattcctgttgcagagaagagatattcacttgagaaccttgatatatatttgccaaatttctgtccaagtatcatttttaaaaagttaaaaacatgactttcatagaaacacatacggagcatatgtcaaagatgtatttctctaatgcaatgagacagccagcaagacagtgaggctgcagcagcatggggacagagtgcagaaagaggtcgcagaagccttggaagaacgtcattcagtcatacaaggacaccctgatgcttgcgctgcggtcctttccaagtccacggggcgttgttcctttgtgtcaacaccagataagactcatggggattgctgtcagtgttgtgtatgttataataccagggaccctcacatggctgtgttagattctaaccaatagaaaataataagtcaaagcaaagaccgttactgattccttccattgtttctttagagactttggtttagtgctctaaactttctgattatcagatcttatgtgtttgctaatatataaaataacaaattaggcataatgccctataattttctgcttgattaattgcctgaaatttgatctatcagtcagtgtttgattagaatagagaaatcacatgtaatttgaacaaggaaagattaatacgaagaattgctagctataacagggtttggagcaatgaggattggctagtaaaaagtaaagagaactctaaggaatataagaataacagataaaaggagcgtcaacccctggggttgagatacaacatccagggcctctgggattcagatccagaccctgtttgagggggcatggctgtggctcactgaatgaagagaagttgctgtggtagaaatctgtctcatcagaatcactctgctgtaatactgccttgtggaggtactggtggaagatactcggtgctgctgactgctatgcacttcaggagcctgacaatggagcaaactgcacgggttctggatctggacactggagaagctgtgttgcagtacagaagcctgccaagaggagcacacaagactcttggaaagaagaggaaaatctcctcttacaatgtcgatctaagatcatgccaactagcaaaggaaaaatgtttaaagggtccaagttcatttctgcagagcagacatgaaaggttgaattcagagctgagagacaataagtggacaactggcacatttggtcaaacttgtaattttatatcttagatggacaaattaaacacaagtccataggtgttttccttacaagcttacatttaaatttgggatcctggtcagaattttgctaaggacttcattctttcccagtgtttcaggaaggataccctggggccagagccacttttctttattgtaaggtcctgggctgtggccccttttgcttttctgggctcctttctcatgggcatctgttttgggagcttcatttcctcatctgctttgacactttaatcttggacattgtagtgaaatgcttcacattgtcacacattctaatctcagagaccactccaaatctttttgaattttcttggccattggaattagtactctggaatcagtacattaagaatggttttttaaaaactatcagctagaatttccacattttagaagaaatggtcagtataaatttggagaagcagtttctagctagtagtagctgtgcagaaaaacagttttattgataagtatctgatttggatttaggatccagctaggatgaaaaattcaattgaggtctggccagatagacataaattttatttttcctttatattctgtgtccaaaagacaaattgtcatgagttattatttttttcctgaagtatccgtttgtttctcagctttggaattagaggtgtagaaaataaacgggactcaacagcctaagattttgtttaaaaagatgttcttatttatttatatttaaaaatttctaaactttttttttgcaagaaactgtatgtcagcattttcatttttgatagataaattttatatttgggattttgattattaagttgtttctccaccagaattccttatggatttttgtaataatctgtatttagtgtgtttaattatttgctttccatttatatttattttgggatttcttttttaagagaatggcacctgtgacagcatactgttaatattacccttgtatcgtactttaccatgccatctctgaagaatattacagaccattttggagcatggtgaataacaaatttttaccttaggagttcacttgaatagtcatttttatatttgtgactgcaagtcacttttaggggctgtacttccttagtactggtagcattattatccaatggacttttaaagctttcattaggttttcttttgtttttgttctttaaagaacattttacttaacttagtatttcatttttcatctatattatgaggcagtaagagtcttctgtttttccaaagttgagactgctttatatttatttcatattgtctacagctgtagtgttcaatacattagccactagccacatgtggttatttaaatacgataaaataaaaactggccggtcgtggtggctcacgcctgtaatcccagcactttgggaggccgaggcgggcagatcatgaggtcaggagatcgagaccatccttactaagatggtgaaaccccatctctattaaaaatacaaaaaattagccgggcgtggtggcgggcgcctgcagtcccagctactcaggaggctgaggcaggagaatggcgtgaacctgggaggcagagtttgcagtgagccgagatggtgccactgcactccagcctgggggacagagcgagactccatctcaaaaaaaaaaaaaaaaaattattaagttctttagttgcactagccatatttcaaatacttgatggatacatgtggctagtggctaacataatggatagcacagatataaaacatttcctcctcatataaagttctattggatagtgctggtctgtagcttataggatggtatcttagtctccttcagctgctaaaacagaataccataaattaggtagcttaaacagtaggtattttgaccaggcgtggtggcttatgcctgtattcctaacactttgggaggccgaggcaggtggataacttgagctcaggagtttgagactagcctgggcagcatttcaaaaccttgtctctacaaaaattagctgggcatggtggtgcacgcctgtagtctgagctacttgggaggctgaggtgggagaattgcttgaacctgggaggcggaggttgcagtgagccatgatcgcacccctgtactccagcctggatgacagaatgagactctgtctcaaaaaaaaaaaaaaaaacaaaaaacaaaaaaaaacaagagatatttctcacagttctggaggctggaagtgcaagatcaaagtgttggcaaattacgtttcttaaagagggtctgcttcctagattggaaatggccatcttctctcagtatcctcacatggtagggagaaaagcagctctagtgtctcttcttataaaggaagtaatgccaccataggggctctattctcatgacctcatctaaacctaattctctcctaaaggccacgcctcccaatatcctcaccttgggggttagg

SEQ ID NO: 4852 - DNA, 1534 bp, Homo sapiens
tctccctcctcctccactctgctcaggtccctctcactcttttttttttttaaccgctacgccacagtccccgggagaattcagatcccaaccggggcttccggattctgtagtggctttggcctgtgtctggtctgaggacgcccggaaggcattgcactgaggctaagggaaaggtctctggagggagcctcaggaagagcaaatggaggccagagactggcaggagcgcgccagcgcaggatttaatcccgacgagcggattcagagccgtgcttatataaagcttcaggaagcgccgttccgacgatgaggtcgacacgcgagaggcgacctcaagagcggcggcgccagggatctgtgcgccaagggaggacgggagggagcaggttcgccataattcctggctccaggctctgttttgttggaccgagccactgtattttagctcacacaggagaattctggccctgggaaaattggtctcagcatgctgccaagctttctcatggacgtcagcgaatcccaacacactgtcggtcaaagccgtgctggaagaaacaaaacagttctccctcggtagaactgagaggggattggtccagggcccccgccgataccaaaatccaggttgctcaagtctctcatagaaagtggcgtagtatttgcacataactatgcacatcctcccgtgtactttaaatagtctctaaattacttcgtaacacctaatccagtgtaaatgctatgtaagtaattgttatactgtttttatttttactatcttttgttgtacttttttttaaaaaagaaattcatttgtttaatattttcggtcttggggaacccgcgtatatggagggcctgctacatagagaagactgagggatattctgtgcatccgtttctacggatcctctaaatcggcctttgttttcagccaggatttagtgcccagctgtgtcctttggaggccccacatggagctagcaaagtttgctaaatcgggttttgcaagaggactgtctgctccatactgggagtagttaccgcaaactgccctatgaaattggttggggttcttactgttagcatgtttattactttatcagggctctctgtaggagagtctatgagaaaatcttctggtttctgctgaaagaatcgtgttttgttggggtttttttcccgaaaaatattatttttaaaaactcttctgtgccctgtttaatctctcccttggatccaccttctgtgtgctcataaatcgtaaatctgtattcagacttctggactcgagacacgtagatccacctggtggttcttcagtcattttaagcccaaaactcaaaatctcccgaaatcaaaatgtttaaacttataatctccagggtgtgactcacgggggatgaggggagcaattctctccctccccgcataaagctggttctcctgtctgctcattgaacggttccactgcgcatcacagcatctacatgcctaaaccaacaccccagcattggcaacagatatc

SEQ ID NO: 4853 - DNA, 2444 bp, Homo sapiens
ttcccgtctgtgcttcggggttccctgacccccccatcctgcagcccaccttcctgcagtgtcgtggcagggtctgttgcctaggcgggagtgcagtggcatcataggtcactgtagcctccgcctccagggctcaagggatcctcccacctcagcctctggagtagctgggaccacaatcacacaccaccatgccctgctccttttttttttttttttttgagatgggagtctcgatctgttacccaggctggagtgcagtgacacaatctcagctcactgcaacctctgcctcccaggttcaagtgattctcctgcctcagcctcccgagtaactgggactacaggcgcgtgccaccatgcctggcttttgttttgttttgttttgttttgtatttttagtagagacagggtttcaccatgtttgccaggatagtctcgatctcttgaccttgtgatctgcctgcctcagcctcccaaagtgctgggattacaggtgtgagccaccatgcctggtcaccctgctactttttaatactttttagtagagatggggtctcactatgttgcccaggctggtctccaactcatgggctcaactcatcctcctatcttggcctcccaaagcgctgggattacaggtgtgagccactgtgcctggcctgattacatttttaaaatgagatttccccacccctacagtgagattccacataaaaatccagatttctgctttccctagaaaaacggacctggcaacattcccgtggcacaggacgcctactctccagttgccacaggccctgccacccccctgcccttcattctggtctcctttctggtcctttttaggcacctgcgtttgccctagattaggagtcagctagctgtctgtaaagggccagatggcaactattttgagctttatgggccaggtggtttgtggcagctactcttcacctgcagccccagagcacaaggcaatgcagaaaggaatgggtgttgctgtgttccaataaaactttatttacaaatcaggctgtggccagatgtggcccacaggctgtagttgttggacctctaccgtagaccatcatgaggcctggggttcttcgagaacaagaactccttggttgattccccagggcgacaccgactcctaggcgccctccagagccaagcagcttgcgacttctgagcgctgagagccaccttggcggcctcccggaagacgtcctccacattctcccgaaacttggcggaacattccaggtctgtcttgcagccgatgagcaccatggggatcccgcggcagaaatgcgtgacctcagggaaccactgtggagggaggaggcgggatcaggggtgcggccgggcccagatgtggggccaccacccaggaggccggcctcaccttgatgaggacgttgtcgtagctggtgggattcatgacgtcatagcagatgagcacgagtttcaaacttacagtaaaattgcaacacgagtatgaagagctctctgactgtgattcaccacctgtttgcattggcccctctgactttatctggagacagacacttctgtttctccctgtcagggcacggtaactgtagacatctgcctcttcaccccttagctcagcgcctatctgctgagaacaagggcgttctctcccctgccccaagcccccagaaaccgcatggactctgcattctaatctgatccacagaccatagtcagattttgaccatttcaccaatattgtcctttatttttttccccgttgaggagccagcccagcccagggttctacactgcacttagtcatcctgccccggtatttttttaaaatccccacagtgagaactgagagcttttcaggctcattggtgaccagccccccgcccctccacttccttccactgaacaaggaacgtggaggcccaggaatccccctgccctgtccgcagctgttgcaggtgctgggtggcaccagcctgccccccgttccttctctgccagacacctctcaggacaagtggcctctccacggagtaccaccaggccatgtctgctcctaaccccttgctggtgatggggcatggccaccctctccccactggatccccctcaacccagggacctccaaaagtcttcagccagctcccccatggaacagtgcttaagggtgaggtcactagagacagatgagacacatgttcaaatcccagctctgccctcactggctgtgtgaccttgacttagacaggacagtggtgggagtcttggcttccccatctgggacatgaaaatcataaaatctacctcacggggctgtcaccagccaaggcacaccattgcactccagcctgggtgacaagagcgaaactctgtctcaaaaaaaataaaaataaaaataaaaaatgaattaacataaagcattc

SEQ ID NO: 4854 - DNA, 2416 bp, Homo sapiens
tgcatttcctctacatttattgcaacggctaaatgattaacaacattcacaacttcttagatcttaaaaaacagaaacaaaagaaaacttccattttgtaacatcacaaatgtcttctaggctttatcaaggaccaaaaacactacaattctctaagtgatttccagtgatggaaacaagccagagacagtaaagcacccagagtggcgagagagcacttccagatgcctgttgtcctctcgggggtgaccctggaactagaacgacagaaaagacactgtgactttgacacggctgtgccaccacacatcacgcgcgacacgaggatcctgcagagcggcctctgcagagagcaaggacagcctcggttaagagggaggggctgggggcacggagggccagtggcatctcctctatcccggctggccggcagctggcagcacgcaccatgctctgctggctcccgacaccttcactgccccagcgctgaatccacaggagaggtgtcctctgagagtgtagggggctttctaggttcaaggagatgtgccctttgacccctgccaaggactcacagaaccatctcagctcaaacttggaggagcggcaggaggtggggggcggtcagtggccacacgccacagattcctaaagcatttaactttttaataaaatgaagtggagaaagtcaagaatgaacatgctaggacaaagcacatggaatggtcagggcgatgctggagagagtgcgcttgatccacgctgcaggtgtgtgcgcctcgctcgggtcaatgggctgagccccgcttggagctccatccattcacctgacccatggccaacatggaagctgtcggaggggtcaggaaaggagaaggagaaaggagaagatgaaccccccgcacctgtgactccccaaaaccagctccactccaggcccccacaggctggttcgttcgagggttgggttataaacccaaactccatcctccatgctggcacctctactgccataaagatctgccagttgccaaagctacagaagccactggaagcaagcagagcccctgggggtggtggcactgcaaggtgacagggaccaggcagacaaggagctgggaccacagcctaggaagtctgtggcttaaagaaagccaggatttccttttttttttttgagacagagtctcgctctgttgccaggctggagtgcggtggcacaatctcggctcactgcaacctccgcctcccgggttcaagtgattctcctgcctcagcctcctgagtagctgggactacaagcgcccgccaccacgcccagctaattttttgcatttttagtagagacagggtttcaccatgttggccaggatggtctcgatctcttgacctcgtgatccatccgcctcaacctcctaaagtgctgggattacaggcttgagccactgtgcctggcccaaagccaggatttctttacagccaatacaagtggcatttcccgctcagttctgtggctgatgccctagccactgctgtgtcccctaatcctggggtgtcagagggatcctaagttttccagatttttgcccatacttaaaacttcaacgatcctgcttcacaaggaaggatgagtggagaattgagtggagttacacgcagcagagtgctggggaatctggagagcgggggcgatcacatgcctggaaatagagcagctgcagagcccaccccaggaggagcctgcctctccttacaaaggctgtaataagacagcacttgacgatgccatacgtgcgaaaagtgcagagtctcagagggtttacaacccccatccctttgtaactgtagtttgcttacactgtggattctaaagagacatgtaaatctggggccgatttcatctgtttaatgattactccccacccgatagagctattctatactgttgctaaaatttcattaagtctctcaagatgcattgatgagatgagacaccatgaataacacattcatcaactcaagtatggcaactgttcagagagcttcagagctttggtacccgagtgcagacttggtaattaccgggaatttgtctcccccgtataaattctggcgaacaacgagaaaacaccatctgtgatcgtttccacatcacgtttgctaacagagcacttctggagagcaatggccagtccaactggaaaatcagccagaggagctggttcctcagcactcacaggctgaggtgcctttcgggggcagcgccaccttctgaaggggaaccaagacagatttggaggggacttgctgctaaaagcatgtgaacagagaggagaggcaaaagcacattgaaaatggtgcatgtttttttctttgagagaaagaaaagccagcgaaacctccgccccagagactg

SEQ ID NO: 4855 - DNA, 2094 bp, Homo sapiens
ggaaaagttccggcaagccctgtggacaggtttgcgaatctggactcagcttctgcaatccagacctcagtttcctcatctctaaaagggggagaatggtacctagagcatggagcagtgaggaagcccaggatgtgacgcacaggagctcgccaaaaagagataatgagctgcccagtggtgatgaggttgaggggacataggtgacaggaaaatcggcccatgtccaagaacccttcaggccctgggactcaaggatgctaaaagacacacagcaaaaagcaaacaagtttgtgcatctggccagggtcccctcctgcctgcctagggatcagattcatccttcactgggatctaccaggaatgctggaagcttccccaggccaaccaccttcccgatggggacaatgaatgatgcagcacatcagatgatggtgccacatccctcctgctgctggcttcaaacaaagcccttctgtgtccccaagcctcccataccaactatggccaagatttcctccttgctgggctctggcaggaagtgtgagcccattgtctggatgtggaaaatcggggtcaaagtgcctttcttgaaggctagttgagacgattaaatgagaccataaatgtgagggatccgtggaccatgccccgcaaaggcactctgcagggagaactccctgagaaagacaaaagggggcaggtgcggggaagagggaaaagacaatgggatccaggagtgcctgcggagtctctgtgggctggagataccaaaaatgaccaacagggtgaggacaagtgaccttccaacctaaggaatatgaggcaatgtacagggatgaatctggacagagcccaaatccctaccaccagggaacttgagccagtggcaccttctgcggcacttcaatttcctcctctgtaaaatgaggtgaagatgccaacctggtggggtgtctggtaggactgaaggagccctggcactgtgtttggcacacagcaggtgctcagtaagcataacatccaaagatgacctacagcatgtgtccagaccctatacacacatacagctcactggcccctatacctgccctatacctacctcatacctagccctctacctctgtgtctttgcatacaaagcaagggagacagggagggttccaaacaaggctggtaccagggatggggatgcatctcaggagagggcctcaagccaacacctacagagccagccttgctacccaatcccctccatgagactcctaatgacaccccctcccctcctctctgactttgcctgttctgcctcacccaaaagaacaagggctcttggctgggcatggtggttcatgcctgtaatcccagcactttgggagcccaaggcaggaggatagcttaaacccagtagtttgagaacagcctgggaaacagagtgagaccctgtctctacacaaaattaaaaaattagccaggcgtgatgacatgcaccagtagttctagctactggggaggctgaggtgggaggatcacttgagcctgggaagtcgaggctacagtaagttatgattgtgccactgcactccagcctgggtgacagagtgaaaccctgactcaaaaaagcaaaaaaccaaaaacaaaaaagtgagggctctggatcccagtcctagcacttacaactgagtgatgctgagcaagggacacaacctctctgagcttcagtgtccacagggatagaatggccatattatctcacggactcaccagaacttgatacaagtacaaatcagttagagaaaaagtccaatgggggccaggtgcagtggctcacacctgtaattccagcactttgggagacggaggcaggtggatcacttgaggccaggagttcgagaccagcctggctaacatggtgaaaccccatctctactaaaaatacaaaaaattagccgggcatggtggtgggcatctgtggtcccagctactcaggaggctgagacaggagaatggcttgaacccacgagatggaggttgcggtgagccgagatcgcgccactgcactccagcctgggtgacagagcaagactccaactc

SEQ ID NO: 4856 - DNA, 7680 bp, Homo sapiens
agccccagcgctggctgcggcggaacccacggcgtaccttcccgcctccaacaaactatccggttgctgaggttgatttagcaacaccccagggcatctgggttggcaggagcaccacagtgacagcctggcccaggctcgggtacgggaggcagcccagtggcccgcagtagagggccaggctggggaccagggagctggggctgaggagaatttgtacagcctagggaggcgcagcacagcagtatcagcctctggcatttgtaccacctttagtcctgccactttctctcactgtggcttcgcaacagacttgggaaccaagaaaggcataggtgaggaagctgaagcccagtctgggctcgcggaagaaactggtggatccaacttctgcatagcgcaaatatctgcttcctgcctccacccacccattcccacttcccctgattggggaactctagagccccacatcagagttcaacatgtgcctcaggagcttcagcacctcttttgtgggaggagagtccgctggtgactggggctgcaggccatgacatcagcctgcccagcttcacctcaggctgcttccaacagtgccaagtgaggtcccttggcaggatccctgcaaggcagcggctggccaccaggaggcagcagcctactctacaaggcactttcttcattccaaccccttgtaacaggtctgaggaaacctgttcgcccagccatgtgctgcaaccatcctccactcccaatcttatctcccaatagcacagattcccctatcatgagtccagacttggccttcatctcctcttgccttcctctgtccaaggaatcactacagagattctttctctatccttctttgtaaatttccagaaaattgtttccccagggcccctccccttgaagaaattaaacaggaagctggagtagactgtcccttctttcccccacctctcacactccaaagctctgtttaactctgtgggccagtggctagattccccaacatggatgacagagaatacacatgcaataagaatgttttcgctgccaccagccactcacagacacactgtctcccaccctctgaaggcattgtgcccaatccccagccactcactgtctagtcagggctgcccctgcaggacttgccttggctgaggaccagctagcttcaagccactctgaagtcagcttgctgtttcccctggagcctggtaatacatccttcttcaggtgaacaaaagcagaaaaagcccagtgaaccccactgcaacaaagagcctgccatcagtcttccttctgttcctgcctatctcatcacccaagggctatcccagagcccactatgttctaagatctattcctttcaccaccacccagccaaacaactatccagacaattccttgatcaaacaacactgccttcttgagtttaaattttattttacaaaaagagaaataaagaaaactgataggcagttatactgacttacaattgttctgtttgcttttttttaaaaaagtgacatgaaacacaagtaaaaataaatacgtcatagaaacagccagttgcccagtctctggggcaggagcgcctgccctgctgagaggagggaagcccatgatcacaccagcagctggatcacccagccacagatgctcctcgaagccaggcacaggtcccaggcctcaggggcgtcctgaggaaagaagacggaaaaccaaagccaggtgccaggaccctggggccacctcattatcccccactcctcctggcagcagtctggtcttagtggttatccatagcgaccccccttaacccacctggaccctcttcccctgacctctctgaagatggtacaagggaaaaacctgtcttgggcaggctgggggggattcttctggtgagtccccagcccaccctgagtaacacaaccagataacagtcattttacacccaggtgcacatgagcacagcacacaaacacacacacacacactcacacacacacacacacacagctgggctgagctctcttccagggagggtcctgggtccagtcacagtatgaggtcctctctcttctgaatatcatcccagtagtggcagcagagagtacccaaacctccccaagccctctgcattgcagacactgcagcctgcttggctacccctccccaacacactagattactatgtcaaatagacctgcaaaagggaaaggtgcacactcaggtccctgaagagcaaagaagttggacactgcctgctcaagaagttcattgttataagactcaggtattcataaaaggcctagggctaagctagtagcacagaaaagccgttaaggggatcacagcagaatacacagggcagaagagaagagttggcagcaggggaacggagtctcaaggtgaccaatagagagcacaacattctcaaatagtccttgaggtgctgattcctgggagtagtcagcagagggccagaacatctcccaggggtccttttggggaaggatgacttcacttagttttaggggtgaagagccactgagctgggtgcacagaaggccatggctcagaagggaaagactgatctgagaaatcaaaaggaagtgggggccaggagcagtggctcacgcctgtaatcccatcactgggaggccgaggagggtggatcacttgaggtcaggagttcaaggccagcctggccaacgtggtgaaaccccgtctctactaaaaaatatacaaattagctgggcatggtggtgtgcacctgtaatcccagctacttgggaggctgaggcaggaggatcgcttgaaaccgggagtggaggttgcacggagccaagatcacaccattgcactcaagcctgggtgacagagcaagactctgtctcaaaaaaaaaaaaaaggaagtgggaagcagaaggtaatatccagaacactagtaacaaggaatgtaaagcccccagaagaccttccccatgggatgaggactcaatttcagagcaatgccaggtttgaatagactcacacagagggcccttctctgctgacaactttgggagtgatggtcctacccaggccacttaagtttggctaagtgtttcaaccaatctgcaaaactgtaccccagcactttgcttcctgctcctgaattgagaaatttcatatttagttgtgaatcacaagcatatagagactccacacactaattcctagggaagagagctccaaggatcacaagcatatagagactccacacactaattcctagggaagagagctccaaggaccagacagaattatccttaaatcaggagatgatgagatagatgcctaaaaagcataactcaaaggggtgtggacttcatagatatccaatctaaagaaaatgatatgacccaacatggttcacttcctttcttaaatagctactttgtccctgttcaatttttatctacaaatatattaagaaaaggaaatcaagcatcactataaatggtaaacctcaatcattaagtagtactgtgttccccaggctgagaacttggctaaaccagatgaatggggcttgagaggcccttgaaaacattccatggaagacaatggtaagggaaaacgcctaggcctgattttctgccctccctcttatcaccagccaccctgcccccctcaggcctggataatgggtggaagacaccaccaagtgtttatgatcaaagaaactataaaacatggttcttaggctctgagatacttcctgcttccctcacaaacatgcttatgtttggtgtgcatgcacatttgcctatcagcacatataaagagacagtggaaaagtcagaagtgttttcaggttattttctttaaaaaaaaaaaaaaaaaaaaaaaaaaaaaaaaaaagcaaaaaccatggacctggtagcactccaatttcccatgatcccacccccaacccctctacacaatagaaactgcacatataaaagaaagccttctctagtcaggtcagcctcccagaatgatggcctctgctgagtagaagcaagacccagtccctggaacactggatagacagtaggcatgtgctgcctctcagaatacccatttactttctgtcaacttcaaaagccaagcccatccctccagggaatggtttcagttcccggctgggaaggtttccggattcttggaggctagtacagtgatttcctagaagtgaacacagaaatactacccccttctcccgacaacacacacacacagacatacacatgcacacatgcatctctgggatcccagtgctccagggcctgagaggcatcagtgtaacccaggttctgagtgtgtcccataaattggagattcagtctagctcactcctactgcaccagcctcaacctgagagctcactccaactgagtcccttcaccatccattcttgggatgcatctgaaagagaaagcactggttggaactgctatttttaaattattaaaataatttgcatagctaaattgtagatctaaggcttccatgagtagaagagttaagtgtctggcagggtgcttatgaaaacacaaagcttcttaagttccacttttggtgttattggacagcagacaaacacacatatacacatgcaccccatccatcatctccttgtctcttctctgaggacaataccccagagtctgctaaggccctccaaagatggaaatgggctggtcagaagagctgtaggagctactactgggatgacctgactaagctgccttctgggctgggaagaggcaggtacaccacctgcccagtaaggagggagccatgggtaagtggtaaagctctaaagccaaagtttgttcatcataaagaactgtctggcaaagtgttggggtgggggatacagagggggcggggacaccagtaggaagacagccagtgtttatgcttaaggactagacgaccctcccctggcaatggcaataaggggagacccagaatgactggtgtgttcttttaagataaaacccagacttagggctcctacagagaaagggctcctccatgttccttcaaagatggaggcagcagacaccaggcctacatggaccacctgaagatattttcgaacatgaaatcaacagtccctcaacccagcaaccgcctatccacagcttcactattcagcatagagagccaacatctaacatcatcccaggaggacacagctccaaatctggggtctcttacttcccaattgcaaactccatgatcacaactttcgatttctgtggaatgagtcccaccctccactaactatccagtctcaggattccctgatcttcctgaaaagccatctctcaaaaatatagttgtttaatccaaaccttggtcaaacctaactcttcccctggtcaatttaccatccatccaggattgtttttcaccagtggctatagggtctgggatatcttaaaacttccctttctatcacctaccctccttacccctaacctccccccacccccaaataaacaagacacatgaaaagtccaagtaataaataattgcccataagaaataaattaacatggagctctctaaaggggaaggaaaggaacagaaaagactaccaggataggcagctgggggctcagttctaccctggtgaaaaatgtattttccagccacaactctgcgacctttcattcacgtactgcagtgcttctccctcccagcctctgcacacagacaaccttccaagctggaaagggagagctgctcagagatagccaccggggttaagagacatagattggtaatgcccattttctctcatgaatttccccaaattctcacacaaatgtggctctgaataccagggacttgagttagctgggccttctcttcacccatcccgaaggaaacttgttatttccatggctcttctgggctcaccctgatgttcacactaggtgccatgaaccaccaaactgacttccatttaaagaaagataaattcatttttcagtttccctcttagttcttccctccctcccctcccaccttcacccctgctctgttccatacatacacatacaaaataaacatacacacacacactcacaaacacacatacctggtcagcttccttcccaccccctaaaaagaccccacttcacatgggatcacagtctgctccccctacccaccctccttctctcactcattctcccttccttcactcccctccccaggccaagctaagtcacctagtaaggcagctctcttgggaaagaatgttcccaaagacagaaatgggatgtgcgcttctacactcagatgggcgagcaagcaagcagacagcataagcaaggcaggaaggaaaagaggctgcactgcccctccatccctgttttgggtccctgatttcccgctattgctgctgtgttggacttttttttttttttttttttttttgcctcttttgttaaacagcaacagagctctgccactttggccaaccaccctcctttgtcctcttccttttccctcctgccaagtgtcctattctcaaaaggtctaaatcactgcctttcagcttggtgggcaacctgctgggggccccaagtgaggtggggaggggctccctagctatttcccagtgacctctatcacatcatcgtctttatcctcatcatcattggagctgaacccaacctcggcaacctcatgagagtcaaatggaggcacctgggaccgtaggaggccaccagctgggtagcctgcatgtggggacatgtagcctggatagatagacatgccccgcgaaaggttgctgggcaagacaggggaaggaaaaggcgcaaacatcctcggctcggacaggagtggctgtgagaatgggagtgaatagctgggtagtatccctggcacagaagggttgagcatgaaggaggggttgctggcagtgactgaggtagccgtggaagaggaactgacggggcctgctggcaccagagggtcagtagtcactggaaacaccaggcgggcatctgccagcaaattggacagctggtagtaggagggggtactgcccataaacagggagttctccccagcctgggaggtgaagggggtggtgaggttatggtttaaggagacgggtggcatggcaaacccgccagagactggatacccgtgttcatacggctgcacgggggctggcagatgacccttcctggaccgccggcgggatgactcctgggcagcaggtggtgtggccaactttcgcttgtggccccttaagtccagcactgggtgcctgtcaccacagggctggccagtcaccaagagggaactattgaggcaatgaccccctagtcgaggctcagttccgagagctgtcccgggaacagcactgctgtccataagttgggccggggggccaggcagggcggcattggtgcttggggagctctgacgggattcccgggcagcagccacatctgcatactgctgaagctcactgatgatctctgggctgtcaggagagacgggcctggccagcccctcagggtcgggggctttgggtgatgaggcactgtgtctgccgttgcttgtggactcgcaagaaggtccctgggaacctgggga

SEQ ID NO: 4857 - DNA, 2685 bp, Homo sapiens
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctc

SEQ ID NO: 4858 - DNA, 752 bp, Homo sapiens
tggcaccacagggacacagaaaccactgaggcccaaggtgtgctccagccccaccaagtcttctccctaaagctcctgagatcttggggctggctgggcaggctagggctctgtatcacagtcctgccgggatcaagtctattttttcagtttcattaaaaacagctgggggaggggcaggcacatgcattaagccccttccgtaggcagagccatggatggacagccccatgggggccttgaaggcagaggccctggaagcagcaaaaacggggctggataaagctactaatgggagggatggtagagcccagctccccagtcccccacaacccagcccagaacctacaaagagctgaagaggccctgggtactgagacgtctctccttacttcacagtcagaaaaatggacccagcgatggccacagatgtgcccaagattagaacccagggactcactctcctagcccaggactttctgctaccccttccctttatagacctgctggaagaggagggggacgcacatctgctctagggccctgtacagaggcacgggggtcggggcatccttcaggggagcaacatggcagcagggccaggggcggggctcagcctgctcctgtacacagtgcccgccggccacctgcctcctcactggggcagacgctcccacctccaggccttggtctttgctgtctcgtctgctgggccattgcttctcggtcctcacagtcccagctgcagctcc

SEQ ID NO: 4859 - DNA, 3134 bp, Homo sapiens
ggacaaaagccatggctgcttgttatccggtcaatggaacgggttatgtacgtcatgttgataatccaaatggagacggaagacgtgtgaaatgtattacattacgttaaagaacgggatgccaagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggacttccagttccccagccagatggggtcacaatgctgcagaaaagtgaagagctttggaatgaagatctcccggacttcaaggagattcagaaaacgtccagtgcaggtgggaaatgaatgggagctagcattccaccaacaaagtcagccctgggattctaaactcggacaagccagcactggttaagggctgaggggaaccaggcactcagtgcacccagtttactattctgtggtgtggaaagcacaggacttgagaagcaggtggcacccaggaaagcctgttcccctaagtaagtttgaactttagttacttgaaaaaaggtataactgaattatgagtgtttatgattttatctttattttattttttttgagatggagtctcaccctgtcacccaggctggaatgcagtggcacaatctcggttcactgcagcctctacctctcaggttcaagcaattctcctgcctcaccctcctgagtagtggggattacaggtgtgccaccaccatgcccgtctctaatttttatatttttagtagagacggggtttcaccatgttggccaggctggtcttgaactcctgacctcaagtgatccacccaccttggccccccacaaagtgctgggattacaggcgtgagccactgtgcctggtctatctttaaattcctatctgaatttgtttaggttttttaaataaaaatctttctttttttttagagacaggggttcaccatggtgcccaggctgatctcgaactcctcctggactcaagctatcctcccacctcagcctcccaaagtactgggattacagacatgagccacatgcttgacctgaattttaactgcagttaattatcacttaaccagcgaattcacacaggagaaatcccctggccgggcgcggtggctcacacctgtaatcccagctcttcgggaggccgaggtgggtagatcacaaggtcaagagatcaagaccattctggccaacatggtgaaactccgtctgtaccaaaaatacaaaaattacctgggcatggtggtacgtgcctgtaatcccagctacttggcaggctgaggcaggagcattgcttgaacccatgaggtggaggttgcagtgagccgagatcacgccactgcactcaagcctgggtgacagagcaagactccatctctactacaaaaaaaaaaaaaaaaaaaattcaaccaccttaggaagcctctcatttatgtatttctagcatgtaattagtgttgcacatgggaagggctaatagatgctgacagagtgaacaacttatctattttgtgtgtgtgtgtgtaacagggtctcattctgttgcccaggctggaatacagtggcatgatcacagctcactgcaaacttcaactgccaggctcaggcaaccctcccacctcagcctcttgaatagctgggactgcaggctcataccaccacaaccagctaacttgtatttttagtagagacaaggtttcgccatgttgctcaggctagtctcgaactcctggactcaagtgatccacctgtcttggctgcctacattgctgggattacaggcatgagccaccatgcccagccaaatttttttttttttttaagggaagggatcttgctatgttgcccaggctggtctcaaactcctcagctcaagcaatctgcccacctcagcctctgaaagtgctgggattacaggcatgagccaccatgtccagcacactttaatattcactatgggccctcaaaaggaaatgtttgtggggccaccaaaagcaaatgtctcttgaacctagtcacctggggggacaagtgtgggaaagtgcacctgtg

SEQ ID NO: 4860 - DNA, 2715 bp, Homo sapiens
gtttcgacatgtgtgcattccagagatgtatagaaatttttgttacttataaatttttgggaaagaagtcaggtactcaatgccagctttagataatagggacatgtaattacttctaaattcctcagagaaggagttttgcctctggatggtctgcttaatggccaccaccaggtggtctttgctctcctcattttcccctaataaatatcttggtcaaatctttgaccctttgtataccctcatgctcctgtctacctgctgcctattagggtctccagaaagggaaaacagcacggtgaaggggagcatcaaatctgtctggctacttctgcatgaaggaaatgaagggtcatgaaaaacttgtccatgggccagggtggaaggaatggtgggggaccagattccatcaagaggccccatgtaaatggaagttgctgttgcaggctggtattgggcttgcaaggtcatctataggtgaaatcattataatctagaagatataaacttaatgagagtggtaaaaaggcagggaccaaatagtaaaagaagaatgatgaggaataaaggtccaaggaatgggagaagccaagtgatttttggaaaccaaccagtaaaggttttggcccagttttgattactttgagaaagtatatgctagctcactttggctatcacttatttttgcatttcatgtccaatataatctcacgggaaaacatccacccagtccagtctccgtgatcctttgatgtcttctgacagagcaagtgatggctctctagtgagtgactttgataaaagcctgtctagtcaaaccccagaagaaactgaacattggtggatgatggatttgggttccaaatggactatgaatgttgtgtcagtcaccaactgaagagaatgtattcatggacaaataaagacacttgcgattttaattgggtactcacttgctcagagtggcaagacaaattccaggtaagggttgaaattttaagtgttaaaaatatcaagttaacaactcattaagctttcatatcattttatgcccattcagcagtagttcttatttccacttatagtttgaagaattaactgcagacagcgttcttaacatttgtataatctagctatatggaaatacactattctcaagtgaatatttaatatattcatcaagttggtctttcagcttgctaaaatgaaactcatttcttgcaggtaaaatgggcatttaataacatttaccagtaatttgcttacaacaattaattcagtcaaaatcacccaagcagttgatacatattattatatactacatctttttctagaattaaaaaattaatgtgtagtgccagccctagatgtaagttacatatatcaactctatccaattttgtcagccataaaacttacctttttcacatacttctaactctaacaatgtgagaaatgtagatcattgcaattatacccacaaggcagatggctacatgcagaatggatagcagaatctagctacttacgctagccacatggtagacgttttttcctttgtttttgcaaaattgcaatataagttgcatatcgttagagtgaaagatgtaaagaacccatagaagcagtgatgaaggacatttatattttcaacttacaaaagaccttaaaattgcctatgtggagcagaactgaggagggcaaacatcgtaaaaattttgttctatttgatttggcacatatactcacagtactttgttaacttcttaaaaatatctatttggaaaaacagtttataaatatgagaataatgtaatgattacccagaagcctacaaaatttcctttttattgttatctgtaaactgtttgcaaggtattttaatttcctgttggtcattaattattgctacaactgcatagttaatgtagttaatatttcaatattatctctaatgttgtctcacaggaaacatataactcagtctatcaccttcaatcaatccagatcacttgagaaagccattgtattagaaaaaattacatatattcaaaaaccaatgagaggcagatccctggtatatggtggatttgggcttttcagaaaaatttgcttcagtcaccaaccaaagaaattgttgccacgaataaacaaatgaagctataattctagttggagatttatttgaaaatggtaccacattaaatcccaggtacgaatccaagttttgagttctagaaggatcatggcatgcttatcctttttgttttcaccaaccctgagaggtagtctacattccaagattagaacataatgaagttagaagggctgcattctatgaggcagggagaattagacatggaattacagagcttttcattgcaatttccatgactgttatttatgtgaacttacacaaatctaaggatcactctgagccacagtttctttatcctattctgaaatctctttaaaggacttgagtccaagctctctcccacactgcaagaccccactgcaatggctcctatagctgctgccatggcctcctccaatcaagtcagccttactatcttaaaaaaagtaaataagggcagctaaacgccatggcaaatgtatacctatgtaacaaacctgcacgttctgcacatgtatcccagaacttaaagtaaaatttaaaaaaaagaaaaaataaataaataataacatctcttt

SEQ ID NO: 4861 - DNA, 2433 bp, Homo sapiens
cctgggcaacaagagtgaaattccatctcaaaaaataaaaataaaaaagaactgaataaaagcgcaacaaactccccacaggggccgggggcgggggagaaaaaaaagcatagtagctcattcctgtaatcccagcattttggaaggccgaggcaggaggatcactggagtccaggagttcaaggctagcctgggcaagataagacactgcctttacaaaaaaaaaaaaaaaattatccaggcatggtggtacatgcctgtggtcctagctacttgggagactgaggccggaatattgcttgagcccaagacgtcaaagctgcagtgagccatgactgtgccactgtgatccagcctgggcaacaaagcaagaccctgtctctaacaaaaaagtgagtacgaaactgaaaatgaataccatagcacaaagccagtaggaggcagcctaggaaaagctgggttcctgccatactgcacacagcacttcacttcatttcctttcccttttgacaataatcaccaggaatcctaggggtgacaagatgccatggcttcctcagattaaaattctcagtgtcattaacagaggtggcttcacctccttctgccagcagggttgtacagatccattatgagcaaacagagcaagggcctggagaatgcgaggcttgggaatacaggacccagttgtcaccttccatgtaagtctcagtgtgacaggtgacaaggtgggcagccttgtaagatgctccccaccaattccctccctgagaataggctggaactagtgactggcacctaacagacagagtgcaacagtgatgaagttatgagagactgcggcttttgtcttgctctcgttctctccagctgtccttgcttgtgacctttgatggagacagctgccatgtcgtaggctgccctgaggactactccgtagcatgatgaagggcagagggcgatctttagccaatagccataagaaaccaagatccttacttagcctgacagtctgtgaggaactgactcctgcaacaactatacgagtgagcagggaagcaggccctcccccagtgaagcctggaacacaccttcactgcagcctgcagagacatggactgcagcctggagagacgctcaggactcagctcagccatgcgcagattcccgacccacagaaactgtgatgaaatagatgtgtgttattttaagtggctacgttttgaggtaatttgttatggcacattagaaaactaatacaccttgataaataatgtgcttaaagagataataaatcactactgttaagtctaaaagggcatttgtaaattatttatataggatcaactaagccaatggaggttatatcagcttcaaaaaggaaaaccagaacttcaaaatctggagccgctgggcgcagtggctcacgcctgtaatcccagcactttgggaggctgaggcaggcggatcatgaggtcaagagttcgagaccagcctgaccaacatggtgaaaccccgtctctactgaaaatacaaaaattagccaggcggggtggtgcatgcctgtaatcccagctactcaggaggctgaggcaggagaatcgctttaacctgggaggcggaggttgcagtgagccaagattgcgccactgcactctagcctgggcaacagagtgagacgctgtcttgaaaaaaaaaaaaaaacacatacacaacaaccaaaagacaacaacaacaaaagtgagctcttcctaggcacggtggctcttgtttgtaatccccccagcactttgcgaggccatggcaagaagatcacttaagcccaggagttcaagaccagcctgagcaacatagggagactctgtctctactaaaaatttgaaaagaaaaaaaaaacaaaactgagctgtctcatttacatgaaatgttcaaaataagcaaatctatagagacagaaagtagattcgtggttgccatgccagatgagaaagaatgactgctgacaggcagcgactactttttggggtgataaaatgtcctggaattagatcattgtggtggttatgcaaccttgtgaatgtacactttaaaatgggacatttttatggtttctggatttgatttcaatttaaaaaaaaaatttaagtgagctcttatggagggaagctaacacttccatttaacatctccccaaatagttatgttccattcccgcacccaggatgatagacttgcactgctcgaggaggacacataaatgacggtgtgacactggcctgatgacgcagctcagatctcattccagatgttagatccctgttcttaagacttaaaggaccgggcatggtggctcacccctgcaatcccagcactttgggaggccgaggcaggtgaatcacctgaggtcaggagttccagaccagcctggccaac

SEQ ID NO: 4862 - DNA, 1592 bp, Homo sapiens
gggcttcgtgtcctgcgttccgggagcgccaacccctccaggttaggaatctgagagtacgggctgcgcgcacctggggcgggtgcctgggaggaggtggaggaggagacggtcctcagaacgggtcctgggggtcggaggcgagggcgggggttgtaagtggccgggagaggtccctcccgcgggtcccggcgccccccgccccgtcggggacgcacctacttcgtgcagtttgtgcagcgagcgcgccagctcctagttggagaggtcgctgatgcgcgccgcgtggcagaaggcgagccccgcgtgggagcgccccccaacccccgcagcctgggctgagccgcagagcccgctgcttcttgaagtagtagcttggagaagagaggcggggcggccgcctcagacactcccagccctctctgtctcacaggtgcggaagccaaagcagggccggaagccgctgctttgtctttgtcctggggcgacttggggcccaggaaacagactcagaattcagggctcccgtctctagggcaggaatatcaggggtccctgcggggggcagggtttgctcctcccattgtgggcccaggagctggtatggttgtgcccacctcatcaccccccgtgccaacttggagggcacaaagccccggcccagcagcttgaacagcatttccaagaacagggtctgcagtccctgggggtacagagctggctgttcctcacccggcttgggggcaaaaaaggtgaaggagggtgaggagggggcaccccctaagccaggcccacccctcctccaccagccttgcccctcacccatgcactgagccaagcggtggttgtcatcgaagacacccaggaagtcaatgaagcttacgattccatcacctggggagagaggagagggggtgctgtgggtgcctgccccctgcagaaggcctgccttgcacatgcctgctggcagttccaggtgttagagaatctagtcctgcctctagccaagggcagaccccagtttcaatgggggagaaacggcccatgccttgggggttcccaaatcaggattaggatgaacacagcagcaacgtttacaggccatgagataggtgtgttggtcagggcaggcttcctggaagagggaactttaaaataggaccaggccaggattttgtgggaaggggaggcattctttaaaagaatgcctggaggtgggaggggacaagaagacagggttggggcacccaccatccaagtctgcctgccgcagagcctcgaacgtctcctgtggactcagctggatacccacattgcccagggcaactttcatgctgtgcatgtccacggtgcctgttgggctggagctgaagagtttgaagatatcctggaaggctgagggtagaggggacaggtggcaagacgaaccacccacacaagaaccctgagagctgcccactctaactcaggtggaactgacgacttggctcattccaactccctcctgggtgttttaaatttttatttatttatttatttatttttgagacagagtctcactctttgcccaggctggagtgcagtggcgagat

SEQ ID NO: 4863 - DNA, 2142 bp, Homo sapiens
cccgtctctactagaaatacaaaattagctgggcgtggtggcacatgcctgtaatcccagctactcgggaagctgaggcaggagaatcgcttgaacctgggaggcagaggttgtggtgagccaagatcgcgccactgcactccagcctgggcgacaaaagcaaaactccgtctcaaaaaaaaaaaaaaaaagcaactgttaacaaaatgtaagtgtctttccctttaaaggtacccaatttttattattttgactttagatgtattttaatggagttgcaggaattctaagataaacagcttcctacaaggggcaaaactcaaagtagttccaattttacttaaaaacaacaacaacaacaacgacaacaagcggccgggcacgacggctcatgcttgtaatcccagcacttcagaaggccgaggcgagcggatcacctgacgtcaggagttcaagaccagcctagccaacatggtgaaaccccgtctctacgaaaaactacaaaaagtagcagggcatgacggcgggtgcctgtaatcccagctactcgggaggctgaggtgggagaatcacttgatcctgggaggcggtggttgcagtgggcggagatcacgccattgcaatccagcctgggcgactgagcgagacaccatctcaaaaaaaaaaaaaaaaaaaaaaaacaagcaaacaaaaactgaataaatgctagagttagattagaaaccaagagttgtggcatgtggacttattttactctctcaacaaatcctgcagccacctggaacttccttcagtttctccttcaagttgtaatactgcgactggtcactgtcaattctgaagcctctaccttccataggagctagatgaaaaccgttaaaaatgcttttttgttaacagaaacccaagatgctaccagcggttgttaaggcagcaaaacagccaacatgtttatttcacctttcaaattgagattacttttagaacaaaaaaaaagtgtcagtgtcaatgcgtttacactgaaatcatgttaatttcaagggaaacaaataacgaagggtattaatccttacagccattttccaaccttgttctcttttacttgaattctccatcactaaaaattactcaaaaccaggtggaaaactcaaggacaaattctttaaacacgtccaagtgccacaaagcacacactctgccggagagacaatttagaaaccagcttcactgttgtcacagtgctggccacatgaaatggttctttgcacctgcaggacgttttcacggtcgtttcgtattcagcactaagagaaagcctacgtaagtattccaaaaaccaccttcatttattcctttcctctaaactgagctccaggcagaggtgaaatgctgggcctgctgaccttcacacaatgtcagactccactgactagcttcaacaagagctgacagcagttttctgaccttcagcgggacgcgaccctaagaatcgaaagagaggaacctcaccgattcagaacaggcctcggagagctagcgcccaagccctgaccttcacccaagatcccccttctagggccgctgtcagccgaagacaggaatcttgaggccctgtctctggacaccatcgagttaactgtctgccctgtaccattctgcctctgcgcaggtgacgagcaaaagggcacctgtgtcgcctgctctgtccagccggagaagccacgggtgcaagatggcggcattcgccacagcccctcgccctcctgcagagagcgcccgagccggcgcaccaccaccctgcagccccacccggccgcctgcatcatgccggccttcggtgctcaccagtccggcccgccgaggaagggcgcggaccacggccgcagcaacgcgcacggacagcatctttgcagttactccgcaggcggtacttctgcagccgcagcctccggactgactgggacaaaatggccgagccgcaaagaaggtcaagacagccggcccacctgacccggaagtactgcccctcgcgttcaccacctctccccccgcccccgccgccactctgcattttttggcaggttacttatttttttatgtaacatttttaagtttaaacctcaaaatgaatgattagatata

SEQ ID NO: 4864 - DNA, 2145 bp, Homo sapiens
ttttggcaactacactgctgaccttgtgctgagctcagggagggaggtgcagcaggcagacagggcccaggtaggggtgcagtggctgacagacctctgtcttggcacagccattaggctcaggcccctgtgtgcgggctcaggtccctccttcatcacagggtggtattggcaccagcctgggggagcagttcatggggctgggtgtgctggaagagacgtgctgagaagttagggaccccaggttctctctgactttgttttctgtttttattttgctcacatagatttgtgagttgttaaaaaagaagggctcctggggccaagaactcggaagaggggtggtatttgggaaaaacagccccatcccccttgggtgccgtggcctggacaatcccagagcatcagcatacctgagttcaggattgagcccattatggccgagagaggccctggtccccgtctcaggaaagttgctccgaggctccaggcgctctaggaaccagaaccctgggctccacagcagggccaggtgtctcctcaggtgctgtggtctcatcttagtgccacctcagccagtgtacaaccttgggcaagtcacgccccctcctggagactctgaaaatggaacagaaaggtgtggtcatctgtgtgttcctctgtgatctggaaatgctacaacctttgcttctaaggcaggtagtagccaggcatggggacggggcttctgtcagctcccctttgattttgtagacctctggctcttagcaaagagatgtcctaggaaggaagggcagtaccttggtgatcctgtcttgcacatatagactggagcttcagcccattctcacctctccttcacctgagacctgtggctgcagaaccagaaactcatttccagaagcagcagaatgtctctctttccgcagggctcagaagtatgtattaagccttccattaactgcatcttactcagctggaaaaataatactcaggatgcaattttatctgatttctggcctgtaagctcctgaagggttctcttaagaaaggctcaaaaaactcctgcgctgtgtgactcggagcccagccctgtagcctccctccaaggagcaggcagctcagtggttgaccagcaagcccatcatcattcagcactactgggttatccatctgtccgtctgtcaattaaacaagtgcttatgagggcctggggccaggggcacataccgagattactaagactaaataagacacagcgtgtgccctccacagcagttcaggcgcaacctgaccactttctctatttggttaaactccagaaagttcttgactttattattcgcagttcaaaagcagcatgagcttttgtgtctgctccccttcacccactaagtgtcatgacgagcaggcagaacgcccatatagatgccacacatgctatgggttacgatataggacaggaacaccgagcttggggtatccaccatcttgtggcagacagcaagcaagccagctttttgtctcagagagaaacattacctcatgtctcaggattggttgctgcaaacccaacccaggtacagagcagtcagagccttgcattctttgtctacccagcaagatgtgtaggaatgcaagaaactcatggagaagtgtctccaaacaatgcattagcattgcacatgtctggatttgaatcctacgtctaacaatttaagtgcgaaattaagtgcgaaattgggtaaattgcaatggctgaacttctcagcctcagtttcctcttctataagatggggataatgcctactttccaggtgactgtgaaagagagtgtagggtcactcgtctgggaacacagtagtgaactaagaaagcccttgagttcaagaaacttagttgcacggggaatcctttcagctatgtattaagtatgcaatgccagttagtcatgtgtgtggaaaagaatagaggaggctgggcacggtggctcatgcctgtaatcccagcactttgggaggctgaggcaggaaaattgcttgaacccaggaggtgaaggttgcagtgagccaaggtcgtgccactgcactccagcctgggtgacagagcgagactctgtctcaaaaaaaaaaaaaaaaaaaaaaa

SEQ ID NO: 4865 - DNA, 1863 bp, Homo sapiens
gtcacggggcgcgcgctgatgcgaacggggtgacagatgggaacgcctccgagaccgccagcgacgaccccgctcgggcagccccggatttcctcggctgcaccggcgccggcagcggggaccgaggcccgcgtccgttcgggtcgggccggggcttagccccgcgccccacgggcggccgggaccccacccggaccccgccgcggttctgggccgccggagcctcgcgccgcctctcggggaccttgtcccctggcctccggcctctcgggcccctcgcctgccgtctaggagggaaggggccttggatctgtgccccgcccatggaacagcgcccgggctcggagaggccccgcgaggccgcaggcgcagaccctcccggagggctgggcgggcaccggggtcttcggctggcttgagggacccgacccctgggggaggaatttggggtctgtgtgtccgaatgaacgcgggggttcagatgagtctgtggtgcccccgctttccatctcctccggccccggccccagaggactgtctgagaggccggtggccgcggatcctggacgcgcctccctcctgcctgtggtttccctttattccggcagcggcgcgagcccacccttcacatacaggagctacatccagaagcttctcctggggccacagcgtgggcttccgagactctgcgtgaccccagctctgcccctttggggctgcgggtgaagccctcaggaccctccgcgtgcgttgggcaggtaactggatgagggataatgtggtgaggtccccgtgcccaaccctcctctgcagcccacagcaaccgttccctcttcagcagccccctccccccggccgctctgggcgcccgttcccagcatcctccttggcaggtgttacccctccccattccccaggccctgggccctcctgatctgtctcctcgaccccctggggccccagtctggctcagtctggtccacactctggaatctggtgggactgggtatggagggtcttgagtgtcagcaggccacctgcgtcccacctggtgggtgagaagggtcccacaggtcagcatggagggacccgactctgtctcttctgctggaaaccaggcaggttccttcccccagggccccggcagggccacgagtacccgctgcactggagcacgggggaagaggcagggatccttcattacctgaaccccatgttcacacgtcacaaaacaggagtttccaaaattagaatttatttcagtttctaaggaatgaatccccgagtgtggcaggaaggacacagccggctcctgacgcacacctgatttgattcaacaccgagtcggcacagacacaaccagagatggcctgggtccaggctggggctgcacgggctgtgtcctggacagccaggagggaggccccgcacacagacggccgccgggcagggggcctgagcgggacaggcctggccacagcccatgtccttggccttccacataggtgcacacattgtctgcccagagagggccaagatgccccaggcaccccttcgctccgggggctcaggacacaggctcccagctgaggccacgcctggacccagagctgatgtttggctgcacgcgagcccactcgggacagacccaagaacacgaattctctccctttggatttaaggctggtgttttttgacatttacttcagtttttctctctgaaattaaaattacctgagtaaaagattttaagacattaaaaaagccaaaaacacagaatccctgcaggcagacggtgccagggaggtggcggccagggccaggatgccaggggcacggtggggtcggctggagctccagggc

SEQ ID NO: 4866 - DNA, 575 bp, Homo sapiens
cttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 4867 - DNA, 2470 bp, Homo sapiens
atgcgctcgcccctctactcctccacgccccggcccttgggtccggctcggaagcagccccggaaacgacggcatttgttggggaaacaagaccggaattgaccaagaacaggaagaggaggggccaggcctgcaattcccagaatgctcgagggctaaccgacagccaggctggcttcccgtggtctcagcgccacctgccggaagccgcgagaacagcggccgcctcaggcaggaagtgcgtcatctcgcacggaggacgaatgccgttcccggcacttccggtcctgaccggaagcggtaaccgtcactccttctgggctctgtcagtgcaccgaggcggggctccccaggatcccacggtcccgctcaggccagacgcagaggcagtcccagcccgcgatgaggacgtggggtcgtgaccgctgggccacggtgaagggggcagccctgctggacccgctagctgggccgacgctttcccacccctaggggtttgctgggccctggccgcaaacttgtggggcgccgtcctcggggccactgcccggccaccctcacacccttgggccctcagctctggtgcattggtccgggctccgggaggcactgagacgtccccctagggcgctgcagggaagcgagggccaggcccttccaggtccccggtcctcccgggcaggatggaggctgctgaacgctcctcaagcttccaagtcagccgtggctgggcgggcggcagcagggaaggtttgggctccgccatgcttgcgagccagcagcctggcctcgcctgtccgcagcagggggcaggtcagctgcccgccctgaaagggaggaccagggcccagattctccctgcgacaagccgcgtcttccttggccactgggccctagatggttggcaccttgtgccccttctcagctgggagagttcctgccccacacactcaaggattctgagttctccttggctgctagacctctggtccctctgaaaggctcgagagagaactcccccagggcctgctgtcctggcatccgctgggaaataggattcaaggacctgctgtggctcagcctagaaaaaaggaggggaagcaggacccactcctcggcccccggtctgctgtgcgcctttgggattccttatttcttaaactgctcttccctccccacagggaacacagcggaaagtagagagggggctccttggaccattatgttctcccaaccagtgcaggcttgcaagttgggagcagcaggggaggagggcctgctgagagactctgtaaccccctaaaatgcagggctggggacagtttccaaattggcctgcaaagaggctgctgggagccctagatatgaattcccaggcactcatttcctccagggaacagtgaaatgtgccagcacccccctccccacaactagggaaaagtagcctaacccagagcaagccccaccccacgatgtggggaaagataggagagtctagaccaagcccactggctggaggtgctcagacaaagggaaaaggacgggggagtgcaggggctccttagccccacagcctgtctgcccccaaccaccgctcgctggtgggctgggggggctccctagtaggatgaggtctttcttcccctccagaccctctgagatgtggctcaggcctgagccatcagctcctcaaaggaacatttacaggtaacagatgggcagggcagagaccctcaaatgctcgggagggggcagtgtgtccatcctttaccatccctcaggaggaagaggagtcctgcagcgcacccagcccctaccccaagcccatctcactgcattccctggctgcccgacccctcctgcccacctgcttacactgtgtgccccttgtgtgcccaaggggcagggtggaagtggctgcaggcaacacagggcctctcccaaaagagaatagagagaacgctcccaaaaagggcccttgctacctggagttgctccctggtttaaacccaaagtaaaattctaagcaaccccaaccaactgaatgggcacctcttggccaaatgcattctaaagtaaacctgaaaagctcgttgaggccatgatgactgtgggtggccgaacatgcctcataggcacagctgaccagcattcacattaaaacagagaccttagtccggtgtggtggctcacacctgtaatcccaaaacctggtgtgtcacgtgaggtcaggagttcgagactagcctggccaccgtggcgaaacaccgtctctactaaaaatacaaaattagctgggtggggtggtgcatgcctgttgtcccagctactcaggaggctgaggcaggagaatcgcttgaacctgggaggtggaggggaggctgcagtgagctgagatcacgccattgcactccaacctgggtgacaagagcaaaactctgtctaaaaataaaaagaccttaagactcac

SEQ ID NO: 4868 - DNA, 1605 bp, Homo sapiens
ttttataacttggattatgaaactaaactttaacccaaaattaaccctgcctctctccccaccccaccccgttctccttgacttcatggcaagtttaaagggcagcatggggttctttatgagtctgagagccgtctcccacggtctgtgcccccttctgccaccctaccctctcatggactcccagagccaggtgggagtcccacccatccctctaactcctaacccccaaggtcatctccagtcacacatttttttttttttttcgggatcaatggtgtttgatttgtagccatttccatcaggagcaaagtctctcccagcccattctaggtcagccatgctcatcgctgcactgttagtgaactgtattcaggagtgtgctcccagaccacctgcccacaccagcctgggttagcgcaaggagtaaatcctcaactccgaggtgcccgccccgccccacagggtgcagggtcagcctggaagctacagggcaaccctgcagtgctgccgggcagggtgtgtcaggggcttgggatgtgccccagggcaatgactagactgtatccaccatagtgagagcgctgcctaggcaggaagacacttgcctgtgtgtagccaggctaccctagttcctcagccccactttggacctggaacagggttacaggtttgggaaaggaagcgttctgcctttctttcttttaacgcattctgccagtaaggggactgtcacctcactccttctagaaaatgatcgggaagccaagcctgatgggatggccaattatttacctgtgggtggcctctccgtggcaaaagctctttgctctgaatttcgaagaccacaaagactcacttgggtgtgtgcatcagtctaggccacagagggctcactgggtgttgatggcctagtttcaccttccccagctcctgaagcccttactcaccccagctcctccccaggatgctcctgcagcctcaactactgcaggtcagcatgaactcaactgcattcccttatagggagacacagggagacattcagggagagtctgttgagtacctaccttgaacctggtaccatgctaaacctggcaggcaactccaaacagtagaaaacgtggcctctgctccccaggggctctcaggcttcatttagggatcagacatcatcctatggacggccctttttttgtctttgatttttgtctagctccaacgtttgggtttttttttttttttttccttccattatgacttataggggaagcttcctgaagtgagaagcacttgctgagggccgtggggtgggaggcagcttcgtttttgctcagggtggcaacttggatccatcagggctatggtgtcagggtaggaggtctgggggggccttgaggtctgtgcccacctcagccaactcctctgggccagcctgcccacctgttcctaattcccctaggacctgaggtgagcagggctcaggggaccccaccaggtgaggtccctgccgactcctagataacttcactatcagtggtcacttttcttttcccttcacctggtagtttgaaatgtcatcttttcttgtgctcagtcgagagt

SEQ ID NO: 4869 - DNA, 5632 bp, Homo sapiens
gcgggaccctgcatacctggaagcggcgggtggcgtcctccttgtcgccctcacccacccggtccgggtgtacctgcagggacaccttgtggtagcctcgtcggacctcgccgtcggaggcctcgcgtcgcacgcccagcacccggtaaaggtcggcggtgccgaacacttcctcgcaaaggtccagcagccccatgccgggcggagatacgaccccggaggaagcagccgctcccagctgcgccgggtacaacccaggactgcttctttttcgcgcccaaaaagcccagggcgcctgcgtcacaagcactgaaggggcgtggccacgccgcgcatccgcgctttacggcggccgcaaaatgaggtgtggcgagtcaggcgcgggcccggatccaagatcaaactcagctgaagtcagttcctctcaacctgccctggcatcaaagtctcaaagcaagtgggggccaaccagcaacaaccccaggggagctttgacaaccacagaatttgagatggctggtaatcgttctcagaacataaaacacaaagtaagtcggcacattgatagaacctcctctataaatttcctatatcttagtcacacaccagagttaagccatctgtctttgctcatttttccctctatggacaacataatatgttgggaagggctttccaggagggcataaccgggagatgaatcttacatcactgggcaagtttccacctctaggcctcagcttccctatctgtaaaacggagataatcctacctgccttcataataccttacaattgtcacaaataaccttgtacacaaaaggcctaggatatatgtagatgctttgcaatattatctttcttccagtttcttgtattttttaaggtattcaaatacatctattttaacatttttctatatatacatttgctacggaaaattgaaatcgcacactgaaatatccttttattgcaactcaaattttcaaaaaccagaaaatcaaattattatgctctagccaaattatgtaatgttttctttttcttttctctgtcacccaggctggactgtagtggaacaatcacagttcactgcagcatcggcctcctgggctcaagtgatcttactgcctcagcttcccgagtagctggaactatgggtgagcaacaccacagccagctaattttttaagtttttgtagagacggggtcttgctgtgttgcacaggctggtctcaaactctggcttcaagtgatccttccacctcagcctcccaaagtgctgagattacaggtgtgagccactgccccaatggtatctttatattatttttccttacaagttacttcaaattcttgatgttgaatttcatctcactgacttcaggcttttaaaacacatgggaatacttgagacctaagaatggttgtgagtcaaataaaaaagtagaactaaagtatactgaagttattcaaatacattcaaactataaagatcccttatagattactggcatcaaggtaggaaggaaaagatacaagaagtaaaatgcaacactcattacaggttgtcaacattattggtatacagtttatcctaacacagagcagccttcttaacctgctccataaaattaccagcaagaaagaaaagtacaagaataaggttcacagctgaattggcttggtgtcctaattccctattccagtattctcagaaggatcccatctatgatatatgcagaaatcacagccacatttgaatggttcaatcttgattcatactgaactcccttaagcccagcagtttctcattcttaaaaggtaggttattagagccccaaagcaattttcataacaaatctacctttgtatatttaagaatatgcattaaggctaggagtggtggctcacgccagtaatcctagcactttgggaggccgaggtgggcagatcacaaggtcagattgagaccatcctggccaacacggtgaaaccccatctctactaaaaatacaaaaatttgcccgggcggtggctcacgcctataatcccagcacttttgggaggccaaggcgggcggatcacgaggtcaggagatcaaaaccatcctggataacatggtgaaaccccatctctactaaaaatacaaaaaaattagctgggtgtggtggtgggcacctgtagtcccagctactcctgggactactcgggaggctgaagcaggagaatggcatgaacccaggagacagagcttgcagtgagccgagatcgcgccactgcactcaagcctgggcgacagagcgagactcctctcaaaaaaaaaaaaaaaattagctgggtgtggtggtgcatgcttgtagctccccggctactcaggaggctgaggcaggagaacctcttgaacccaggaggtggagattgcagtgagctgagattgcaccaccgcactccagcctggcaacagaacaagactccgtctcaaaaaaaaaaaaaaaaagagaatatgcattaggcaagacaatataaacctccaattacaaaaatcaattaagaaaggttaactgttcttgcacttgtgggatgaacatgaagatctgaatgggccatgaatagtctggctgggggttttgaagcaggaagtcttggaagccagtaaattgtaaagttgtccaagagacccagagcccaactcaaaagtccaatcctcccatagccactgtctatcccaagacaaagtcgaaaaaagctaattagtacccacacccagctctaagtcacacaagaacaaatctctccctgggccctgtgcaggccaggccagaagagcaagggcaactcaggatactccatttattgaactccaaatctaacaaaattaagatcgctgcagtgtttcaaaaggaccttgaccttgttcccactgctatgctcactaaagtcagctcatttatgtttctgtagcctctgtatctgtagcttctgcatctgttttctgagaagctaacaggacttcacgtgcccgtttccttcgcagtctctcagcatttgtgatcatcataggatgcagagggaaaaagccagcaagacctaaaagtaacagatttttcacttattataacacagtataagccaatgcttccctaggaactctgtctcacagaactgaggtctgagatctgacccagtgcatggatgcaaaccatgctcctcacttgccaaactctgtactacttctccccggcaaggagacagtggatgtctacttccctaacaatattccccttactttaaaaaacgtaaactgacagatggccattcaaaacatactattcctatttttagcataaaataccagtcacccaaagtcttacaaaggagtccacaaaaggggcctccagattcaaaatgccaattagatcacaacttcagctcccacttcagtcctgaacagcctagagggaatgaaataactcttttttttttttctttgagatggaatcgccctctgttgcccagactggagtgcagtgacgcgatcttggctcactgcaacctccgcctcctgggttcaagcgattctcctgcctcagcctccccagtagctgagactacaggtgcgtgtcaccacgcccaactaattttttttttttatttttagtagagacagcgtttcaccatgttggccactctggtctcaaactcttgacctcaggtgatccgcccgcctcggcctcccaaagcgctgagattacaggcgtgagccaccgtgcccagccgaaaatcattcttacacctactgtcctggagctgacttcagtttaaaatcccctcaataaggtaagaccagagctgagttacccagaagcttttccataggcttagagaggtgggccccgcagccaatccaatgacggatcctgtctaggttgagggcaacgagtttttctccatgactgttgggcaatggatcataggagcccagctgctctacgaaacggccatccctgggacacttgttgtgagcagccacaatgcggtagaacggccgattggtgcagccacccagggcaaggcggatggttaagtggcccccacggtaggccttgcagaggagagtagctgtagaaaagcagctggttaggacacaaaaaacagcacaaaaaggacaaaatgacacagacggcacaattcccttttcccactgaaatgtctcacttccaatccattcctgtcaatccagtttagatgctactcttctttgtgaaacccctcttggccagtccagccagcaatgacctcctcctcatacccaaacccaccccgcatgggcttgccattcactaggctctgtgaccttgtcggagccttagctgcttcaatggggtggaaatttttcagcggtgattaagtggggaaaaaactgagagaaggatcaaatgtaaggcagtgtggctgcttcaggttcgggttgcctccatcgcgcctgggagagctctccccacccggccccgaactcccgagccccgtgaccgcccggaacgtctcgcggtggcccgatgactcactgaggtggaccatggtgccgccggcgtgcggctcctcggagagccccgctacccgcacgcaccagctctacggccttggcagggcagagaacaaacacagaaagaacctgcaagccgacaccaggccgcaccgccaagcggtacaagcccgaaaacctcgactccggaagcggatgatccgctcgccacgcctcctccgcttgccgccctatacttcccacaatgcaacacggtgacccctaacgtaccttaaactgctgcaaaagaggcgtttctcgtggtgtcttgtgggagtggcggtgcgatccctctcagacttgtgagtccctgctggagtcagaagttttaggcgaatcccaggcgcgccaaggaaagtgctacaaaagccatccatcttgcaagcgttggtgccgaggcgcaacgctgagaacgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattctccaggcttcatacggtaaaactctctgggaaggaaaggaactcagagtcccatgcagaaaattgttcagctggaggggtatcagaaagatggatttccaaagccaactgtttcctgtagtgtgtggatctctgcaagcagagcctcatctttcaatttcagctacatgaaagaggaagaaagggaaagatatatgtcatacgtgatatactttatgtggctttgaagacccctcttttgtggggctacggctaaagaacatagttccctgggatggaattggctcttcctatttccctacttcatgaaaactccagtagaagaccttagaaccttgtcctggttacatggatatgtttactttgtgaaaattcatcaagcactatgcacggtcatgatttgtacatttttttgtaagataacttcattaaaatttac

SEQ ID NO: 4870 - DNA, 1941 bp, Homo sapiens
gacacaaagctctggcaccgccatttcacgggggtgggacccgggcgctcccgaggacccgtacacggccacaggcaagcggcaagagaggacccagaacaccactttctcctggttgatttgcgagcccaggtcgggtttaatctttggcgcggcaaagtggaccgaaggtttcccagactgggcgtctgtcgcccccaacagcatcgccgcccccgtagcccagctgcgtgccctacctcccgccctgcgccaagactctcctccccgcctctcacctgcggctgcggacaacacccatggcgccacggcgacgagcactagggtcgtcgcgcccaggaggacgaccatcatctgggagccgccgcagatcccaccagttacatgttcgcgcacgcgcagctcctctcagccgccatcgccccgtcctaagtcacaccgcccctctgcacacgcgctgcccctcttagctctcaccgcccctctacgcacgcgccgcctcttctgacacacacaccgcccctccgcgcacgcgccgttcctccacgcacgcgcctttcctcctagctagcaccccttctccaagctcccattgccccatcctaattgcagcacccctgtgcgcgcgcgccttagaaatcgcaggcctcctgcattctcttcttcctcactctttccggcctatggccggtctggagcacttcaccatcgcattccaggacgactccccctcacaggaggccttgaccttcacaggatcgcggcacacacctgcgcagacccagcgactttggagttcccgcgtctcttccccatgtctgcagtcggagggcgcgggtgggctcctggtcgcggcccggcgctcttcgtcctcgcccttctccgcccggggcgcttgctgaccctagagtcttggacagtggcgttgggagtccccagcggcctgggaaccagatgaggctggaaggaggaagtggctgagcgaccagaccgttgctgtgtgcagagcgagagcggggcagaggcggtcgagcgctcgttttccgggcgacttggctgaggggcgagatggtcccttggagagaacagccacgggccctgggccgaggggctccaaacagcagtcgctaggctgttttggtcgtcgggctttatcagtaaacaattcgagcccatggttcgaatgattatttaattaaattcctcagtaatagatccagtgcattgtgaaaatatgcgaaataaaatttaaatgatgagataaaataaggaatcaaatacttcgttgttataacaaccaagcaattaattagcaattacataattaaatgaatgtttgtaaagaacaatgcaatggaatatatatgtattccatctatatattccatctctatattccatctatatattccatctctatatcccatcactatattccatctctatatcccatctctatattccatctctatatcccatctctatattccatctctatatcccatctctatatcccatctctatattccatctctatattccatatctattccatctctatattccatatctattccatctctatattccatatctattccatctctatatcccatctctatattccatcactatatcccatctctatatcccatctctatatcccatctctatatcccatctctatatcccatctctatatcccatctctatattccatctctatattccatctctattccatctctatattccatatctattccatctctatattccatatctattccatctctatattccatctctatattccatctctatatgccatctctatatgccatatatattccatctctatatgccatatatattccatctctatatgccatatatattccatctctatattccatctctatatgccatctctatatgcca

SEQ ID NO: 4871 - DNA, 3494 bp, Homo sapiens
ctggtagctgggactataggcacgtgccaccacacccagttaattttttgtatttttagtagagatggggtttcaccgggttagccaggatggtctcaatctcttgacctcgtgatctgcccgttttggtctcccaaagtgatgggattacaggcgtgagccaccgcgccaggctgagatggggtttcaccacgttggccaggctggtctggaactcctgacctcaggtgatccgcctgccttggactcccaaagtgctgggattacagacgtgagccaccgtgcccggccagttctatgagttttgatgaatgtgtcctgcttcttcccaggctccaccatctcttcccctaaaggcaaccaccattctgatttctctcaccaaagactggaaaaatatcccaatacctggatgtatgcctcacgtgtcccgctggccccagcacccaggtcattctggtggaatggaagtgcaaccgtgaggtcgccagttggccggcattgttaagcaagggcagcagaaggctgggagggacggagccagtcccccaccctctcctccagcccccgcccaccacaaattcacagtgagaggcacctcactgccttgacattcagaaaagagtgaaataaagaaaccctcgcagcgcaggaaataactggattccaccttcaaggttattgaggttcctccctctctctccacgcccccagtcaaaccctgaaatcctaaggctgggggcaagcccttccccaacctgccaaaggaaaggagccagggctgctgccttctggccgcttttctgcctccagtcccaaaaggaatttctctggacagatgtgactgcagcggcccaaggccccccttctcctcctcctcccatcccactgggcgggcttgggaaggtacaatcaaccatgaacataaatatgaataaaaaatgaacttgaaaatgacaagctattaattaaacaaatctataaaaatagttaggacataactctgttcaaataaatacaaaataaataggttccaagcagtgacacaagtggaatgtggggctggtcccgctgcgcccctgctggggttggacaggaacccccagggcgtcagaacagactctgagcagtcagccaagctcctgctccctcgtcttcctctggaagcacagaagtcgctcatttgtccggcttgtccttctggacaaaacccttttcccaacagtccataattaaggcctccaacaccttttccttccctccccagaacacacaaacgctctgcccttcgccctcaaacatggtgctccactgccctcatgccacagtggggacagtgagtttggttctgaggtggggcccatcctgacagggtccaggccagctcagagcaccatgagccccagcacttgccttctgtgcagccaggccaggcagcccgagccccctgcactcccaagcatgcccgagagccccagccatcagcagggctcagatgccagtgaccacaaggccagatcctttcctcttccttcacagccaagttggcgtcaatgctgtaggttgggaagtcaggcctgggaggccacgtgacctcacctttcatcatggattatgggattggacgagggggtgggatgtgggctgtagccctcctcccaccttacctcagcagacaggcaggcagcaagagggcacagggagatgcacggcagaccagagggcaggggccgtggccaacagctggctgcaagggtgaaatggaagaactaagccggcctccaggctccaagctcgctattggcaggcactgcagaaaatgtcctgtccttacacatgtgagcccggagcctgctgaccctggaccctaaggaatgcctgtggtcttcgctggaaccaacaggagggtctgctggggtcagcaggacaagccctgggcctgccagctctccccaccctccctgcgggtgcgtctagggttttcacagcttggctcgagacagcttagtgttggcacattcacagaatgagatggctgcacaccccaggctgcggcccaggatcagcgagtccactgccgggcggccctccccccgtcaccgcgactgcacgcccagggtgatcttcaggttctcgtagaccacgtagctgatgctcacagctgggatgaccttcatgaagttgggggccagccccctgtacagcccgaaggccccctcggtccgcaggatatgtttgaagaggctgctcatggtcacctccggagcgccctcaatagaggctgcaggatggaggccaccagtcagatgcttctgtccgctccccccgacctcccaggggactgtccagggccagccttaccttgcgcctgcatccgggtcctgactagggccagggggtagctggccagctggccacaggtactggacatggtgccacaggccaggagcacaaacacgccggggtccgcgctgttcactgcatagtgctgcagccaggcattcttgagcgtctagaaggagaagggagcatgggataagccctaggaagggctagtgaggcagcaagagacggggctgttactgggtcctcaggccactggaacccgactgccgcgcctggggcctggctgggctcctagcctggctgccctgtttctgctgtcactgggaattccgggacaaggtagagggaacacctccttccccacacagaagggctgacttctggggtctgtctagagtgtgctggggcctgtgagctcctgggggccaccctgctctggggatctgcctgctgagcctctggggatgcagagcctgggtgcagggctcacaggagctgctggggtctgccaggggcaggcagggtgaaggaaagctgcagtaaacagaagagcaggaaggaggcgcagtctttgatgcagtttcctgcactaaccacgcgtccgtcaaggagggagacagcaggtggaggtgtgctgggaggaggtttctaaatctgtccagcttgggcctcacctcgtagactgcaaggtcgatgccggcataggggatgatgcccagcatgttggggacatagcctttgtagaaggcggccaccccctctctggccaggatcctcctggcgcagtccagcattcctgagtactggcctgtcttccgcagcgccatccgggtcttcaggacctgcacaacaggagcagcgggacgcgtgagcacagcctgtgcctctccccagtcctgtgcccactgcccgccccaggacccaggcggcccctcacctccattgggtagatgctgctctgggcgatggcccctgccaaggaccctgccacaagcctctcgtgaatcctcagagtctcctggtcactaccaacaaggcgcttgatctagaaccaggaacaaacaaaccacctgatatacccagaggttggggcacctgctgctgcccctcccttccaggagtccccggcacattttatgctacccaga

SEQ ID NO: 4872 - DNA, 557 bp, Homo sapiens
gacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaccctcgggctcaggccctcgcattggtccatcacgctccgggctggggatgccccttttcagagaagggcccgggaccacggtgaccaggagtcgtagga

SEQ ID NO: 4873 - DNA, 2900 bp, Homo sapiens
aggtgccgtacgcgcgccgcagctcccggcgcacgaagtccggtagctgcagaggggggccccgcgcgcgctccacgcggccccagcgcagctcggtttgcaggctcccgccctccggccacggcgcccagctctcggccaccgccgcgggcgcctgcagcgacagtcccgagatgccggcggcggcgcagggccggcgcagggtcgtggcgtaggccggagggcaggcccaccagggcggcgcggcctcgggtggcgcggcggggccgtagaagcggtggtattcccgtggggccgcccactcgcccgcatgcaggctcccgggccggctgcggaagctgtgggcctggactgggggtagcagcagaggggcggccaggtaggtgcaggtgagcagctgcggcggcggcggccagacgccctgtttgggcggcggccagctgtacacatacatggtcggccccccaggcggctgctgttcttactgggggctcctgcggatccagacctgcggcggaggaagggatatgtagacagactttctacttaaccgcctcctgtccctgtgggccggttccccgggacgccggttcatggctttgggggaattcatcccaaatcgaacattcagctccccgcctagcctcttgtcccaaggtcgggcagagcctcaggctcccagcagacaataaggagccttttcaagccctccgccgggatgctcttcccagtgactccccactcacttgtctccttcagccttggggagccggcgggatccagagcggggctcctctccgcactttgtagctgcgttgctccgctccatgccctgcctcagccactcctcctggttaccaggcaaaaggaaacaccttgagctggccaggagctaccagcgtctgtctacacctgggtgagccgtactggtcgtagtggccccaccctacaaggatgcccttcctacagtattactgatggctgtctaatccggttagctcccagtcactacaccccagcctcccagcgcctgcaggtggattgggttatcctcacatttgagtgaaactcctgcacaccagacactgaatcgagttgtctgggagcatctaactgcaagttatgtcgatccgaggaaggggggtactgatattacccctgctttccatagcaaaaagctgcttgcctcacagttggtgtccagtgtattcagtgactggagcttatgtaggttaaataactcatcccaactcacacagctggctatagtaagggcaaaattcaacccccagtctgtctcaagactcaggctcacaatgttggtcttattgcccacctgtgcaggagcttctcgcagactgtctcgaagtcctcccactctagaatgttacataagcgctttaatttttttttttttttttttgagatggggtcttgctctgttgtctaggctggagtgcagcggcatgatctcggcacactgcagccaccgtcttccaggttcaagcgattctcccacctcagcctcccgaggagctgggattacaggtgcaccaccacctcctgctaatttttgtagttttagtagagacggggttttcactatgttggccaggctggtcccgaactcctgacctcaggtgatccaccctccttggcttcccaaagtgctgattttacaggcgtgagccatcgcgcccggctgctttaaattcttttcttccttttttttttttttttttttgagacagaatcttgctctgtcgcccaggctggagtgcggtggcacgatcttggcttactgcaacctctgcctcccagcttcaagcgattcttctgcctcagcctcccaagtaggtgggactacaggcgtgccccaccacacctggctaatttttgtattttttagtagaaatggcgtttcaccatattggccagactggtcttgaactcccaaccccgtgatccgcccaccttggcctcccaaagttttgggattacaaggatgagctactgcgcccggcctactttaaattcttaatagctatgtgaagtgcatagtgatgtcatgctcttttagtagataaggaaccagaggctcagagaagttaggccactgtcccaggttcacacagcctgtaagtaccacagtggaatttgaacccagtccaactgatgtcaaaggccagaagccatttgagtgaaggcaggaagattgcttcatccagatggggtgagccctgtctgagttccagtcccttctggtgtgggtcacaacccctgcacctcttccttctccagtggggagagtggtagttatggatgattaaaactgaaaccgtctcccagctgcagggctgccatgttgccacactttccttccccatctcctgttgactgaagcagtatcaccagcagccctgacagaaaggttcttctgggttctcagtatccctcaaaactcagctaccctctggtggtggccaccatttggtgactcaccctggtgatgtcatgctattcgtgactgagccactgctccaagtcttaattcgggccagtccttttgaaggcaggtgctggggctgggctgtggatggaaaaaaggggcctggttagggtttcatttggactctaacactgtcatagaaacccagattcaggctggtgaacctgatgcacagctaaggccaaacagtgggagatagagaaaggtttatttgatttggccaaagtgagaaggcgggagagcaaatctctcaaatccctattaacagaaaaaaagcagcagggtggcttacacctgtaatcctagcacttttggaggctgaggcaggtggactgcttgagctcaggagttcgagatcagcctgggcaacatggtgaaacaccggctctac

SEQ ID NO: 4874 - DNA, 900 bp, Homo sapiens
ctcccggacgcttgcctgcagtcagcgaagcttttccaacccaggtctgggccctgcgagctccaggtgcctctgccccgcggcgctggcgaagtcgaagcccgagaacgcccaccgcagcgatgcgaaggccgcttctggggtggggctgaggctgcagctgcctccctttcgcaccaaggaccccaaccttcagcgacgcagccgccgctcccgcccaggctgggaggcactgtagggatccgacgcttcaggtggccaaagagcgactttctctgattccagggccctggcggggcaggctccagtaccgcactcggcggaggccgaaggtctgtggggcaggacaggagttcctcgtgccgtcggaagggccgaggacgaaggagggcgctaattcactccccactgggctggcggcaacgccgaatcccgcagtgaccgcggagggccaaggtgcaggctgccccatggatgccacacgtggcagcggggagaaaagaagtgattcggtccctgccgagggttgctgccacccacgcactgctggcggactcagtgccaggcagccttgatggccaggcaacgtctaacccaggaggtgggacacatcctcggagtcaccagtgagatgtggcgagctgggagaaaagtcggcttcctgcatttgtcaccttctgcctccagccatggtagtaaaccaccgcggccagtcccgacccatcccggatccctcgggtctcacctgcaggtcctccagaccgggggccgccgccagccccggaaggccgagaggaactgcttcacaagattaaaggagaaacagaaaatgtatctagcgctgtgcttggggcatggcaggaactcaatgaatgcttattaaatactgtaaatgataaa

SEQ ID NO: 4875 - DNA, 1951 bp, Homo sapiens
gtttgattaatttgctggggggtgctcacagaactcagggaaacacatgtttacatttaccagtttgctccaaggatattgcaaaggacacagatgaagggctgcgtggggcagggcatggggaagatgtggagtcctgtgccctccctgggcacccccctccaagagcctctgcatgttccgccatccagaagctccctgaaccctgtcctcttggatttttatgggcgcttcttgatgtcagctttcttccccgctggtggggatggggccttctctgaggaggatcgtatgagcaacaggaaaggctggaggagagagatgttttgcctggcagctgaaaggcggacagaaaggacaggagaaggttggggaagttctgtttcctgaggcctgacgcacccgaccttctaacagaagactgtaacagggctgtggggtacacaagccaggtgccgtggaggaaagcctgtagatagatccacatcacggcaccaccacttctccccgtggttcacaggccctccccaagcatcccagggccctctgctgtgaaggcggctccccctgcctcgctacctgggcccccgctcccctgtgcagtgtgcttatttcagtgctggtctgacttgctctttgtggtggtaagctccatgaaggcaggaccatgctcagggagtttcctgtccttcactgccccagggatgtggcaaatacttaatcagtgtttgcctatggagtgaacaggtccatgaatggtcttggaaaatgatgtatcccagcaccatggtggtggtcattcatacgtgttctcatgacttctttgcttttcctaatggtgagttcggtaggccaattcatttcttgctgaaaagtgtggtaaaggcaagtctcctaactggaccaagactacagcctgcagaacgcgcagggcctgggcatggggaagcacggatgaggagcctgctgctgatgctgagcaggagccgtggaggggtctacaccactctgctgactctgcgtgatgaggattcaaaatgccattcacgcaaaacaaatttagcaactaagaagtagagcggcgcgctgctttagaagcactatgtgttagcaggtgtggtacacacctgactttgcttctgtggctgaggaaggggaatgagtcttctgtgcgtaaatctttccacaagcaccatcctgggtgtcctgcctgaccagacttgtgagccagggccaggttgaagcatgtgcccaggtgaaaattatgcattatttattcatgtgagcaactctgcgcctattttgaaacattcactgctttgttttgtttgttttgtctaattgcatgaaagatgtggtaggcagaataatgccccccaacaaaaggtgtccacttcttaatccctggaacctgtgaatatgttaccttactagcaaaagggactttacagatatgactaaggctaaggaccttgagttgcagaaattatcctggaccatccaggcaggcctggagacatgagtcctctaaaaacagagactctttcccagctgtgctcagaaccagaggtgaccaccaaagagagatcagagccatgccatgtgaaaaggacttgacttgccattgctggctttccagatgatgaaggggcctcaagccaaggaatgtgggcagcttctagaagatggaaaaggcaaacaaatattctcccctagagctctgggaaggaacacagctctgccacctccttgattttcacccagtgaaattagttttggattcccaacctgtagaactgtaaagtaacaaatttgtgttttaaggccaggtgtggtggctcacgcctgtaatctcagcactttggttttggaaggccgaggtgggagaatcatttgaggccaggagttcgaaaccagcttgggcaacatagtgagactccatctctacacc

SEQ ID NO: 4876 - DNA, 4003 bp, Homo sapiens
caaacttgaagtcctcaggccgcttcttccgaggctgcggcggaggctgggcatgctgcagggagccggcgccgggccgaggctcggctgcagtgccgtccatggcggggccctgcctgctgccaccaggaatgccagggggcgtgctggactcagtctgggtcctcaccattgatggggatgggcaggaacataacaccacgctggactggatgggcacggcgtcatactaggcgacaaagaggaaaaggaagtaaggctcaaggcagctgccttgctctcaatgcacggactaaggtttaaggacctcatttcaacgctcaaaaacaaaccccaagcacagggcaggccagctgagccccgcggtctgctgtgagctgccggcctcctctcctgagtcctgcccgtgccatggctccccgctaatccaccaggcagcgcctcgccctcctcctgtccctcgcgctgcctgagcctccagccaactcatcccaaggccaaggtaacctgagcagagatagcacggcacatctttaattgtgggggggatggagagataagagtgatgatcgcatgtgtttacaatacacagagacgcccagtgctggcaagactataataaagcgagcgcactcacaccactgcggctggcaccaaaaaccgggattgcagtggaaatgtttttggaaagcagtttggcaactgtcaacaaagcgactacagaacagttgtcaatgagacacagaaatacgaaggagaggagggagggcagaaacccagttaacaatgtaagcgggcacggagggaagatcagcgtgcaaagctaggtcggcaagacgtgcaaggtgcacccacagccataacaatccctccccagaccccaacgtgtcctcacggtggtggcagtggccccccgcactacagaagaacaatgcgaggcgagctcaggcgcgctgatggtggtttccgatacaactccccactcaaagaaccccggagagctcttgattccatctctcagtagggtcctgaagtccatgctgtctgaagacacagggtctccccctgcgtctgtgccaggacagagggactgccaccagccaagctgcaatccttttaaacgctaaaaacggccgggcttggtggctcatgcctgtagtcccagcagtttgggtggatgaggcgggtggatcccctgcggtcgggagttcaagatcagcctgaccaacacgaataaaccccttctctactaaaaatacaaaattaggccgggcacagtggctcaggcctgtaatcccagcactttgggaggcagaggcgggaggatcacctgaggtcaggagttcgagaccagcctgaccacatggagaaatcccgtctctactaaaaatacaaaaaaactagccgggcttgttggcgcatgcctgtaatgccagctacttgggaggctgaggcaggagaatcgcttcaacctgcaaggcagaggttgcagtgagctgatagcatgccattgcactccagcctaggcaacaagagtgaaatttcgtctcaaaaaaaaaaaaaaaaaaaaaaaataggccgggcgcagaggccaaagtgggtggatcacttcagcccatgagttcaagaccagcctgggcaaacacagcaaaacctcacctctactaaaaatataaaaattaaccaggtacggtggcatgtgcctgtcgtcgcagttaattgggaggctgaggtaggaggattacctaagcccggggaggtcgaggctgcaatgagccaagatcacatcactgcactccagcctggacgacagagggagatcctgcctcaaaaataaaaaataataagtaaataaataaaaagaatatattcactattttgcttatcaaagtctcttaaaggaggtgacttacctacgctatggacccaattactcagccaataagaggacacggtccctgcccatagaaagctgatgtccagcctgacctcaatacaaaaccatccagttaaagtggtgggggtggctatgcagagacgggcgggtgccgggagagtcaagggcagccccttggctggccaggggctcagacagaccagctggggagatgcatcactcgcccaggaaaactgatgacagcttagatggcactgcaagagcagggaggatcacactcatgtccagaaagtgaaacataaaacagctaaacatgtaccacacagctttcatacaaaaattttatatacacaaattttgaaaaaatagagatggggttttgcttgttgtcccggctggtttcgaactcctgaactcaagtgatctgcctgcctcagcttcccaaagtgatgcaattacaggcatgtgccaccatgcctggtgactttttttctgttttgagacggggtctcactctgtctcccaggctggagttcagtggcatgatcatagctcactgcagtctcgacctcctaggctcaagtgatcctcccacctcagcctcctgagtagtgggaccacaggtgtgcaccaccgtgtccagctaatttttgtagagatggggtctcatcatgctgcccaggctggtctcaaactccagggctcgagtgatccgccatccttggcctcccaaagtgctggattacagacctgagccaccacaccaggctgccccacacattgtaaagtttcgcttccctctaatgtcagattccaaagacagcagccttcatgagtcagaaagaaacatcggtcattttgaaatcaacatccaactgaagtgtagaaaggcctctggatttttgaaacggcaacaacagatgatgtaatacaaagacgcccccaccccactgctttcccactgcatgctttacatgacatggcacagcttccacgccagcagcttcaatcatgtaaagcgaatgcagtcccatcaagaccacagcattggctgagcagctactccatgctgggcaccgtcctgggcactggaagtacagcagagaacgaaaccaagaccacaccctccagaagcctgcattccagcaggacagacagacttccatacacagagcaggaaaatgcacagcgtgtcagatgatgatgattactatgagaaaaataaagcaggcaaagagaacaggactatttggatgagggtggtgcaaattcaaataatcagacagcctttgctgggaaggtgatatctgagcaaagattcgagaaggtggggagagccccggagccttccccgcagagcagaggaggcccgggaagctctggactcatagcggttcagcacggccacgacacggccacttccagacagagcccctggctgctgggtagggaccgcagcacctcagagaaccctttctggggtcacttctggcaccctctgcaaacctcaagggggagcgtgaggctgggggctgtccatcagggtccaggcacctcctgaaggaacctctcaaagccagccgatcaccggctccagacccacgctgtcagacatctctgtggccaccagaccactgccactctcacgggtgtgatgacatgggacctgcctactggtagtcttctgccttcgtggaattctgcaacttccttcctgcctcggccacagcatgtcagccaagcacctgtcagggtccctccctggcaggacgatgtttagaagctcaacaccttgctcctgcctcctcttcagacccatcagaacttgctaccatgggtgtgttttaataaataacttcatttctgcagcaaataaataaataaataaatgtagttgcaatattgcctttaaaagcacttttaagcatcaattgtgaaataaaaagcccgagcaaaagccctctttgagcgtgaagtgtctaaacgtttatttgtactactattgttgtaaagggtagattttgtagcattttgaggtggtgattcaactgcattaacagcatcccgagaccgcctgccacgatctggaggaaacgcacggccagg

SEQ ID NO: 4877 - DNA, 5098 bp, Homo sapiens
gtatatatgtgcagagcgcggcgcgggtggtcacctccgctgctgccgccacccgcccggcctgcctttgaccctatgggtcacagacaaggcagggtgatcgcggcaagaccctgagtgagactagatgcgttacccagagggtgcgaggtcgagtaccttccctgtcccatcgcaaacccaaagatccccgttcctggagattctgattgaggtaaactaacaaaacatgtattgtgccagagagtggtaagcactgtggagggttacagtggtgtaggggaagacctgtcggggtggacacttggggaacgcgacgtgggggcggaatcgggccgctattggcgtgggcctcaagttccagcggacacgcactgcagcctctgcgcttcccccactatctggaaaaggggatggaggcgggggtcagcttcccatccaatcacagctcagcgtgcctcggagggcgggaggaaacggaactctgccggtcagcgacttccggccgtcaccacggaaactgccagccccgtgagcgcatggtgtggcacttgcctgcggaggggcccaggcgccactcctctgattctgcagatgctcccccaggagtggcttctggccaaggccaagccccttctttgaaactgcctttcagcctgtgttacctgcacccaagtcacccactggagggttgggggagaggggctgtgtgaaggacctggacaatgggatggaaggggaagatggctagggcaaaacaggcaatggcactgggtcctggagacgctgccctgaagcctgcagtatgctgaacttatgctctcagcatctgtccactttcacctaagctgcgtttccactggtttgctgctgaatctactcctgactgaaaccttccaatgtgcatggggccagggtgggagaagccttcagctctagcgatgggaatgatcaccacagggcagggaaactggcccagggcctgcagcctttgcttctcagactggctggggttccatctgcagggtcctacaccctcatcacctgctgcttgtgaacacgagaacaggaaagtcttgaaaaatctgaatttccaggtgaaatcttctagttttaaaactaggaaatggtttcctaggtgtaaaggagttttacaaagacatcctgaggcagaatctggatcaccaggtgtcagtttgctcctgctggatcgcataatcttggttggctagggagattctggcctgtctgggtcctttcctggggtttggcttggcccatggcccaggggacagccgtgacagggtgtggaggggagcatgcaggttgcaggcatcaagtttaggcacagtaccacccacaaacctgggggttggcagatccaagtgggatccttggctcccagctgtaagaagtgctgtgaccccactgcttccctttgttcctctagtactaagggtgagatgctgaatgtccccatgagtacaactcttcagcgggtactcctactgataggtagataaaggtagaaagctttggccgctcaggaccactttagggagtagggtgctgttagggtaagggtagctgtacagctgagctggggtgggagaggtagtatcatgggaatgaatcattaacgctgacttggagcaaggaggactggtgctcaggaggctggtaacctccctgaggattgagtgttctcccagcccttggaggccctggtctcagtgtcaagggaaaatcccatgggatttcatcaccagacaaggctgggctccagacctacccacctaggcatcactgtgcagggcagagactacaaacacctctcttcacttgcagatctgttaagggcaggctggaacaggggttggaaagggagaagagactaggccagcaccacctcttccccttggcaacagcaggtccttccaggagcaacagtttttacatacctcccagaaccaggctcactgggccccttggagacacccacaccagtgccccctcaggagtctcctaggcctatggggcaccctcttgagaacagagacctccagaccagctgagcagtaccccctcaggcccacagggcttccctgccagctaagagaccccaggactggctcagcagtgccctcttctcaggggcctgagttccagctccatgggaaactcattggagcttctaagttgcaatgcttccctttgttcctctagtcctaagggtctagctgcttcctgcaggaactttcccatttctaagacagattgacttaaccttctcactctcccatcaatcacctaacacctagttagctgtgctctgtctcttgatgggactcaatcagatcaggcatggcaccatgctatgcacatatgtactcttggtggatgctcacagagaacatttcttcctctctgggtttgagaaaccgaggtccattgcccagggagagctgaagctggactgcccagggcagttctgccccacctgctgctggtccattccctctgtaaactagaagctgggtatagcggccatcccacacgcggggtaggtgatgctaggagccacctctctcagggtgaagaggggtgttgtggaggtgaaccctcacaggaaccacgtggttacagagggagcacaccagcccagcactcggggggctggagggtggggagtgaaggacgcacaggtagggaggcactgagtgggtggagacccagtttccatctactgtttattggacacctacagtagccaagccctgggcggacctgcttatacttatgtaatcgccagcctcacaataaccaggggaggtaggtgttctgaccatggcggacacagtgcgtcccggctggagctactcggcgctgtggacgcgctggtgctgaatgagcttggtgctctggtggaagcggcggccacagtcctggcaggcgaagggcttctctcgtcggtgggtgcgcagatgctgcgtgagcgtgggccgctggcggaaggccttgccacactcagggcatgcgtagggccgttcacccgtgtggatgcgccggtgctgggtgaggttggcgtgctgccgaaagctctggccgcactcggggcaggcgaagggccgttcgcccgtgtggatgcgctggtgctcggtgagccgcgagacctgcgtgaagcccaggccgcactcaccgcagtggtagggcttttcgccggtgtgtgtcctctgatgacgcgtgagcttgaggcgctggctgaagcgctggccacactcggggcaggcaaagggtttctcgcccgtgtgtacgcggagatgctgcgtgagcgtaggccgctggcggaaggccttgccacactcggcgcaggcgaagggccgctccccggtgtggatgcgccggtgctgcgtcaggttggagcgctgccggaagctctggccgcactcggcacaggcgaagggccgctcgccactgtgcacgcgccggtgctgcagcagcactgagcggcggccgaagcgctcgccgcactcgacgcagccaaaggacttgtcgcccgtgtgtaccgcctggtgctccagcagcacggcgcgccgcgcgaagctctcgcggcactcgctgcacggaaaggggccgggaggctcgggcgcaccaggaggggccgggggcttagcgccagggcccgggggatcgccgtggatgcgctggtgctgcagcagattggagcgctgccggaagctctggccgcactcagcgcaacggaaaggctgttcgcccgtgtgcactctccgatgctcttccaggcgcgcgctgcgcacgaagccctggccacagtcgccgcacacgaacggccgctcctcggtgtgcgtaagctggtggcgcagcaggtgcgagctgcggctgaagctgcggccgcactcgctgcacacgaatggtcgctcacccgtgtggatcttctggtgcctcagcaggttgctgcgttggctgaacaccttgccacatacatcgcaacggccgcccctaaccaccccgcccccagtgctggggcggccccggctccggcccctgggggagcgccagcgggtggtgatcagagcagggcccacaccccggcagggatcctcgtccgtggggtcctgttcactcctcagatcgctggggagcagaagcgcatgcgcaaagccaccttcgcgggagggtgattggatctggccagaaaggccagccatgccgaggtcccaggggacgtggaggtgagggcttacactacctggacctgcggagatgctgcctagctgcagcgcgaaccctgcatacacaaggggaccattcattcatgacagaatgcccaccgtgccgggacccacttcatccctggggacacagtgtgaactacagggacctgaaactgaccaaagaggcagacggaggcgacaaatgcaggggtagggattctatctgtacagacttccctgatgaggtgataatgagacagaacccagcacaaggaggaagactgggctatgtgaaaaagctttctaggtctgatttaggttggaaaaaatcgtttttggaagggctgtagggcaagcgtgggggcattgtctaggtggaaaatgatggtctcagcaaatgcagggaagtgggtgggtctcggaggctggaggtggagccaacagaaagagggtgcaggctcctggatagtggtctggggtttggatgtgccttgcttgtgatgtctgtggggcatctgaggaacacagacttcatgaaggctgtggggaaacgtgagcaagggctctagggcatacacatggcacacagaacccgggcctgcaagtgatcaacacaggggtgggtatctacagaggagagaagtgggtcccagccacactgtgagcactccagcgtcagacgctgggtgaaggaggaggcaccagcaactccaactgagaatcagggcctggagaaggcggaagcctggaggaggttaaatcaagaagactgagagagcagtgagggcttttagtggtgagagaaagtccataagtcgccaaagaaaagtcagataaactagaatacatcaaaggaaatcagc

SEQ ID NO: 4878 - DNA, 3918 bp, Homo sapiens
gtggtcagtggctgccccagtgagcagcacagctacagaggttcaggaaaaccaaccccaggagcgtggatgttcactgccttccttcaaccactccaggcaggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcagttgggtatttttttagctagataatttaaacgcgaataattcaagtctgactaaatgaaagtcacataatcagaatgcaaataattgaatttctactgcattcattaattcagtgtggaggtgtgtgtgaagactactatgatgagctgtcacagctcaataaaatctcagtcaattaattttttcattatcttagtattatatcaacaaaaaagtgaagtgtgtatatatatctatacacgtgcatatgtgcatactatgtattatataaatacatatacattaaatcaaaatgcaaggaaatacctttctgaatcataatctatatcattttctttttttccttcttcatcttcttcagggaaacgtctattcattaaggcaaacttgtgaattgcttcttccacagagtacttagtctgcccagaaacacacgcctcaatgtcttctgaattcagatggctctgtaagaagagattaagagaagagttatagagcaacaatccattaatacgaacttggatcgtgaagtctgtgaagtctgagcagagtgtttcctgtggcctctgtcagcggtttcctgcctgccataagtacaaggaactgttcatgggattgtactcgtggctttgtttctgttggaaatgtgttttattttctttataaaataatgggtaatctttaaaattgattttagatggtttgaggcattacaccacaacagtaatgagcactaatgccaatgatattggacacaaattcattttagctttatttcatgtctgaagcaattctactgagccttgaactgctcacgtgttgttattaacttgctagtaacttaacacatgggtacagcaaacaaaagtgatcagagtccaggttgatcgggacctcaaggctactgtcctttttcttgagctataattcaatttccaattttactgtacattagactcattatttcccagcgttttctttttctgctcaatactgccatctggaggacacacagatgaaaagagaaggagccaggctcacccagctcacaattccaaagagccagaaagatgtggctggggaggggacatctgaacactcccccaggcctagagttcaaaccagtgagtcggctaggtacagttttggtttttggaatctcctctgtttctctggctaaattcatgccaccatactccatgagttttaaataagcaaaaataatttttaaatgtatttatatgcttattttagtcagatagttcattctgaaatttaaaatgaaaatttttgagagtgttttcccatctggttaggtgagcataattaatttattttgagtactatttggcttactatcagagagggctgtgactgccaccatcataatattaaatactattttttccttagtcatgtttgtgccatattttccacaaacaaatctaatagcccaaaatcaatttcaaacctaatataaagagtactttgtaaaacagtcaataaaatgtcatttgtagaaacctccatttaaaaagtatatgattttcaaacctttataaaaggaataaaaaatagcctctaggattttaaaagaatttctagaaagatatttatagtgcaaatcagaagttattcctttccccataacagttttagactaaacaaagcaaaatctgttttttttccctaaactggacacagttgaaaagcacagttttcctcaacatgattttattagatgtattatatgctggtttagctgagaatatatagctatgcaaaatcatttcatcctaactaaggatgtcctgggtctgctgaacccaatacaatgatatatatacataactgcatagtacatggaaggttagcagtttgatgtagaaaaaaaaaattaactcagcctgtttagctcttactataagaaaaaataaaacctacaaatcttcattgaagacattcatgatctatgctgtggtgccctctattgaacacaaagacataaaaatcgtgtgtgtgtaaaactagctgtcatggttcaacactagccttttgtaaaaaatctttaatattccttaatatttgaagaaatacaaaaccatgatactaaagtctaaactgtagggtaaatgtagttgtattaatgggatgaattcagtaaagaagggaagcggctcccagtcatgaacaaatctattcaaacctaaattgaaaatcccattcaaacctaaaaattagtaggaattccatttttcatagttagagacttactgagtttatattttttagcctataactttcttttcataactattagaagggactttaagtttataattactcaggggcaagaatacaaaagggagattatagttaagactgaagaaaaatgaatatatttgaaaaatctcacaatcataccaaatttagccagcatttaagagtactgctaattttaaatttgccaggttctgggattcatatagtatgtccatctttcctataatttctttatctataaaactgagataatacccaactcctaagatttttagtactgagactaaaacatgtaaaatgccaaacacgtagaaagtgttcgataaatggtagaaattattcttatttggcacctagtcaaagaaacaattttccaattcctctacaaagatcagtactttcttattacatatgtatcatttcacaaatgaccttaaagaaaaataggtatatatacacatatacaaagacattgtggtttcaaaaggtttgaacatatttagtgcttctggttcataacttcaaaactcacatgaaaaccaggctttaaaaatgcatgcgaaaaacctacaatacaagcatgtttccatgttttaatgctgtggttcctaaaattcctctacaaacaaggtacaggctattgatggctggccctacttaacaggtaaccagtgggggctcagaggatgtcaaactggggccaagacacagtgccaaggtacacatcacatccagttccctagagtggaccctggttgggtgaggggagggggcaccaggggcaaagacatggagggtactaccttacacaacccgggcaagcacagatctgagggacacagaagggaggctggggagggtcagcaggggccgcagagctcagttcaggcctgaagccagccctgtggtatttgactcctcacttccttcaggtttaggctgtgtggaagcaccagctttcatttttaaagtgaaatattaacttgtagacaaatgttcacataccacaggggaacaaatgatatcacaagagaaccccctgccaattccatgatttgacaatccaatcggatgacaatccagattcagtgttaatgaatctagccgtagccctggatgtgtacacagtgctccccctagaaggaagtgtcaggacaaggacttgttcattctgtgcagtcctatgtccgtggcacgcagcctggcccaaagcattcacttaataaacatctattgaatgaaggatcgctgcatggtttttagagtttttttcaagtccttttcatctgtaggacacaaccac

SEQ ID NO: 4879 - DNA, 11117 bp, Homo sapiens
gctcgccgtagcagcgcgagtagggggcggagcccgccgcgtgcccggaagcgctcgattccccccgctgccttgatgtggcgcgtgcggagggctaggagcgcgcggctcaggggtgtctcgttggtcgctgggtccttttccccacccagagcctccccggccgccgccgcgagctgcgcgaggcagaacgagagcgagtccgtgagggttggcttcgcagccgccatcttggctcgggcctcagactccgccccgcttctcgccgctgatcccagggagcggaactggaagacagggaaatcgtcgggcaccgcctcgctgacgctgtttagcgccaccgcagtgatgcaagtcggaagttgtagttctcgaccccggaagtctgtccttgcacacgaggcgcggcagtaccttaatcgcagcgcatcctgggacgtgcgggcggtgcatgagggagatgtggtccgcgtcgagcttctcacgcctacctcgggaagcgctggaaactcttccagggccctccaggtgggccagggcctccgaacagcccagaagtccgaccacggagccttcgtgccgtgccccgcccccggcgtgcactcggcggggaccgccttttctcctctaggctcgcttcgctgccccccagcggtggtgcggcccggccttgggacggactccgagaaccccgagccgggccgaaagtgcggggtcctgaccgcgccgcagacggggagccctcgctcggtcagaggaagaagagggttaaacctaccgagaacgttcgctgccgcttcctagagtgacgggcttgtggaattttccgtttccggagctggaccccggtgtcccgagtgtcctccgctctggacgtgctcgtgagctcaggagctggcatctaggaaacggggagttcttcactcgcagcgcagtcggccgcgccagaagaggcgagggagaatccggacggggcggggcggcgggggagcgggacattcgcgtcccggggagcccccaggtcacccctggattgcgaggtggctccgcctgagcagcccttcctggtgtggtcggggcagctgcccgcccggaaaatggtcaggctctagccctggggaggaagaagcctttgccaagagcaaccgtctacaagccccaaaacctgcgagtgccggaaatgtggactgaccacagcctgcctccccggcttcattcaccaccaaggcagcccctctggtgacaagccttaccgttgtccgggttatggcagaagcttccgatgtggctctgatctggttaagcaccactgggtacacaccggtgaaaagccgtactcctgccccgagtgtgaccatcgcttcggccctatgcctgtgcctagtgtggtaagactttcagcgtcagctccaacctgatccagcaccagcgcgctcacaccgctaaaagccttaccgctgaggggactgcggcaagagtctcagccttggctccaccctgttgcagcacctgcgctccacatgggtgagaaggcctctaagtgccttgtttgtagtaagagttttgtgcacagttggaatctgctgcggcaccagcacagtcacaaagtccggaaacctgatgcttggtggtgagtgtggccagaccttcggccacagctcccacctgcccatccactaggcggcccacagcagcacccctgcgtctgcctgcagtgtggcagggccctagcgcaaagctccaacctgggccagcaccagcggacgcactagggcggcagcctctgcaaatagccctggcttcaattttagctgaaacttcagctctgactttggttcggacttcaaggaaatggaaggaaccaggatctctaagcagacccccttctgctcccttagggctgttgattttagagctaatgatgggattcggttggggcgagggggtctccacatctttttgcccaaccctttgctaagtcaaggaaccccagtctgggctgggcatggtggctcatgcctgtaatcccagcactttgggaggccaaggttagcggatcactggaggccaggagttcgagaccagcctggccaacatattgaaaccctgtctctactaaaaaaaaaatgctaggcgtgttggctctcgcctgtaatcccagctactcgggaggctgaggcaggagactcacttgaaccccgggaggcggaggctgcagtgagcgaagatcgtgccactgcactccagcctgggcgacagagagtgtctcaaaaaaataacaaatttaaaaattgtttttaacaaaggagccccagtctggaagaatcagaacactagatctgtgatcactgccttcaaagagcccagtcagctgagagggcttaggtttgttctttgaagttacaaagacagaacgtcgaccagctgaagggagagttttggaatggcgggagctatccagcgtggacccagctgcctgcagatctggcagtagctgacacagtcccttcacaggcctagggagtgatggggttaatcacacctagaacaacagctacctcttcccagaggaatgggaccagaaatcaggcaagcccctgtgaggagttccatggcagcgcgcaggcggggcattcctaacctccagagggaaccatgagggatcctgtgttctggcagatgggccagagaatttgaacttgggaccattgtgtgagccctgggtgtgtgagcccttcaaaagtcctctcagcacgtgagaactatcattatggatgatgctagggtggtgggggccccagaacagacctgtatgttgagttcaggggttgctttgttgcatttctgggcaggggcaagaggcccagggtttgtcatctgccccttcccctgccttatccccttcccttccaagttccccaggctccttttctgccagtctgtcaagagagggaagagtggcgaagagtcctttgtgcctggacattggggactgaacatggcccttttgcctgggcattgcccaaacatatatttctactggcataactttgtgtatgtgagagccaggggtaggcttcccaaagcacctgcctgtgctcagagtagacaccaagctctgaggcccttcccttccctgctgggggagggagttgtctgtttcaaggacctaatgtccaccccttgtgggacagtcctaccatcagtccaggcatctggtctgctgcccccaaattttaccatcttttttttttttttttttttttttttttgagacggagtctcactctgttgcccaggctggagtgcagtggcacgatctcagctcactgcaacctccgcctcctgggttaaagtgattctcctgcctcagcctcccgagtagctgggaccacaggcttgcgccacgatgccagccagtgtttgtatttttagtagagggtttcaccaaccctctactaaagaccagcctctagttggtcaggctggtctcgaactcctgacctcaagtgatccatccgcctcagccccccaaagtgctaggattacaggcatgagccaccacgcccggtaattttgccatcttttatcaggctttctgtgtcgaggacgctacccacatagagtagaacctaaagggaagggatgtgaagtgacctcaccctcagcttctagctcatggtgtcaaggcttgtgtgatcttagacacgtctgcctcttctgagcctgtttcttcatctgtaaaacagggatgggaggttgtggtaaagattccacagcaacactgcacacgcatgaagtacctgggccagggatgactcggcagacctcagtttccctctgcctcctgcctagagctgttagcaagcatccatcatgcggctcacacaagagctccccccggaggttacagaaatgaaggcagcagccccagtccttgggtagcctgtttccccttgaaggaaacagactcaatatcagcaacacagagtgaatgacgccagggtggcgaacgggcctttcctggagcaaatgcgggaggcttcatggagatgacgtgtaatgaacagcactcatctcaggctgggagcagcacatgcccccggcagggagtcagtgatgaggtatggggttcttgacatcttcctcacccaggacccttcagagagtacgagccagggtttgagtgaagggcctgagcccagcacatgcatggtaggcactcaaagaataattgtcatgatcaggtcctttttacactgcttactagtggcctttaagcctcagtttcctcacagttgccttgagtgagtgtcaagtgttgtagacctctgcaaaattcataactgcttaagaatattaggtatgggtagagtaggcttggaaggaggattggtttgcagaatccctttcagagacctgtaatctaatttctcacattagggctaatactcctgggacccctctcctctccaattgcataaaacaggttctgaccagaacagcgaggcaggccagacctcagaagcagagggacgggcttaatctaacaggagtttatcccatgtcctgcatccactgtaccctgtgctgggtttagaagtagcttcactgtccaagcttgtgacccagtgcccaagcccgagatgggaaacacatttgttttggctgtgtgtgtgtgtgtgtgtgtgtgtgtgtgtgtgtgtgtgtgttttcaaacaagccaagatttttactttttgagttccattttgttgcccaggctggtctctgaaacttccaggctcaagcaatccccctgcctcagcctcccaaaatgctggaattacaggtgtgagctaccatgcccatttatttatttatttatttatttatttatttttgagacagaatctcactctgtcatccaggctggagtgcagtggtgcaattgtggctcactgtagcctcaacctcctgggctcaagtgatcctcccaccttaacctcccaaggagctgggactacaggcatacaccaccacacctggctaattttttgatttttaaaaaatgttttgtagagacggggtctcactgtgttgcccaggctggtcttgaactcctgagttcaagtgttcctctggtctcagcctcccaaaatgctgggattacagatgtgagccacctaacctggtctttttatttttttaaagagccaacatttaaataaggagatttcacatcacagtcgatttctggggcttggtttgttgttgttttttttgtttttttttttttttaattgagacaggatcttgccaggttgcagactggtcttgaactcctaggctcaaatgatcccctcctggccgggcacggtggctcacgcctgtaatcccagcactttgggaggcctaggtgggcggatcacgaggtcaggagatcgagaccttcctggctaacaaggtgaaatcctgtctctactaaaaatacaaaaaattagctggaaatggtggcaggcgcctatagttccagctactcaagaggctgaggcaagagaatggcatgaacccaggaggcagagcttgcagtgggcggagatcctgtcactgcaatccagcctgggtgacagagcaagactccgtttcaaaaaaaaaaagaaaagatcccctgccccggcccttccctcccccacccacctcggcttccgaaagtggtaggattacaggcgtcagtcaccacacccggcctgctttattatttatatcagaagatgctgcaacattggatttttatggcagcagttcgttgagtagtggctgtcctggacataggaacagggacactccctcttgcatccctgactcagcacgtttcatatgtgttacttgcctgtcccctgcagaaaagtacttgaggttacagtctccatcccaccccactgtgggtgagaaggacctttccatgcagtgaaggcacttttcccctttccttcaccccttcctgttcccttctctgccgttttccttcttctcccccagaactcctctgtgaaatacctggcctccttccctgagcctccctgtctccctgccaccccatctccactccgtgctatgacatcaccccgtaatttgaagctcctttccctatctgaagggaggcagagacagagtgcacaggctcaactaggcaaggcagacccttgcatgcctgggtcagaggtcagggtctctggcacacattcctcccagagcaactgtaggaagcaagccagtacagaggtactctaagcgctagacaggacggggtgggagtcggtaacatcgtctcctctgggctggccctgcttctgcttagctctgggcataagactgactccagtacagtcacagttatgtctctgagctcacccagtcctgggttccaggttcccagctctgagcctggcgagacacacacaggctggtgctgtgggatgtcttggtacggtggctcacgcctgtattcccagcgctttgggaggccgaggtgggcagatcacctgaggtcaggagttcgagaccaggctgcccaacgtggtgaaaccctgtctctaccaaaaatataaaaattagccaggcatggtggcacgtgcctgtaatcccagctacttgggaggttgaggcaggaaaattgcttgaacccaggaggtggaggtttcagtgagccaagatcgtgccactgcaccccagtttggatgaaagagtgagactccgtttcaaaaaaaaaacaaaaaaaacaaaaccaaaaaataaaaaaacacatcagcttgacattttggaggcattcccagactcagggttagtcagcagattagcatttaaaagaaagtcttgtccctacagattccctgacctcagctacccatgaagggtgggaagaggagtccttagcaagaagtccaggaagttgacaacctcctcagacctgataggacactcctctctccaccctgcctcctgactgatttaatctcaggggtgtgaggacctctgagataggccccaggagtctcacccgcaccacttatgtctcagggctaaccagagactccctgaaacagatcctagaggattcccaagtgataggataaatagagaggtactgagacttcctggcgtgggtgacctctcccaggctggccaacctcccccattcagaaatttgctgagcaccaggagtgaatgaagtaaaggaagcccctaggagttcaagaagcagagatttccaggtccatgcaccaaagctcatgtgctcaattctcaggaaaggcctcactcagttaaaaaattttgtatcatgaaagggtaaatgaattaattagtgaatctggtttctaagccaatggcttactagaaatattatagtaaatcagaaaaaaaaaaaaaggcggtggctcacacctataatcccagcactttgagaggctgaggtgagaggatgctttgagcccaggagttcgagactagcctgggcaacatagcaaaccccatctctagaaaaaattaaaaaaccagccaggtgtggtgatgttcactgtagtcccagctattcaggaggctgaggcaggaggaccgcttgagcccaggaatttgagactgcagtgagctaggattgtgccactgcaccccagcctgggcaacagagtgagaccctgtctctaaaaaaataattttttttaaagataattcttcaaaggagatccgctcttcctttcctacacccattccctttcctccctttcctgaacaatgctgtcttacagcctctaggggcaggcagagccaaagaggcctctgccgggtgtggggagtgagacgcagcaggccagagcatgtatcagagctccagcaggtgggggagggtgtccacacgagaaggtggcctggcttggcatggcagaacctgataggattaggaaggcatcagccacgggaaggagatggcgagagagataagaaactgcttccaccagctattggtcaaataagtacacatttgaaagataacagccaggtttctcagtgtcagagaaaaccgagacacagctcgggaaagggagaaaatgtgggtggggagacccttgtggtgtcgaattggaactggaggtataggagtagactcaggattttcagaaagtgtttagatagacatagaaattagtatgggtgtgtatatgtgtatgtgcacgcagatgtgtgtaaatgtccatatattccctagctctggaaagccctggagcagtgccatcccaataacaaaaagctttttatggttttttgagatagggtctctccctcacccaggctggggtgcagtggtgcgaccacagcccactgcagcctcgacttcctgggctcaggtgatcctcctgtgtcagcctcccaagtagctgggactacaggcatatgccaccacacccagctaatttttaattttttttttttgtagggacgggtcttgctacgttgcccaggatggtcctgaactcctgggctcaagcaatcctcccacctcagtctcccaaagtgctgggactacaggtgtaacagttttaaggtaatcagaatcaagaaatgattgaggtgatgctctggaataatggggactagagagtcgtgacaactaaatgcaatgtgtggtgtggtagcatttttctgggctgtagtccctagatgggtagagaagaaagccccggagagggtgaagaggtggggatgtggaagacgtcagagagagcacagggcagagcgcagagaactgcatccacaggcctcgccatgcccccagcatggctgcaccacaccagcagatgccttcgcttcccagcagtggacacaggtcactggatcctcacaaatgagcagccaggagaatgtttgcagcctggagattcggggctttgtcagcaccttgggaaggttttgttcttgggttttgggtttttggtttttggatttttttggtaacaatatcgctatatttattctcctgcagtacacttttaaattgcttcaacattttccccttaaaataaaaaagaacaacaacaaaaaaattccaaaccttagaattgaaatatttggccttttctctctctcttttttttttttttttttttttttgagatggaatctcgctctgtcgcctaggctggagagcagtggcgcgatctcagctcactgcaacttctacctcctgggatcaagcgattctcctgccttaccctcctgagtagctgggaccacaggcgcatgccaccataccaggctagtttttttttgttttgttttgttttgttttgttttgttggtatttttagtagagacggggtttcaccgtgttagccaggatggtctcgatctcctgacctcgtgatccgcctgcctcggcctcccaaagtgctgggattacaggtgtgagccagtgcacctggccttggccctttctctttttatttcctcgcagttctctcccttttttaaaaaaaataataataaattgaatttataaatagaggcaaggtcttgttatgttgcccaggctggtctcgaactcctaggctcgagggatcctcccaccttggcctctcaaagtgctggattacatgtgtgagccaccccacctggccccagctctcttaattgccagcactcctcttggaagtccctcatcttgattaccttatttaaggtcacctcctcacaggccctatcttttttttttttttttttttttgagagggagtttcgttgcttttgcccaggctgcagtgcaatggcgtggtctcggctcactgcaacatccatctcctgggttcaagccattcgcctgcctcagcctcccaagtagctgagattacagacatctgccaccacacctggctaattttttggaatttttagtagagacggtgtttcaccttgttggccaggctggtcttgaactcctgacctcaggtgatctgcttgccttgacctcccaaagttcagggattacaggcgtgaggcaccatgcccagccagtccctgtcttcaaatacagtcacactgggggttaaacaatgtataaatttgggggcgatacaaacattcagtccataacaccccctataccccaaccctaggcaaccactaatctacatcttatctctacagatgacctattctggacatgtcatataaatggaatcatacaatgtgtggtcattcgtgtctggcttctttcatatagcataatgttatcaaggttcatccacactgtagtatctcatttctttttattaggaataatacagtttcactttatggattgctgtggtttgaacctgtcccctaaagttcatgtgttggaaacttaacctccaattcaactgttgagaggtgggaactttaagaagtgattaggttatgtgagctcttccctcatgaatggattaatggcattattgcatgagtaggttagttatcaagggagtggacagctgatagataaatggatgggttctgcccccacccaccccctctcttgcactgtcttgcccttccgctttctgctgtgggatgaggcagaaagaaggccctcaccagatgcagggcccttgaccttcgacttcccaacctctagaactgaaagaaagatatttctattctttataaattatccagccttaggcattctacgatgcagcacaaaacagactaagacatggatatgccactttcttcaatcatcagttgacagacatttgggttgtttccactcgggctattatgaataatgctgctatgaatactcacgtacaaggtttttgtggaatatgcttttatttcttttggttacatatctagaagggaaattgctggatcatataactctatgtttaaacatctgaggaactgccagaccattttccaaagttaatgaatgattttacgttccaaccagccatgtgtgagggttccaatctctccacattctcacaaaaacttgttaattaactgtcttttcagcttttttttttttgagtcggaatctcactctgtcaccaggctggagtgcagtggcgtgatctcagctcactgcaacctacgcc

SEQ ID NO: 4880 - DNA, 748 bp, Homo sapiens
gaatggggtagatagcagctgtcttcatcactgtcatcattgttggctcacatcaaatcaggaccagaaaaccctgttgacttctgggtcttaaactgctgtatcagtgaggggcttcctcctcatactcattgccaggagtagagtaaggcttttaatttcatctctaaccaactctgatagggctggaaatgtgtatggagttccagacccaccatggggccccagtgctagcttcttagccctcctttgtaaggtttgcactagtttgatgggagagggattttttttgtcttgattctgaagctcttaaagaaatgctcctttttctccataacttgaggatttcacaattgtattggaattattggtgttaaggagttaggtccatctcttggcagcttgtgaagggtgggcaggcacctgtgaattcttcactggcttcttgtaagaatgactttactggagggtgctgagtttgtgattatctcctctgctgctagaaaactccgtgaaccctggtacatatagcgtgataaatcaagtcctgtttttgctcctaacttgcattatggtgtttgatactatatcttcatttctcccatggtagtaataacactgttggaaagagctctcagttggaagttgaagatccaggttctagttgaggcaccagagtttccttgggcaagttgccatacctttttgggccttggtttcctcatctcaataaaatgagtttctgttc

SEQ ID NO: 4881 - DNA, 1126 bp, Homo sapiens
ctaagatgaaccccaacaacccccaactcctcactttccagagcagtccacggatattttgatccaagagagaattactctgacaaggagtccctgtcgttcatgatagacacaatgaaatccaccctcaaagaggactacttcggatacaatcacagcaaccctggcctcggccctgccctgtccctgccatgcaacttcacaactcagctggcctagacccctgggaggcctccaagtccctaagcggttccagtttgtggaagtcccaggcaatcactgtgtccacatgagcgaaccccagcacgtggccagtatcatcagctccttcttacagtgcacacacacgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctgtctcctggctaataatctccagccagctggaggaaggaagggcgggctgggcccacctagcctttccctgctgcccaactggatggaaaataaaaggttcttgtattctcactgcttttgaggctttttcgttgccagcaagggcttttgcattgagggaaaaggaagcacagaacggattcatccagggtcctggagaggagggtgtggaggcaagaagcaggaaggacaagtcctcctctcggcacgcctgggtccccaggactgctgaagcacaagacccgaggggtggcctggtccttccctcctggcctgtgtggactctgatggggctgttggacgcggtggccttcaacctggggcccgttggccagagctcggcctctcagagaccgctgcaggccctgcctcgcctcctcctggccctgcacctccagccattcactgcggctctcacagctcagtacggtcggaatttgcgctgggcccgcagcagctcgatcctctgcttgtcctcctcgaacttcttgcgcagctgcgctagatc

SEQ ID NO: 4882 - DNA, 4327 bp, Homo sapiens
agacggaaggggccaggttaacgcagccgcgcgcccgccgggcagccagaatcgtcaccgtagcgcgggaaggggcctcgcgggccgtctgcagcaggtgcggccgggagccgcaggcccgcgcgttgccatgggttaccagggcggttgccatgggttaccggaccgaggccggctggctcgctacctgcagcccagtcgccgccgccagcggagcggcccgggcgggacgcggcgggagcgcgcgtgtgcgggacgcagcgcgggggatgcgcgcgggccgcggaggcgccgcaaccaacaggcggccgagggtgcagccgcgggagcgccaccgccagtggggtggggggcaaagctataaagaaggcccagaggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcagttgggtatttttttagctagataatttaaacgcgaataattcaagtctgactaaatgaaagtcacataatcagaatgcaaataattgaatttctactgcattcattaattcagtgtggaggtgtgtgtgaagactactatgatgagctgtcacagctcaataaaatctcagtcaattaattttttcattatcttagtattatatcaacaaaaaagtgaagtgtgtatatatatctatacacgtgcatatgtgcatactatgtattatataaatacatatacattaaatcaaaatgcaaggaaatacctttctgaatcataatctatatcattttctttttttccttcttcatcttcttcagggaaacgtctattcattaaggcaaacttgtgaattgcttcttccacagagtacttagtctgcccagaaacacacgcctcaatgtcttctgaattcagatggctctgtaagaagaggtgaaggctgctatctgaaagcaaaagtgcattctgtaggactctatattaaaaaaaaaaggaaaaataattggtgaacaggatggtcagtgatagggtagaagaaagaaaaacattagaaaagtaccactgaagattaagagaagagttatagagcaacaatccattaatacgaacttggatcgtgaagtctgtgaagtctgagcagagtgtttcctgtggcctctgtcagcggtttcctgcctgccataagtacaaggaactgttcatgggattgtactcgtggctttgtttctgttggaaatgtgttttattttctttataaaataatgggtaatctttaaaattgattttagatggtttgaggcattacaccacaacagtaatgagcactaatgccaatgatattggacacaaattcattttagctttatttcatgtctgaagcaattctactgagccttgaactgctcacgtgttgttattaacttgctagtaacttaacacatgggtacagcaaacaaaagtgatcagagtccaggttgatcgggacctcaaggctactgtcctttttcttgagctataattcaatttccaattttactgtacattagactcattatttcccagcgttttctttttctgctcaatactgccatctggaggacacacagatgaaaagagaaggagccaggctcacccagctcacaattccaaagagccagaaagatgtggctggggaggggacatctgaacactcccccaggcctagagttcaaaccagtgagtcggctaggtacagttttggtttttggaatctcctctgtttctctggctaaattcatgccaccatactccatgagttttaaataagcaaaaataatttttaaatgtatttatatgcttattttagtcagatagttcattctgaaatttaaaatgaaaatttttgagagtgttttcccatctggttaggtgagcataattaatttattttgagtactatttggcttactatcagagagggctgtgactgccaccatcataatattaaatactattttttccttagtcatgtttgtgccatattttccacaaacaaatctaatagcccaaaatcaatttcaaacctaatataaagagtactttgtaaaacagtcaataaaatgtcatttgtagaaacctccatttaaaaagtatatgattttcaaacctttataaaaggaataaaaaatagcctctaggattttaaaagaatttctagaaagatatttatagtgcaaatcagaagttattcctttccccataacagttttagactaaacaaagcaaaatctgttttttttccctaaactggacacagttgaaaagcacagttttcctcaacatgattttattagatgtattatatgctggtttagctgagaatatatagctatgcaaaatcatttcatcctaactaaggatgtcctgggtctgctgaacccaatacaatgatatatatacataactgcatagtacatggaaggttagcagtttgatgtagaaaaaaaaaattaactcagcctgtttagctcttactataagaaaaaataaaacctacaaatcttcattgaagacattcatgatctatgctgtggtgccctctattgaacacaaagacataaaaatcgtgtgtgtgtaaaactagctgtcatggttcaacactagccttttgtaaaaaatctttaatattccttaatatttgaagaaatacaaaaccatgatactaaagtctaaactgtagggtaaatgtagttgtattaatgggatgaattcagtaaagaagggaagcggctcccagtcatgaacaaatctattcaaacctaaattgaaaatcccattcaaacctaaaaattagtaggaattccatttttcatagttagagacttactgagtttatattttttagcctataactttcttttcataactattagaagggactttaagtttataattactcaggggcaagaatacaaaagggagattatagttaagactgaagaaaaatgaatatatttgaaaaatctcacaatcataccaaatttagccagcatttaagagtactgctaattttaaatttgccaggttctgggattcatatagtatgtccatctttcctataatttctttatctataaaactgagataatacccaactcctaagatttttagtactgagactaaaacatgtaaaatgccaaacacgtagaaagtgttcgataaatggtagaaattattcttatttggcacctagtcaaagaaacaattttccaattcctctacaaagatcagtactttcttattacatatgtatcatttcacaaatgaccttaaagaaaaataggtatatatacacatatacaaagacattgtggtttcaaaaggtttgaacatatttagtgcttctggttcataacttcaaaactcacatgaaaaccaggctttaaaaatgcatgcgaaaaacctacaatacaagcatgtttccatgttttaatgctgtggttcctaaaattcctctacaaacaaggtacaggctattgatggctggccctacttaacaggtaaccagtgggggctcagaggatgtcaaactggggccaagacacagtgccaaggtacacatcacatccagttccctagagtggaccctggttgggtgaggggagggggcaccaggggcaaagacatggagggtactaccttacacaacccgggcaagcacagatctgagggacacagaagggaggctggggagggtcagcaggggccgcagagctcagttcaggcctgaagccagccctgtggtatttgactcctcacttccttcaggtttaggctgtgtggaagcaccagctttcatttttaaagtgaaatattaacttgtagacaaatgttcacataccacaggggaacaaatgatatcacaagagaaccccctgccaattccatgatttgacaatccaatcggatgacaatccagattcagtgttaatgaatctagccgtagccctggatgtgtacacagtgctccccctagaaggaagtgtcaggacaaggacttgttcattctgtgcagtcctatgtccgtggcacgcagcctggcccaaagcattcacttaataaacatctattgaatgaaggatcgctgcatggtttttagagtttttttcaagtccttttcatctgtaggacacaaccac

SEQ ID NO: 4883 - DNA, 1964 bp, Homo sapiens
gggacttcccggtaggctcaggatccccctccctgctctcccctcccccatcttcaccactgctctctcagagatccaggtccgggagatgacagtggctcccagaaagcccaggattcaatcgctgagagagtgcttaggcccgaatgccggcccaaatcgttctactcaccgtgtcggaggccgaggccgaggccgagagcgatgagagtgcagggaagtggggaagagggggtggccgccaggctcctccgcttccctgggtccacggcggatccctcccgcttgtcaggaggcggccagcgggtaagctgactggcggaaatgcgagagaggagaagggaaaggtggaaggctaaagggggcaaactgaggggaggcgggtcccgcaaccgagactgggatcgtctcccctccgcaaagcgaacccaaaatggcggcgggagcggcggcggcggcggcggcagcagcagagtggcggcggtggcggcggcagctcctccagagggagggagcgaagggcgcctagcgcccccctcaaccttccactccttcctccttgcgttctttcccaccgtcccccgctccgcccgactccgtccgcgtagcgcgcacgcccgcccgcacgcgtacgagtgtctacgggctcgtcgctggctgctcccaccaaccaccaccttcggccgccccgcgcgccagccagcccgtacgcgctcacccacaggaaccccctcgtccagtccctcactacccctcaggccctgtcaagccggcgccggcgcaggccctcacgcgtaccttcaacggcgcaagcccaagcctcctcctcctcctcctccacctcctcttctctcctccccccccttccccgcccccacggccaccaaccgccgccacggccgccgccgccgccgccagccccccctaccaccctccacccctcgcgcgtgcgcctcccacaatcccccccgcgggactgttccattcctgtcggctgcaggggcaggagaggaagggacgggccgagcgggtcggggcttgccgtttgactggaattgccagaatggcggaccgagccccacgacaacctacctccctgggctcctcgccgcagcgctgcggctcgcctccctctgctcctcctcctccgccggatcgcggcgagcggatcgaggactgcctagcgcccctctgcccaccggtggttggaggccgcggcggctgcgcgttgagtcgtttcctgccggttgacctgagcctacttcgcagtagcaggaccgctgctgtggagctggtcgcaggcggtgtgtgccggtcgcctagtcaggagaactagtcctcgactcacggtgagggaatggaccgacacgggtattgtaccgctgagggaaaggagcgggactccggacctccaggaggtagggagtgaggccagtaggaccggcgcgcctccggggggattcctcccgggcgttgagttgccaacctgggacccgaggaagatcggcgtggtggtgtgctttttgttgttgttaaccctcctcggatttctcgaatttcacaccactgtccatatgcgatgatgtttgtttgcccttgacgcacttactcatggatggtacttcttcagcctcgttagacagcctggtgatggaggatgaagaaaccatgtgcttttcattcagttctggacttagtctcccttttcttccttcagcaagttatttttgttagttccttatcaaaaagtgtacataaaaattaggcaactccaaacatgcctccagggttaatgtgtgaaataataagataatatatgtaaagtggaattagctcctaggcatagggaaagtgcagaatattgccgtgttgtcatttacagttctgttgatgtcgataacgtttgtgggtgtaattggtagtgttctgtccctccaaggagttaataaaacaaagcaaacata

SEQ ID NO: 4884 - DNA, 314 bp, Homo sapiens
gtattagctctagaattaccacagttatccaagtaggagaggagcgagcgaccaaaggaaccataactgatttaatgagccattcgcagtttcactgtaccggccgtgcgtacttagacatgcatggcttaatctttgagacaagcatatgctactggcaggatcaaccaggtaggtaggtagagcgcggcgaggccccgacgcggccggacggccggccggggggcctcgcgaggacgggcccggcgccccgcaagcgaggaggacgacggacggacggacggacgggccgcggacggcccgacccgcgcccg

SEQ ID NO: 4885 - DNA, 1076 bp, Homo sapiens
caacagctgtttttcttaacgctctgtctcccgaaaagccccagtgtgtgttgttccccttcctgcgtccatgtgatcccatttttcagctcccaatacaagtgagaatgtggcgttttgtactcttttcctggattagatttaaagtggactcattccaattacagggcctcgaaagagtcctgtattgttatttttcgtcactacctccccgggtcgggagtgggtaatttgcgcgcctgctgccttccttggatgtggtagccgtttctcaggctccctctccggaatcgaaccctgattccccgtcacccgtggtcaccatggtagtcaccaaagccgccggcgcccgccccccggccggggccggagaggggctgaccgggttggttttgatctgataaatgcacgcatcccccccgcgaagggggtcagcgcccgtcggcatgtattagctctagaattaccacagttatccaagtaggagaggagcgagcgaccaaaggaaccataactgatttaatgagccattcgcagtttcactgtaccggccgtgcgtacttagacatgcatggcttaatctttgagacaagcatatgctactggcaggatcaaccaggtaggtaggtagagcgcggcgaggccccgacgcggccggacggccggccggggggcctcgcgaggacgggcccggcgccccgcaagcgaggaggacgacggacggacggacggacgggccgcggacgggcggacgggagggagcgagcgggcgcgggggcggcggccgggaccggtggggccggggcggggcgcggcgaaccggacgccccaaccacccgccccccacgcgacacgaccaccggggccccgcgccacagacccgcgacgcttcttcgtcgcgcccgcccgcgaggaggcggacggcccgacccgcgcccggcggccgggagggaccggcggccacgcgcgcgcgcgcgcggccggcgcccgcgggcggcggcgaggcggggacggcgctccgcccgccccgcggggcggccccgacgtccgggcggcgagcgagaggcggaccgcgg

SEQ ID NO: 4886 - DNA, 1019 bp, Homo sapiens
cgtttcttgtttaatttcattctttgatagttgtaatagtaattgacaccgaggaaaaaacaatctactctaaatattctacacagtaaggattaaatttcattttctatggttttactatttagtgggcattgtgatacattctaatctacacattgcccctctacccatgccttgtcttttgtcctcagaatatcttattaatcagaactttcataaacatacacaattctttgactgtttcaagagtcaggctatattttcagctcttgtcttgtttctgtgaatatggtggcagaaatcatggatttgagggtcaactggactggtgtcaagcagtcccctaccgtttattagctgaatgagcttaggaaatcatttgtttaacctttaagttatacatcactcatgtctttatttagggtaggccactgtcctctaattccatactgattcttctgggtactctggtgagccactcaaaaaacaatttctgccaaacctttgggaaagtatcagtggtttggtggccaaattcctcatcaaatagtgcaaactggtttcctccaagctgtgacttctgcagagacagaaatgtccttgttaagtaacactgtcctcaaattttctatgtgtatcatagcctacttcctcctgaatactacctttctccaaatcaagactcaaaataatatgttttctttttaatttctatcctaaatcccatatagaaggaaggatgcaagacgtggtctccatgggagacagagtataatcaccaactaggtccaaaagaaaagcaaagtcgtgtcctgggttcctttttccaagttccgagttgtgggaagatgggttgtggcagctccgggagcagacacataggatttcctccttcctcagctctcaggagggccgctggatccaaggcaggggtcaggtatttccgagatgaagtgaactgaatagggcggctacccgaaaggcagtcctcagcattattccaggaaacatcagggcag

SEQ ID NO: 4887 - DNA, 3529 bp, Homo sapiens
gtgacgcaggcgcggttggaaagaagctgaggactggatgtgcggaaaccagccttctccttgctgttgccatgtgaagaaggatgtgtttgcttccccttctgccatgattgtaagttttctgaagcctctccagccatgccaaactgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccacaattttcatttccactaaaatatttatttaatggatatcttacagaaataaataaaaacagtttttgtctaatacagataggtttttttatatatatgtaatttgattttacaaaattgaagcatatcaaattgttttctctaaaacatagctcagaaaggaatagtagaaaacaaacacaaagaaatactgaaatagtctcatttttaaattataagcatgggccttctgaatctcagcatgacatgttattagtaaaagaatgtaagatatggagtcaggggacctgggctccactgtttacttgctacatgtcctaagaaagtttcaatatatctgaacttcagttctctacctttaaaacagtaaagatattaattatatcaacttcacaagattgttgggtaaattaaacacgtaaatgtacatgaaagctctttttaatatgtgaagagctataaaaataacagtttgatttaatttcatataaaagaatcaatggatacctccttttaactgaagaataagcaccaaaagcatgtgtgtgttttcttcagttgaattacatcactctataaacctagagtaagaaaatgcaccttaactaagcaccaaagcctctcggacaaatgggatctagggaatggttctatgagttttccaggcagctaactgggagctaataagtcctgagggtcaaagagggtcctttaaaactctgaaggctcaaagaaaaggaagccaaataagaacatttgtattacatcaaatggctaggatgtaacaagctactccttattcagcaatttcaaagtccattaattcctcacagaagaagaaacacttcgttattatcacttgcaacgatttgcttatgtgaacatggcattctcttgttcaaaaggtcaaagactcgtgcttaagggaggaacaactggagtgaaataacaactctaccatgaattcagatatcactggctaaaaagtctagttacacaagaacatgggaaagaaaaagaatccaagacatcagtataataatgattaaaaaaaaaaccctgccatatttccatgttataataaaacaaaatcataaaaactgcaatatttacagatacatcaatcttacaacatataaaaactttaacaataagaaaaattaagagtagggaaagcagataattttaaggtaatcattaatacattaaaaaatctatttggagttaactgtttacactaacaccactttacacataatagaaatatgaatattttcattgtttttgttttcagtagcaagatgcagaagaaacaaataactgtctaacattaacttattgtaaggagttgtattactgcaaaattactaggtgtaaagttatggtataagcctactcaaaaaatgggttaatataattcaccatctacttaaaatattactaacaagatattggtgaatcatgtgctaaagatactgaaggcccttccaaaactgagatctatgtttgttcaatataccaggtcatataaaactagactagtttactttcttattccaactgttttatgagtgatcttatcataagaaaagtacacattacctctcttaattcccttgcatcatcagatatagatactatttgggacaaaaaataaatgttttattaggagtgtaaaattaagaatctttatagatcttttggaaacagtatattgaaaaggactcaataagtactaagccactgtataaccagaacaataaacaaattcattcaactagg

SEQ ID NO: 4888 - DNA, 9416 bp, Homo sapiens
agttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcaggatgggcctgtggggtctgtgtggggaaggaaggagctgggagcctgggctgcctgtgtgtcggctggatgctgccagcaccggcatggaccaagcaacttctctgagccagatgctggggacgcagaggtgaacccagagacatgatcccatctgctcagatcttcatgtcagaacacgctttattacagtctcggcaagggggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgccggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggagacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaggaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcaggtgcagggagaattcagtgagattgtgtgcctagcacagtgcctgactcccagtaggtgctcagcaaatgctcccatccatctgggagtatagacttagggtttatctatttttttttttttttggctctctggactttaaaactcagcatcttctgaaccagaggcatttctgattagcccttccctacctattttcctagtatcactctttaatcagcttggggaggtggcagcatttcatggcctccgtagtaactcacaatgcttcctggggtatttaaattctactctctcatcagcactgagcacctactttgggccctttcccgtgctagccatttgggggaaatataggtgaagagtggctggggtttgaacctttaggatttcacagccatgctggatgggataaaaccagctcacatggagaatcagagaatgggacagtgccacaaaacagtctactgaggcacaagttctgagtgcctgggaagtggtagagagaccccagagagggctgctgcagtctggaacagcttcctagcaagctgtaccaaacagggccttgaaggatgagaaagatctggctgagatgatacccgaccctctagggaaattcttaaagtaacttctaggaaatgtcattgctccttaaaaaaaaaaaaaaaaaaaaaaaagcaggttctaattcaaattccgctgcactactgaagtagtgcaggacttatcagaacctttaaaatgctaatggcaatttcaaatactcagggacagggcataggatgaagtgttccttgacttttatggccgtagaatctttttctcatggaacatcgtttagaactgtgggagatgctaggctggggtttctatgggaaaagtacagcagtgatagaagatggcataattagggtacacttaggtgctttgtagcattggctgaaaaggaagcagaccgggtgggcgtgggggagtctcaacttggttccaggagccaggccagcttgatgcgttttttttttttctaatggtgggagggcaggccaatagttggagaaactagaggcctgacagtcggtgatggaagagatgtctactaagcacggttgtcagatcttttgcggagagatgcgggtgtgcgtgtgtctgtcagagtgtaacaggatccagccctctgggaaggggctgaccagaaccaggcagggggtttctgtctaggacaagtagggtccattttcaggggagctgaaatatttgcagggggtgctctgagacccacagccaataaatagggaagcaacatgcttttgggcagggtccatgtggttagggttgattttgatggggctggggggcttagagttagaccccctgccctggtcaggccccactccctggctggtgggggcgggaggcctctgaagctgcagctggaggggccggggcagtgttgcatggtgtgattaacctactaacccagggctcagccgggacgctgtggcgtgtgacgaggtgcctggccttctgccaaccaactaacccactaaccaggcccgagcatgccctactaaccacccccccgcagccagatcctactaactgtgcagctcatgggcctttcaaggggctgggatatgggggcagccaaggctccagaaggctctgcctatgggctgggatctttgtgcagacccacgttccaggacagagaatgcaaataagactcaccaactctgccacttcctgttgagtgagtttgagtaagtcacctcacttctctcaacctcagtttcctcagtggtagaatgcgagttctgataccttacaggttgcagtgaggattcccgtcaatataagggtctcagcacatggcagacacctaaaaaaaaaaaaagtatgaggatggaggaaggcccctcaaacctggttgaacacgtctgctgcctaggccctggcctctctgggtgttctgcacacagatccttctgcctggggcaagacacttggctttgaatccatgtcacttccccacattcttcctccgtctcagctttcttttctgtaggcagctcttttgttcgattactaacccgtctaacccctggggtgcctcaactgcaccccgatcatcccttaacaaactaacggacctgcgtgcgttcttccttttctcttagcgactcctgtgtgtgtctgctgaggtgccctgtccgctggtgctgtgctctgacttactaacccagcccctactaaccctgttttctcttcttactaaccccagccctgccgagctctgggctccccccgggggctggtccccctccttttggcaagcagatgacctggggctactggccctgtagacagatgtcccactttgctgccccatattggctgtaagatcagagtccactgggccaggtctaaggcaggggatggccctattaacaagactcagaggaggaagaggtggtcctgtggatgtgggaggctggactctgagtatgacatctctcctatgtgcagaagtctggttgccactgggagtaggtgggaccagggaaatctctgggacgtgagtgtggaggcctgttggtctagactctagactgtggagctctgagcttttgtgtcctctggaaggaagctggggaagaatcctctccattgttaagtgacggggatagaagctgtcctgcacaggaagtcacgaggggggcgtatcccacgaggaaggcaggagggggcgtgcccctcaccggaaattagcagaggggcgtgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagccggggccacacctgggggtgatttcatgcctcacctccagtaggcaccttggtttctttgggctaatctctggctcccttgcgctaactcttgctctcacccagctaatccctgcctcaccctgactgccccaggggctgaccactaacaaccaacctggccctgtctgggggttccaggctcctggcctggccctgaccggttcttaattaacctttccttcaccttgactaactcctgccttcctggtctgttcctttcagcagaaactaatggtttgtggatttttttctgactaacaacaggtctaacattcctcgttactgttaacagcttggatgtcggcatggctgggaaggggctaacacagctttgaacttggctaacacaggtttgaacttggctaacacaggtttgaacttgactaacacagggaaaagcatagctaacaattttgggcgtggtggctgctctgagtcagaacaatcagaagtcggtaaagatggtagttttctaaaggaggtgccagggctctggtgtggaccaggcctgatggagcagtggtacccaccaaggtggggtcagaagtatagccagtcttgcaaggttttggccattgggcatatcttcactcctcatagtctgcatttggtttcagttcttaaaaaaatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttagatcagagtattcagaagggttataactccgtcagtcatttacatgttagtagtataaattatctgagcttcctgttctaacttttagctcttctagcataaactcttctgtgcaatttagctgcaccgaggaaacgggagtttttctggaagggacttttgatctctttagactgagggaacgtcctttgggagtagaggggcagggagcatacgcaagggattccaggtgcaggtaaaaggtggcactagttcaaggttttgctgactcagtctggtagtcagagtctgcaggagaagacagttcaaggcagggcctggaggattggatcagtttagggacaggtcaaaggctggcttacagaccttagaggcaggttgcttgggtcgttgaatgctagtctggtgctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttgctccatttcactcaaagcaggaagctcacacctcctattcctgaaactcctctttgtttaactgcaaagacttgatgctgctaaggatctactatgtgccaggcactgctctgggcgctgggacctgcacctgggctttttcgtcatggtgcttttatagcctagtgggagagttggtgaagtagatagtgattcagtgagatgggtgttatgattggtcaggggtctgtgggagcaccaaggagacagacaagattgatgtgcacctactctgtgccaggcgtgtgccaggcattggggatgtagtggtagttaaacaccatttggtcttcaggagctttaattctagtgtgttgggtgcaggggggtggaatggggacagagagacacctaatccaccctgtggtggctttctggagagggaggcatctaagctgagctgtggctgggtggagtgtgggtggggatgagttccgggcagcgagagtggtggacaccagtttctggggatcagagaggatccaaagaggttctggaaggttcatgtggaatgtagcaagagataggagacatggacatggtgccgggtctggttgccaagaagtttagattttatccttaggccttggggagcgacggatatgatctgagaaagggagttagtggatttgagttttaggctggccatttggcttttccagcccaggtggaactcagaggagtttgcaatggcctctggccacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttcccagaggcagaaggattgggactaggccaacatagagattggcgatggttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatgttgagctggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgctggaaacatgactgtggcctatgaagcagaagggacgtgctgtttaggggagagggggcagccagtggcattctcaaggagcaggggtgggctctct

SEQ ID NO: 4889 - DNA, 5045 bp, Homo sapiens
ttgccaaactcagacaatataatcacaagtccagagaagagctagttaattttaaattccccgaggtccttttactgagatggaaaagcacaaacagtcaaggaaaaccaaagagggaggggtgagggaaggggaaagtgcataaagcacttaaagattttttaaaagtaggtatgatagataagccacaagaagtttttaagactactaataaccataattctattttaatcagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgtcctccagttctgcatccttggattcaaccaactgtgggttgaaaatactggaggtaaaaagacaaaaaataacaatgaagaacaacaacaaaaatacacagtataataattacatttacatagcatttattttgtattagacattataagtaatctagagatgatttaaagtatatgggagaatgtatgtagattatatggaaatatgagggtattttatttaaagggacttgggcctgtggataccaaggaataactaaggtaaaactgagcataagtggcctgtccatattttgttaaatatcagattattgattagtgatcatcaacattttcccgcattcatgcagtgcggcctctgaaaacatggttgaacatcctatggaatttttttttttttttgagatggagtctcactctgtcacctaggctagagtgcaatggcgcgatcttggcttactgcaacctccgcctgccccacctcgggttcaagtgattctcctgcctcagcctcctgagtacctgggactacaggcatgcaccaccacgcccggctaatttttgtatttttagacgagacagggtttcaccctgttggccaggctggtctcaaactcctaacctcaggtgatccaactgcctcggcctcccaaagtgctgggattacaggtatgagccaccgtgcccagcagaattttttaactatttggttacgactaatttggataatgtagtgcatgcagctttgatttgtgccactaagagtgggcaaactgtcttcctttttgtgaatcagtaaaaattttccctcaacatgtgtttgacagttgtcattcactgctaagttaaggcatttggtaaaccacacagcctctgcatccttcctagcgacagccacaagaaaaggtgggcatgggagggaaaatgctcttgtgaattgaactggaggcaagctccacttttctttagaaaaagatgtagatcaaaataactaatattttcttccttgctcgatttctgtgccttccatggtacatcaaaataataggaccagtaatggccacaatcctgttgactgctgttaccttcgccccaatatttctttaagcatttcttaagcatctagcttgtgttttgttatatttaacagattttcttaaagtattgtatgaattaaaaccagaaataacttcattttcctagaaagggataatttctcccggagaataaatcctgaggatttagttagatgctgtgggtattgtattttaaataatattttaatgggagcagctgattgactttcaaatggattgtttacattaatagtaattctgcagttgttttactattgcatcagtctgccagacaagttccatgtgcatattttaattcagaactaattatacttaaaaatttaaaccctgcatacttccccaaaaatgtttagggcagttaaaaacaactcttttggaagatgactcgcattttaagaaatgagagaacactgtcaaatgatgaatgcatttaaaaaataatttgcaaagtgataaaagcccttagttttaaatcttacaatgacattagctcttacaagaactcagtaagtatttgctgttttttaatgggatagtaataaggttgaggtttttgttaagggacgtttacttatcatcaaactctatacttactactacaaggaaactccaagtacattaaacactatgttttataattctttgccacactgccaataaattctgttcacattttaaggatgacaagtccactatatgtaacacgtaagaatgctatcctggcagtagacacagggccagaataaactggcaagttttcattccacacaagtgtgggaaaaaaatgactacaacttaaactttatttacttgattgagagcttattgcacatgaaatgttttatgtggttgatcttaacttcgtttacattgacttctatgctcaagattgttcaattgctgctgctgccgttgtgttttctttcaggatcgaggtgggtaccttcatataatatcttctttttaatttcttctctggcaattctttcctggattctttgctttgcataattatacctacaatgaaaccttagaagaaaagaatatgaataaattgttaatataaagtcctacagaaattaatttatgaaatttctctaaatcacacaaaacttaaatacagatgactactaccctgagactgaaaaatatgttctaatttatagtgctatttttgggcagttttggtgtcagaatacctatcaacacattctttttttattaggaaaaaaaggatgtctacataacaatttgtaaagtgataaaatccattagtttttaagtcttctgatagcattggctattataagaaacaagtatttgctctcgtttttaacgggataataatgctatgtctacataaaatgatttctaccaccttaaatagctcactgtagaaattcatgtataaatggaaccatatagtacatacatatcatactcttaggtctggcaaatatttgaggttcatccatattttatattcactcatcagtagttgtaaacacattcttaaagtagcattttcagatatgaataagcagggatgaaataagtattagggtaagggaaatggttgaggctttcctaagtgaagtgtaaaaaccacagctttctttttaatgggatgtctaatatgcatttatctgttcaagcattttaagatttccatgaaaatgtcctgaaaaatcaagattcttcattgagggtgaggatctcccaatgggagactgctctgaaaagagcatgtgctttttgaattagataacctactataatcatggatgttcttgaatacttagcaaacataccagcatcccaaagtcaccaagataaaccctcctactccaacatcacatgatcttctaattctacctgtaaaaataagcataacaattaattagaatataattacgttatatacattactccacctagaaaaaaaaatagttcattatgtagagaaatgctttttttagtacatagagaaataaaaaatacagatactcactagtgaacaaaaaatgtccaaagccagccacaacagatcctaatgaaccatacaatattgaatgccgggcgcagggagtattttcaacatctaaaaatcctaggagcttaagggactagaatgaaaaaaaagaacctagattgagtaagaaagtatttcattttggggtgctttggcaaaaatgacaatacaccatttcttttcttgtagttgagggtttaaactagagtatgtgccacgtgacaacctaaatcagcttgcgttgtctttgtccacctttggtatgcagtctgaatctttaaatccgaaaaccttacaaattggaccggaaaacccttaagcagtagggtaacttggagctgtatcttaatttgctaatcaactgacttggaaataggataattcattttatgagctctttaaatgagtttatttgggaatatgcctatcattggaattgaaagcagcatagcttgcttcagtaactccaataatttgggaagcagaaatggaaaaagtaatttgagtcatgtttgcttatgtagtgccgtttaaaattcccctagtaattacctttcatattttattaactaggttaacatcaactgtggttgtaagagtaaatgtttcaccttaagataaacatgggcaatatattaaactctagtctgttttcttgcctgtgaagtgaggctgcacttgattatatttgattctttgttcgtaatacatgggaacgacagctaagtgtggtgaaaaacgcggggatccaaagagctggatttttatctcagatctgccgctaacttttgtatcctataggctacttttatttctatggtctcaatctataacatgaatgggttgggttaaatgactgaagttccttcaagtgctaaaattctttttctacagtcttcattggatttatgtatttcttattcctaatatgtttaactgggatgtctgtcactctagggcggcaagacagacatttaaaagtaacagtcacactgctgaactggcatttctgttaacacaaaagtttagaaaactcacggtaactgttacttgatttaagtgtatataaaattttcagtaaggctgcttttaaaaggaaccactgtccatttaaaggtttcatagttatcttcaatgggttagtattgtttggggcaggacattaaactagaagggattctataggatgaggtgatacctagaaggtaatatattgtaaggcaaaagagattagaagaaatggggaaaggatagtaaaaggcaagtcagattaaaggttgaaacatgaagatattctcaattgtatttctgcctatgtttgcttttttggctcaagcatctgttggaagagacaaaatgtgacttggttcataataaagcaagaattatttactctcgga

SEQ ID NO: 4890 - DNA, 1604 bp, Homo sapiens
catatttagatataagcaggaccagaataacatacctagaacagatactgattttcttgcattcatgtaataatcatttaaaattcatatctgctttacgcgaatagatataaacatagagctaagtgctcctacaagatgaatttttagtaggctaaacagcacagctaaagtctcttatgaacctcatttccccaacatatctttcatctctctctctttttggtttgtttcttgtttgttaagctaatgggtgtattaattccatcccaatgtgactccaaattttgaaattataaggcccaaatgaattattttttctttgctcaaataggatacatacctcatctgaagacaattcaacatataacaaaagttaatgaacggcatttcactgcagtcacaaacccattaagcatcaaatccaggcgctgtgaacatcaaagaagtcaaactgggcaactggtctctcctgtgcaatgggaaaacctcctaatgaagggccatgactttattgttgacaccgattccacttcaaacttggcgtctgcaatctctgccagaagattttccgaggttgtttttaagtcataaagttaaataacatgaaatgttgtctccatagtaaaagatgctttcctaaaactgaagggcctctagccaaaagacctacagccaaaaagcagggtttggctgtggccatctctaagaaagaaatgtagtcagatgattcaaaggaaaatgggtaaacaaaaaaaaacaaagctgcaagtttaaaaagtcaatactcaggattgatgaaaggaaagtggccttggaacacacagaggtgaccgctccttcatgatgtgtgtgtgttttgatggaggccagtataattagggatattcatgatccctgtggtgctttggtgggaggtggaggaggacagtcagagacagatgtcttcccagtctccagtgctgagcagaggatttggtaaagcaaccggcagtggataaagtgtagaaagtacaaaactaactccagcccacaatagtcattcactttttgataccactgaaatgacgaagtcaaaagcaatcatgtttcccacttctagaaaaatattcaggtcacaatttgtaaatcttttgtttaatttataacaatgattagcagcatttaaaaatcaactttattgaggtttaatttgcatacaataaaatgtacccattttctgtgtggtctaaggagttttgacaaatgcaaacgcccatgtaaccaacacccaatcaagacacaagtatttccttcattccacgaaggtccctcaaggtcttttgctcccaaccctcacccccactctcacataaccattgaactaccatccatcactgcggattagttttacctcttctagaatgtcatagaaatggaatcaggcagtgtccagctaattttgttcctttgtgtctggctttcttgctcattgtgtatttcagacgcctgctccttttccttgataagggatatcccattgtgtgcatgacccacagtcttcacccagctacctaatgatgaatgtctgggttctttccagatcgaagctgtataaataaacc

SEQ ID NO: 4891 - DNA, 1113 bp, Homo sapiens
gttcaggaagctagaagtcctagattttggcagaattggttccttccgcgggctgtgggggaggatctgttccttgccgctcccagcttctgatggtttgctggcaatccttggtgtcccttggcctctgctgcatcaccccagtctctgccttcatcttcacatggtacttagcctatgtgcatgtctttgtgttcagatttcccctttttatatgtacaacaatcgaattagggggccaccctatgccaataagacctcatcttaattatatctgcaacaacctcattttccaaataagggcacattttgaggtactaggggctaggacttcaacatatgatttttggtggaagggacacaattcgacccataacaccatggaagcctctattctaactagtggaccacaaaggctttttaggtctcagcatttgtgctggcttagggccagtttccaagtaatccctaaaggcctgggcatttccatttccctaagcacacatgcatagttacatggcttaagatccctttggggaaaacgagaagatttatgatatagttatggtggtattgctgggtgcttcctccagagtaccctgcaccccctttttcaagggcttcagctctgagaattgtctgtaaatctccattttggtgactcaaaacaggcctctatttgccagacctgaagatttgttttgcgttctataagccaaatagaaccttggtaggtaacccatgtatttcatcactacagctctgttgccttggtactaccccttggccactggcactgcaggatcccatcatctctactgatatcagggattcctttacaatggtaacatctcttagcttcatttccagcctagggaaggtacacactacaaacttttcaagataaggtgtttcccttgtttaaagtacttttcaattccttgctgaaagaaataacctcttggcaattttgaagggcaaaattaggaggtgcagggaaatgtgtgaagtctggctgcagtgcccaagagataagaatcttctaagctggctgttgtccagacttgccatcctcattgtagtaaaacactggccaggaagacaaaagtgcat

SEQ ID NO: 4892 - DNA, 24616 bp, Homo sapiens
acaccgccctcggcaaacctcggctggctccggcctttctcctcctctgaggcctggatcttctcttcgcgaccagtctgccctttccttcttttcctcactcgcgagtcggccaccgccgttcccgtttagggatagtctcgctcgggcgcctgctcgaggctgatctcaggggctccgggctgcgcagggagggagccgccttccggaagaggacggtggggcgcgagggaagccatcgcggactaaataagggaggctgcagcggctgcgcgtgcgcccagaggcgcagcgggagggggtgctctcgggcgagctctccggccgcggcccccgcccctgcgctgtcgggcggggaggtcggaaaccccctggcgagaccacgggcggacgcttcccgaagagctgcctgggctgcagccgcggaagctgcgttctggggagcggggagcgtgctccggcgccttcgggccgctgctggaagccggaaccgagcccgggccgctgcccctcaccggacgccgcgcgccaccggccctccgcggggcaggggctgctgcgagctcgccgggcgccctttagacgtaagtctcaccctgcgccccgaggcaggaaggagcgcgtgcagtcccggccagaaacggctaataggaagggctgaggggttctgtgttcaaggcagaaggccgtgcgtcagggcggccctcagcggagatgcgtgcacggagcggggagcgccgctcggggcagggaatgaaagcggcgcttgagactggaaatttagggagatgagttccttgggaacaacgctgaaccatctcactgccccaccctaccccttgttatttttttttgagacaggtctcgcgctgtcgtccagtctgagtgcagtgacgcgatcacggctcactgcagcctcgacctccggggcttacgggtcatcccacctcagccctctaagtagctggcaccacgggcatgcaccaccacacccggctaattttttaaaaaaagtttttccggagatagggtctcgctgtgttacccaggctggtctcgaacccctggcctgaagcgatcctcccgcctcggcctcccaaagtgctgggattacaggcgtgagccactgcgctcggcttttcacccctttctaacgttttccatccccagcggtgccctgcccaccctctctttatctctcacttttccctcctctgtttcttcctcgctgaagtccattggtgaaagaaaattcatgtgaaagttctcaggtgtgttaagtgaaattgctacaaatttgattttatgtactgctgcaggtacattgagagaagaaacgtgaagtataccaaacaaccgttagttgagagtggtggtattcgggtgattggttgacttttttttttttttttgcactatttgtaaggcaacatagtttaatgaaaagaattgtggtaaacataattaggtgattaacacagaagaggcaaatagtaaacaagtcagaagaaacaaccccctccaaaaaataaaaagtaactgatttacttggtatccaagaagttacgttattgctagacctaatagaatggagagatggaatgatgtagggagaaaggctctgaaatcacaactggttggaaaaaaaattttaattacataatcttatttgtcacatccatctgccagatgtagagcttattgctgtttgtggagatgtgcagaccaataaaaagcctatttaatgctctcttaaactaccagtaactaaaaaaaaaaattgacagtgactgaaattatgaaaacaaaaaaattcggtagcatcttaacatgtaatttctgacatatttgtagtgaatccattgaagacaaacatcagaggagtacaacaaataacatttcatagaaactttgaaaactggcagcaaaattactactaatttgtttgataactagatgtctgctgaaattggtataaaccatttgctcaaaagtagccaggcatggtgatgcatgcctgtattcctagctactcccagaggctgaagctgaacaatcactttagtccaggagttcgagactgcagtgagtcatgatcacaccagtgcactccagcctggacgacagagggagaccctgtctcaaaaagtaaataggccggatgcagtgggtcatgcctgtaatcccagcaccttgggaggccaagtcaggtggatcattttgaggtctggagtttgagactagcctggccaacattttgaaaccccatctgtactaaaaatataaaagttagccaggtgtggtggtgtgcgcctgtaatcccagttattcgggagactgaggcaggagaatcacttgggcctgggaggcggaggttgtggtgagccaagatcttgccactgcactccagtctgggtgacagtgagacactgtctctaaataaaaccacattatcaaaagtctgatctgctctcctttacagaaatactttatctttacttctctctcgaacccacagacttcattcccacacttctggacctgttcaagatcatctgtagcatccatgttttcaagtctgatttttatttctcagtcttcatctccacttgtcagcagcatttgacacagctgataactttcttctccttaaagttccttatcttgcctaccaggatttcattttctttcttgcttctcttccttcccaaatggctgttccttagactccttactggtttctccttcttttccagcctctaaatgctggagtggcgtgagattcaaatcttacaacccgcactcctctgttctctctccctaggcaatctcattcagatctctggctggatgaaacccacatttgaatttccagtccacacctttcctctgaacacaagactcacacttaactgcctactgtatagcactgcttgagtttctaacaggcatcacaaacttaatgtattcaaaacgaaactcttaatctccccccaccccaaacaagtcctgctgagatcttcccaatctcttgaaatgacaactccattcttctagtggaggctaaaaactttggagtcatctttgattgttttatatctcacattgactccatcaacaaattttgccagcattaccttcaaaatgtatccacaatctgatctctgtaacccacctccagcaagttcactctggtccaagccaccatcattaaacctggaccgtggcaaaggctttctaactgatcttgcccttctatgcctgcttccacattgtttgctgtctcatacagtgcagtaatcccttaaaaagtcagataatattccaatcttgaataaaagccaaagttatagccatgatccactaggccatatgtaaactgcctgttacttctggcttcttatccactgacttctttatttgctctttttttgtttttgtttttgtttttgtttgagactgattctcactgtcgccaggctggagtgcagtgggatgatcttggctcactgcaacctctgcctcccaggttcaagcaatgctcctgcctcagcctcctgagtagctgggactacaggcacgtgccaccacacccagctaatttttgtatttttagtagagacggggtttcaccatgttggccaggatggtctccatctcttgacctcgtgatccacccacctcagcctcccaaagtgctgggattacaggcgtgagccaccgcgctcagccctgctttctcattcttttcccaccattctaccctccctccctgttttctccagtataccaagcatgcctctgcctcaggacctttgcactgctgtccctttgcctggaatcctcttcccccttagtacttgcttggctcacaccctcacttcttcaggtctctgcttaagtcttgtcttgtttaattgagaactctacatgatggcgccctaccaccatgttgctcccttaaccctgatctatttttcctaaaccatttgccatatattttgtttattggttgtttcccactagaatgaatgcttcatgtggcataccataaatatttgttgaattaaaggatatttgcctgcagaaacgtatacgataaaaatagcaaaattgaattctcaagaggaaaaagcttgggttctatttctgtttgctttgtgaaagaataaaagaattacaaatccagtcctgttctcacaaataagatggaggataaagctagattattcctaatacaggcaaaatattgtaatagatattaaaaaatgtacatgaatttgcatgtatagcaaatcttaaagcagattatttacactgctatctaatgagaaatatcaagtttgcaaatgagtaaaagacccatatttcaacctgtagactgaatacataccaaccaatagaggggaaaaactatcaactcataggttatatataggttgaccaagattttaatgtgattctattgaaggaagaactgaaggaagaaccaaaaagtgaaatcctcaagcctctagttgtgaaagggattttttttttttttttgagacagagtctgactctatagccaggctggagtgcagtggtgtgatctcagctccctgcagcctccacctcccgggttcaagcgattctcctgcctcagcctcccaagtagctgggactatgggtgcgtgccaccacacccagctaatctttgtgtttttagtagatggggtttcaccatgttggccaggatggtctcgatctcttgaccttgtgacctgccacctccgcctcccaaagtgctgggattacaggcgtgaaccaccacgcctggccaaaagggactttaaaaagctttgttgcaatttctaaaacatcataaggatatatttccaaaaattttcacatacttcatttctatctcttttttctctgtccttgccttcctcacaaactcagcctagtatagtgattaaaagcgtgggttttagaatcagtatgacattgcgtagagctcaggctacattattgactaccaacatcaccttgggcaaattactagtcttgaggattatcctgctttgtctctaaacttcacttaatagggtatagtactgtttgtgaaaagtaattgaaattgtgtaaataatttagcagtacctggcacatacatgtttcgctactggtggttattcattttgaaaaaatagtattgaagttctgcgtatcaagtcttaggaacatagtgttaagcaaagtcacttgggttttgctcttatggagtttgtattttaagaataatacataactaaaaggagatgctttgggatctcagatttgtgatatgaagctttcattcaattatgacgaaaaataagaaactgcaacaaaaattactatctaggaaaggggagtaaacaccaggacgtcaccatatcaacatatggtactaggcagggatgatgtaaataatgcaatcaacagatcttgggagaattacttactgactcaagattggccattttttaaagttcttccaagtaatagatactaaagttcagctaatattgagaagcataccctaaaccctttacctgtgtctggcgaaacttcaacctgagttaatccaaccattcattttctgagcacctctgagcagttgcatgctgctgaagattataaaataatagaatatactgattccacttaagcctcatcatcaccaaaatcaaatgacatagtaatttagaaagtaataagtgctacagagaacagtaggtaaagtgttggatggaggagtaatgttttcaagtagagtggttattgagcacatggcgtttgagcaaagatttgaaggtgatgaggtagcaagctatacaggtgtctggaaaggaatgtttctggcaaaggggacagcaagagcaaaggtcctgaggaaagactgcctaatgtgttcagaaataataaggaaagctctgtgattgaagggcagtgactgagagggaaaatattaggaaatgaggtgaggttaaagaagtgggtggaggaacagactgtgaagaatcttataggccattataagaagattggcttttattctgagttaattgggaagccattgaaaagttatgagcagaaaatgacatggctactgtgttgaaaatatctgtattgcaaggcaaggagcagggaaaccagttaggatcctacagcattgcctaagtgcttcaggttactgtttcaaagcggaaagtaagcttctcatctaaggccattttctctatctgtcctttcttgccacccccccttcagttcaccttatattatcaattatcccttcctttgtatattcaaactctctttcatctggattatttccactgatctttaaacataataaatcctaccaccagaaaaccctttcttgaccgtatactcttaactgctcacttcagccaaacatctgctaagtcttatttgtggtacctcacttgtttcattctttactctcgtattgacattttaggtcactattgtttgacatctgcccccgtaatattagcaaaatagatttccctgaggcagtagttcttaaagaggcagtgctgagtctccagggggcatttggaaatgtgtggcagtattttttttttttatcactgctatattttcagtatgacttaagggtgaagggtgctacagatatttagttaccagaagtcaaagatgctaaacatgtagcaatgcgtaggacagttctttatatttaagacttgtcctgctcaaaataccaatgttgtctcatttagaaatagtgttaaggtcacaggtcacaaacaacttctttgcacctatgtttaatgaacatttttttcactctttcttaatctcagaatatttgacattgatagtgcctccctttgcgttgcccttctctctcgccttctatggcacaacacattttgtattttcttcttccttctctgactgctcctctcattacttttcacagagtcgtccttgtctactccactaccaaatgttgaagttcttcaagaatcagtcctttggaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcaaaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaaaaaaaaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcgtggtggtgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacctttctcagatacctgtgcatcttatgggttttgtttttctctttgagacagtctcaccctgttgcccaggctggagtgcagtggcatggtctcagctcattgcagcctccgcctcctgggttcaggtggttctgcctcagccccttgatcggctgggattgcatgcatgtgccaccatgcccggctcatttttgtatttttagtggagatggagacagagtttcaccatgttggccgggctggtcttgggctcctgacctcaggtgatccgcaagcctgggcctcccggggtgctgggattacacgcgtgggcaactgcgcccagcccttgtgtaccttatgtgaggaagtcctgctcaatcaggatcggtcacgcaggccctgatcttgctactctggttccatgtcctatggaagaccaaagtttaccaagatagatttttcccttcatagtggcagatactgttaacccctgcaccatctataactcagaaatccccaccatttcttcccctgggcttcagaatagaattgcctggtttctctgatgatcagcacacttccttaaaacccaaatcagcaaggaatgaacaattttgtttggcatggatgaaattagcactgtttggctcggtaggccccagacaggcaggcaccttaattttttccttgcatattctagtcttcagaagcattgccttttgtcctactggtagtgacatagatcaataacagggcatctggggattttaatcctgaaaacagtgagtctgatactgcttgtgtttttcatcagtgtccaccccgagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacgtgccagcttaggctgggcgcggtggctcacgcctgtagtcccagcacttcgggaggctggggcaggcggatcacctgaggtcaggagttcgggaccggcctgaccaacgtggagaaattctgtccctactaaaaatgcaaaattggccgggtgtggtggtgcatgcctgtaatcccagctacttgggaggctgaggcaagagaattgcttgaacccagggaggcggaggttgcagtgagccgagatcacgccattgcattccagcttgggcaacaaaagcaaaactctgtctcaaaaaaaaaaaaaagtgccagcgtatgaggtaattagattggttctctccagaggtaacctgccaagaagagatgctatagatgttactcatatactgtaaaacattgtgaaatcagattactttaaaatgatgtattacaaagttttgcaaaaaagcagttgtgactgtggaagcccaaggcttatatcccagctctgtcttacactaaatatgggtagagtgtttccactctgtccataaaatgggagctaatattctccaacctgtgtgcctgacatgatggttaaaaggattaaacaaaacaatagtttgtaatttattctgtcagagcacactgctggtaaataaaagggagtaagttgactaaaactaaatttaaaaaaaaatcctaataaaacaagtttgtaatttataattgtatacaaataaaagatgttacaaaaaaaaaaaagacccacaccaagacacatcataattaaaccgtcaaaagtcaatgacaatcctgcaagcagcaagagagaagcaattcctcacgtacaaaggattctcaataagattaatagctgacttctcattagaaaccacagaggccaggaggcagaggcagtgggatgatatattcgaagtgctgaaagaaaaaactgtcaagaattctgtgtccagcaaaactatccttcaaaaaaaaaaaaaaaaagtgaaggagaaattaagacattcacagataagcaaaaacagaaagagtatctcactagtagtcctgccttacaagaaatactaaaaggatccttcagcctgaaatgaaaagacactagacagtgattcagatccacatgaggaaataaaaaacactgaaaaagatttaaatacataggtagatataaatgaaagcaataattatatctgtgtcaaagcacaatgtataaaggtgattcatgatgaggaaaagatgaagtataggagcaaaaattttgtgtactattgaaactaagttggtatttatttgaaatagattgttataaatgaaagttaattgtaatccctagagcaactactaagaaaataactaaaaattttggaaagggaataaaaatggtatgctagaaaatatctaatacaaaaaaggcataagggaggaattgaggaagacatagggaaaacaaatagcaaggggcaatgtccttcctactaattacattaaatgtgaatgccttaaattccatttaacagatggagagattggcagaatggagtcttttaaatgttctaactatatcctgtttacagaagactgactttagaaccaaagacacaaacatgttgaaagtgaaagggtgtcaccttagttttctttctttttttttttttttgagatggagtttcactctttttgcccaggctggaatgcaatggcgtgcttggctcaccacaacctccgcctcctgggtccaagcaattctcctgcctcagcctcctgagtagctgggattacaggcatgcgccaccacgcccagctaattttgtattttttagtagagatggggtttctccatgttggccaggctggtcttgaactcccaacctcaggtgatctgcccgcctcggcctcccaaagtgctggggttacaggctgagccaccgcgcccggccagcaccttagttttcttgtgctgccgtaacagaatacctgagactgggtaatttatatagagcagaaatttattttctcacagttttggaatctgagaaactcaaaattacgacattggcaggtttggttgtctggtaagagctgctttctgcttccaagatgacaccttattgctgcatcttctataggggaggaatgttacatcctcaacgtggcagaaggtaaaagggcaaaaaggaatgaaattcctcatcaggccctaagttaagggcacctaatctcattcatgaggggaggagccctcaagacttaaccacctcttactggctgggcgcagtggctcacgcctgtaatcccagcactttggaaggccgaggcgggtggatcacaaggtcaggagatagagaccatcctggtcctagtagagacacggtgaaacgcggtctttactaaaaatacaaaaacaagattagccggccgtgctggcgggcgcctgtagtcccagctacttgggaggctgagatgggagaatggcgtgaacctgggaggcggagcttgcagtaagccgagattgcgccactgcactccagcctgggcgacagagcaagactccgcctcaaaaaaaaaaaaaaaaaaaagacttaaccacctcttaaaagtcccacctcttaataccatcatgttggccattaagtttaaatatctgaattttggagggcacacattcaaaccatagcaagtggaaaaagacattccaagatatctcaggttcacatggaacattcttcagaataaaacatgttagtccacaagtctcagttttaaaagattgaattacaaagtgccttctctgactacaatggaataaaactgaaaataacacacccttaaacaaccaatggatcaaagaaagattaaatcacaagagaaatcagaaaatactttgagatgaataaaaacaaaaatgcagcaccctaaaacgtttggaatgcagcaaaagcagtgctcaaaggcaattttatagctgcacatgcctacattaaaaaatacctagaatcagcaacctaaccttccaccttcaggaactagaaaaagaagaggaaatcaaacccaaagctagcagaaggaaggaaatagtaaagactggagtagagataaatgaaatatacagtagaaaatagaatccacaaaaccaaaatttggttgtttgaaataataatgttcacaaacccttaaaaagactgagcaagacaaaaagattcaggttactaaaatcaggaataaagtggggacattactgccaatcttacagaaataaaaaggattgtaaggaaatactattaacaattatatgctaacaaattagataacctagataaaatggacaaattcctagcagcacacaaactaccaaaactaactcaagaaaaaactaaacctataacagtactagttaaaaaaaaaaaaagtaaaccagttaaaaacaaaaaacttccaagataggaaagatcaaaccatgtggctttactggtgacgtaaagtattttaagagtgccagtccttctcaaacacttaaagtaggggaagagggaatatcttaactcattatatgatgccggcgttaccctggtaccaaatccagacaaagacatcacaagaaaataaaactacagtccaatagttctaatgaatatagatgcaaagatcctcagccaaagtgaatcctgaagcacattacaaggatatccacaaacaaaactgttagagctaatacctcaatatcacaggatgcccaggatcaacatacaaaaattagttatatttctgtatccttgcaatgaacatttcaaagtgaaatgaagaaaactcatttacagtagtatcaaaaagaataaaatactaataaacaagatgtaagacttacacactgagaactacaaaacatagttgagagaaatttaaaaagacctaaataaataggcattttatgttcacgtattagaagactttgaaaatggcaatactcccccaattaaccaacagaatcagtgaaattcctatgaaaattccaactgccattaatgtagaaatgggcaggttgatcctaaaattcataagaaattgcaaggatgtggccaggcgcggtggttcaacgtctgtaattccagcactttgggaggctgaggcgggcggatcacgaggtcaggagatagataccattctgggtaacacggttaaaccccgtctctactaaaaataaaaaaaaaaaaagtgtagccgggcaggtggtgggcgcctgtagtcccagctactggggaggctgaggcagaagaatggcatgaacccaggaggcagagtttgcaatgagccgagatcgcgccactgcactccagactgggtgagagagctagactccatctcgaaagaaaaaagaaaatgaaaaaaagaaattgcaaggatgccaaaacagtcttggaaaagaacaaagttagaagacccacattttgtgatttcaaaatttaccacgaagctacagtaatcaaaagagtgtggtactgacataaggatagatatgtaggccaagaaaacagaattgagagcccagaagtaagcctatacatctgtggtcaattgatttttgacaaaggtgtcaagatagatcactggggaatagaatagtatttttaagaaatgctgaggatactgggtatccacatgtaatagaatggatttggacccttaccttacaccacatgcaaacattaagtcaaaataaatcaaatacctaaatataagaatgaaactatacaactattaaaagaaaatattggggtaagtctacatgacctgggatttcccagtggattcttagatatgataccaagaactcaagtagcaacatgaaaaatagatacaactgggcttgatcaaaatttaaaactttacatatcaaatgacactatcaagaaagagaaaagagaacccactgagtgagagaaaatatttgcaagtcgtatacctggtaaagctcaaataactcttacaagtcatcagttaaaagacgacccaagttaaaaatgggcaaaggacttgaatagacatttctccaagggagatattctaatggccaagtacatgaagagatgctttgcatcataaccttccaccttaagggaaatgcaaatcaaaaccacgatgagataccactttctatactcactagggtgctattattaaaagacaagtgttggcaaggatgtggagaaattggaaagctcataaattgctggcggaaatataaaatggtgcgttcattataaaatagtttgatggtttatcaaaattttaaacggaattaacatataacccagcagctctcctaaatatatactcaagaggatagaaaactaatcaaacaaaaacttctgcatgagtgtgtatagcagcactataatagccaataagtagaaacaacccaaatgttcatcaatagatgaatggacaaattgtggtatattcatataatgaaaaactactcagccataaaaagaaattaggtactagtatatgttgcaacatggatcaaccttgaaagaccttgctaactgaaagaaaaggccacatcttacatgattgtatttatgtgaaacatctagaagaggcacatccatagagacagaaaacattggtggatgctaggggttagggaaatgtagaagtggggagttgctgcttaatgggtttcttttttgagtgatgaaaatattcagatttaggtagtggtgatacttgcaaacattgtgaatgtactggaaggcactgaattgtacagtaaaatggttaaaatggtgagttttatgtcatgtgaattttaccccaataatacctcaataataattttttaaaagtagcccctctcttagtccattttgtgctgctctaacagaatacccgaaactttataaagaacaaacgttggccgggcactgtggctcacgtctgtaatcccagcactttgggaggccgaggtgggcagatcacgaggtcaggaattaagaccagcctagccaacatggtgaaaccccgtctctactaaaaataacaaaaactagctgggcgtggtagcacatgcctgtaatcccagctacttgggaggctgaggcaggagaattgcttaaacccgggaggtgggggttgcagtgagctgcgatcacgccattgcactccagcctgggcaacagagcaagagattcttgtctaaaaaaaaaaaaaaggaactatattggcccacatttctggcagttgagaagtcctagatgaaggggccacatctagtgagggccttcttactgcatcgtaacggtggaaggcatcacatgatgagagagagagcaagaaaaggtgcttttgttacaagcccattccattataatgaacccactcccatgataacaagctattcatgaggacagagccatcatgacctattctctaattaggccctacctcccgacactgttgcattgaagattaattttccaacacaagaactttgggggacacaatccatagcagtccctctcttcactaatttctttccatgaattcttccactcccctgacttttgtgtgtagttaccatctatacacagatgcttcactagaggcagtttgtatctccaacccacatcttttttttgagttccagatgtgaatatcctgctgtttacttacctaccacctccacacatagcttcaaatgcaactttgaaatataaaactgagttcattaccttttctcctaaatttgattatctgtgaatgctttctgtctcactaaagatagcttccagtcattgagagtttgctgtatgtttggactaaagtgttaatccattaatttacttaatcctcacaagaacctcagataatactattttccatttgcagtgagaaagttgaaaggtaaaataacttattgaaatcacacaccttttaaggaaaggctagccctcaacaaaggcagcctgacttttcagagcctatgttcttaatgccattgctataccatcctctaactttttctagagacctagaagtcatctttgtcacttctctcctttacatgctttatcaagttgatcatgaggtcctattgatttgacttcctaaataactctcactccatccagttcatttcatctgctaccaccagccttattcaagcaaccatcttttgtctatacaatggcctcttaactaacctcccatattcactgacaacaacctaataaaaatatttataaatataaatttgtatcttacaggtagggaatttatattcttctcttattatgcccaaggaatatttccaaatattaatcataagattgatcacctagaaaaccttagtgaatcatgaaaagtagaaatcttaagagctgcttttcagatgatagtgcaataaaacctaaagtcaacaaaggttgtttttgtttcttgatgattttaactgttggtttactatcagtctctccaacactcctgccttaattcttggtgattttaatatgcacatcaatgatctttccaatatcttgacctccagcttcttggacacctcttttcattccacttcagccactcctttggtcattccctagttagatctgcttattaccattaactgcaaactcaattatctcaacttcatgcatccacctttctggctgccacatcctgtctttccagctttcccctctagatccctagctcctcataattatttatctttgttggtaattctaatctattgattctatcactgtttcactgcccctcacccttattttcctcctcacttggcttaaattccatagccagtcattgattggatattccttttacccactgacaaaaccgtaaccctaatcattacttatctactccattcttgctcccatgtagctgaacatgactggaagaaaaatgcaagagtttcactttaaattcttgaagacaaacctcatgtgacctcaaaatgctgccagtcaatcaaattatattttctccaagtttattcacttgtagtcagcttgggctgctacaataaaatatcataaagtaggtagcttgtaaacaacagattgtcttccttctggttctggaggctgggaaattcatgatcaaggcaccagcagatttagtgtctgttgaagtccagctttgtggttcatggatggtgacttctcactgtgagaagatatggtggaaggaaagaggggtcctttcttgagcctcttttataaggacactaatctcaatcatgaggaccaccccccataacctaatcaccctccaaacgtgattaggccttccaataccatcaccttgtgggttaggatttcaacatacgaattttgaagggacacaaacattcagagcatagcacccccttttcctgaaatgattttatgtaatgattttatgtaattgtctcttctcgaatatccaacactctattcccagtcttaccctcgatgataactcttgttcctatttcctggagaaaatcagagcaatcagaagagatcccctgccactaaatctatccttctagcagcttgtgaactcatataattttctttccagcctgttaccatacatatatgcatgatgtccatgctctcatctaaaatcagcctctgcttgtgtactagatcagggttgacaaaatgcagcctgtggcccaaatcctgcattttgttttgtttttgtacagcccgtaagccaagaatagtttttacttttttttttttttttttttttttgagacagtcttactctgttacccaggctggagtgcagtggcacaatcttggctcactgcaacctccacctcccgggttcaagcgattcttctgcctcagcctcccaagtagctgggactagaggcacccgccaccaggcctggctaatctttgtattttttagtagagatggggtttcactatgttggccaggctagtcttgaactcctgaccttgtgatccacccacctcaggctcccaaagtgctgggattgcaggcatgagccactgcgcccggctagttttttacaattttaagtgttggggagaaaaaagtatatacagcagagaccatgtgtgatccacaaagcctaaaatatttactggctctttccaaaaaaattttactgattcctgtactagatcacattctctcacacctacttgatagtaacacagcaattcttccttctctcttctacattaaccagtgtttgccctcattcaagattacttccactagcattcaagcattctgttatttctcccatctttaaacaaaccgaaaaaatctcgatactacttttcttgccagttactgtcctgtttctttgctccccttcgcaacacagcaccttgatttttatttttattttattttattttgaaacaggaccttctagcatgctgtataatttatgtattatgtttattgtctagctcctgccccctaatggaggcttcataaggataaaaatcagaatctctttcgctctgtgatatattccaagcacatggctcatagttgatacttcatagatatttgtagaataaataaaaatgaatttaaaaacttcccaattctttaaaaacactacaaaataattactggattatagcagaagtcaaatttgagattacaagttgtatacaaattggaaaactggaacacttcatatgaatatgtatgggaagtgaatcaaacctaagcccagagaagaattcatagctttaaaggaatataatgccaaacaaaataattcttactgtgatcagagctcttactaataatgttctctctatcatcacttcctgcatcaatctcctagcaaagctactgggctttctctcccaaagttattacattagaagacggttctcaatatgtagttgctgggctaacaccatcaacttcacctgagaacttgttagaaatgcaaattgttttaataagcccaccaactgatttcaatacacacgattgtttgagaatattgcattagactcaggaagcttatttcttagtgcctttttcttttctcacataaaagaatagagtctgctgttgattcaaacactgtcttgcttagggaggcaaatttaatggatcagacagggttaatagataatcgtttctcccgtgttagccaatatacagttatctttagggccaggcacggtggctcacgcctgtaatcccagtactttgggggggccgaggcaggcggatcaggagttcaagaacagcctggccaacatggtgagaccccatctctactaaaaatacaaaaattagctaggcgtggtggtgtgtgcctgcagtcccacctacttgggaggctgaggcaggagaatcgcttgaacccaggaggcggaggttgcagtgagctgagattgtacaactgcactctagcctgggcgatagagtgagactacttctcaaaaaaaaaaaaaaatgcattctggatgcattttgttcaccatgtataccttgagtatcattaccttaacttctatttttaagatgaaccaaaacaaaaatattgtgttgaagtcataatcataggcttgtatcagccttacagtttttatcctgaggttcataatcacaaacaaatttttgtagaaaatcctgtttaatatccacgaatatgttttaaaagaaatatcaagacatattcagaacatcttaagaatttacagaagggtgctcttgggcaacctactttctcagcatgaggaagctttctctctcttcttttttgtctattaaactttccactcctaaactaaaaaaaaaaaaaaaagaatttacagaagagcgtaaaataatttgactgagtcaaaaaaccatttaatttcctggttagaataacttaatagtgtaaagataacttctttacactattaatatatacatgtaatgcaataatttcaatcgtaatcacaactttggagaaatgagggtagtatttggtaagttgattctaaaatttatcctgagaaattaattcatggaaaaatttaaaatcatgaggaagaagaagaatgtgggaataccatacattaaaatgtactgtaagtctagagtcattttaaatgtatgttatagctactggaagagacaaatactacatgaatcaaaatacttcaaaaatacctccatatggccatgagaattgaatgaattataaaggaggcattttcaatcagtagcaaattgatggaatatttaagaaataatgttggaacatgtatctactcattctgaagaaaaagttaaatctctacattgtactccgaaataagttcttaatgtattaaatacctaaatgttaaaaaataaagtatgaaagcgctaaaataatatatagaattgttttaatctaggtatcaacagaacatgaaacccagaagccacagagaaaaacactgatagatttgacacatacaaatttataacttctttatgatgaaaaatataaataaagttaaaagttaggttatggatttggagaaaataattacaatacataaaagaatcaagaagttaatccatatactatacaaagaactcccaaaattagtaaaaataccaactcaacaaaaagtagatagaatatattaacatatagatgagtcagaaaaggaaatacagatggccagtaataaatgtttaatctcatatataaagtaagaaatacaaataacattgaactttcagtgtaaggctagactgagcacccatatgtacctctctttcaaggtcttactttatttttctaatttcactgttacatacccttatgtgtatcacctcattattaccatcactctacaaataaggaaactgggacataaagtagttaaatcatttggccaaagtcaaacaggtaataaaagcggcagagctggggtgtgcactcagcatttggactgcaggatctaccctctaacccaccatactatgctacctctaaatgaattaaagcaggtctgggagtggccaagacactttcagagaagatctacgaagttaaaacttttcgtaataatagcaaaacataatttggcttttccactccttcatgagtgtggcagtgtcattttccagaggcttcatgacatgtaatgttgcaaaagattaaatgcagaagcagatacgagaattcagctgatttccattaagtctcatcttaaaagagatttacaaaaaagtaaacaaagccactcttgttcggaaatatgtaacttttcatgaaaatatttataacgtaattagtttattttaaatgaatttatagttttaaatttctcacttttaatttctaattggtaaatataaatagataaaacccacataaacaaaagctctttgtattcctcaataatttttaaggatgcaaagggatcttgaggccacaaagtttgagaactactgaattaaacaattacctccagtcaactgacagctgagccagttaggcctctatcccccttcactcacaaatacagagggaaccctctgggaatctgtggcttttcccccaggaataaaatctcaagaggtcttatgtaggctacagcaaagtatggtaaggaaaaacatttgagatggtaccatgtcactatcagctgttctctacttcctgggcacaaacttttgcacaagtgcaaactgtctattgaatagcacctctgttcactaaatggccccactgtggcatgctagcagatgctctctgttagggaaagggacgtgcttatctagtatcaacagtaagaaatctcctagatgacaaaggagtgactgatgtttgtaatctgttgtgcctgaaaaggcacctgattctggttttccatttacaatactgcagtggctcacttctgtaatcccagcactttgggaggccgaggcaggcagattgcctgaggtcaggagttcaagaccagccttcccaacatggtgaaaccctgtctctactaaaaatacaaacaattagccgggcgtggtgccgggcgcctgtaatcccagctacttgggaggctggggcaggacaattgcttgaacccgggaggcagaggttgcagtgagccaagatcgagccactacactccagactgggcgacaagagtgaaactccgtctcaaaataaataaataaataaataaaaagtttccttttaaaataaatttagtggccaggcgtggtggctcatgtctgtaatcccagcactttgggaggccgaggcaggaggatcacctgaggtcaggagttcgagaccagtctagccaacgtggcgaaaccccgtctctattaaaaatacaaaaattagccaggcatggtggtttgcgcctgtaatctcagctactcaggaggctgaggcatgagaatcacttgaacccaggaggcggaggttgcagtgagccgagatcgtgtcactgcactccagcctaggtgacacactgagactccatctcaaaaataaaataataaatttaattttcaaaattgagttgatttaaagaaaagtgttaagaaaatgttacatatgtaaagatggcaaaaattgttaagtgaaggaagtttgagaaacattgctagaaagcaaatcattagtctgtctcgggtgggtctttgatgtagtagttaggggtctgagaaaaatggggcagacacgaggtaactccagacccccacgctaagggagataagaagcaaagtgaaagggcaactctgcctgagagtgaaagattgaaactctgcaccctggcattctctggtctgtacttgttccttccccagtaaatctgcttactggtatgtttcactcacacaaagcttgtgttcacccctctgtgtcttctactgctactcagtcttcattggagacctaattttcccttaaaactctttatgattggccaggcgcggtggctcacgcctgtaatcccagcactttgggacaccgaggcgggtggatcacgaggtcaggggttcgagaccagcctaaccaacatggtgaaatcccttctctactaaaaatacaaaaattagctgagcatggtggcaggcgccttaatcccagcaactcaggaggctgaggcatgagaattgcttgaacctgggaggtggagtttgcagtgagtcgagatcgtgccactgcactccagcctgggcgacagagcgaaactccgtctcaaacgaaacaaaacaaaaaaacactttatgattggccaggcgcggtggctcatgcctgtaatcccagcactttgggaggctgaggcaggcggatcacgaggtcatgagatcaagaccatcctggctaacacggtgaaacccca

SEQ ID NO: 4893 - DNA, 3040 bp, Homo sapiens
tcatgagaaacacctccatgatccaatcacctcccaccaggccccacctccaacattagagattacaattcaacatgagatttgggcggggacacagatccaatccatatcaggcatctaactcccacacctgtggctggagcccatgccactcacctctcctactcaaaactagattgcaaattcccatccagagactctccaaatcagtgactgcaacccatgcttgttggcaggttcttatacaacccactatgagttagcatcaaaaatggctttctcctatcagcacccatgtttgggagtgtgtgtggggtacttcccagtgccgttccttctcatggtctcctgactgctccctgagtcagatcagggcttggtaaagtcaagaagctcctccatggcctggattgcctggctgtccagtgggaatgtgtatcacagagacagtttctccccgtctcacacactgaggattcactcacagtttcccaccagatccaccccgcaggctgctgcttgccttatttttcagagtatccaaagtttctttcacttttatgttgaactcccgtgttctttcttggataaaatttcacagtatgaatctctacacattattttgccttttccaaatgcatgaggcaagctggcaaagccactattctgctatgttggggagaaaaacagaaatggttgtcttaatagatacatgctttaaaattaatctaagctagatgtagttttcaatgaactaatgtatattgagtgtctattatatatggaatccagagaagactgtttctttgtatttttttttgttttatagtactatgattcatttgaaacctattatcagccttatgaccataccaagttgtgccagtcatttaaaatttttagtttttcattattcaacatacattgatatacagccttacatgcatgtctatgagaaagtggtaggagaaagctctcagctgatttttgtgcaactgaatgaccattaatgcttggcaatcttcccaactgaatctgactcaagtagaaatagttaacattaatcaaaagagattaattacctgccaccagtcttttgaaacagtctgtcctgagaaaaagagaattcgatgatatgtaaatccatgttctttgggaatgcttatttctccttttcttgggatacagaagaagagacagactcagatacaaacctcaatacctgaaatcattagctttggtcttggtgggatcaaaaccaaaaaataaaagctattaatatgtgattgaatacacaaacacacgtgcgtgcacacacacacacacacatttattataaggaattggcatatgtgattatggcaactgggaagtccaagaatctgcaatgtggtctggcaggctcaagacccaagagagctgatggtgcagttccagtctcacagaagtctgctggagaatttcctctggcttggagaaggtggtcttttcattctactcaggtcttctattgattggataaagtgcacatacatcatggagggcaatcttctttactcagaggacatcagtgtcaatgttattcccatccagaaacaccttccaagttgacacataaaattaacaatacacttttcctcatctcacccaaatttaggttaagagttctggatacctgaattaatattgccattggaatgccacttttacttttggagaaaaattagaaataacattttataaaattaaaaaactgtaggctaggcacactggtttacacctataatcccagcacttttggaggccaaggcaggaggatcccttgagcccaggagttcaagtctagcctgggcaacataaggagatcctgtctctacaaaaaaaaaaaaacaaaaaaactgtagctaggcatggtggcatgtgcttgtagtctcagatactcagaaggctgaggtaggaggatcccttgagcccaggagttcaaggctgcagtgagctgtgattataccatggcactccagcatgggtgacagagcaagactttatctcaaaaagaaaaaaaaatactgtgtttctggtttgcaattatactgagtattccagatatgaagtgaccagctcatagcacttgcaacaagattattctcttctgtagtctggttgctatatttctaataatgtgactcaagatttcattcattttacctctggacttatcactctttgaactttacggtttatcactaggtctttttctctaaatgagctattgttaggccagttttcttcttcctcttgcaatcctgtttttcagtggttgatggcatttaacctaacgtggattttcacataacaattgctattttaaaatgttattagttacttaacccatatgatttatcttagaaccacagaacctcagagctaaaatgaacattttataataacaaaccgggtccaaaataaatgacttacatagatttataaggtaattaatgacagagctgagtcaaggattcatgtttcttgatgcctagtttagtagtctttgatgcaacagacatcaagtacatattatatctagaagtaatgtattaaagataatcttttggcttaaatcattttagaatgtgtaacatccttgtaatacaagtcattacccatttcaactagagaagaagatatatagaaatatcaaatgttaacaaggtaataggccattgcttttgtgtaattcaaaatttgataatgattttgttctttgccctagttattgataaaattcttaaagtgaacattgccctactgcctatttctaggtgctgttccctttaataagtatattttgaacatcatttgtttaaccctgttttaaccaattagaaatctatctacttgaattatgttcattctcttccctatgtattctttttgagtaacaaaatgagattattttaatatgactagaaaggaaatatatcttaatatgagggtgtacaaacttttgttgtcttaaataaagattgacatgtcaaatctg

SEQ ID NO: 4894 - DNA, 2505 bp, Homo sapiens
atatcttggttagccaccactcctctgtgcaccataactcactgagcttcctccatcatggtgcctttcacaccatttgataatgtgtgtgtgtttgtgtgtgtgtgtgtgtgtgtgtgtattcatctgcataccccactgggctgtattgttttcatgtgtgacttgcttgcccttttaagtccagcacctagaggagataggtgctggccccaatatgcattttcaacaagtatttttgaataaattgagatatcaatttcccctaattttaggtgaggagtgtacctgatacatatacactagcctcattatagtttgtatagataactttgtcttttaatctgtgccatttgcaattttgagatacttattaacttctctttgctacttcttcctttgccatttgcatctttcatttcagaattatacaatgtccaggttttttctttctacagtataaagctctgaactcctgattaatctttcaatatgttgaataacatacacacacatacgggcacacacgtacagcctttatgtttggtttctttctttgaatgccgtttgttaaatagttcctttggtagtaatccctctggctttaggtaaagccagttcaaagcatttttagagcctggcaatttgtagctctctttaaaatatcttttcatctctccaactccgtgcttcttaatctgtactagaaaccaagcatttgaaagaaactaatatcacctgcattgtggctgcttctttgcctttctgcctcccacttgttactgtagtttattcatctttatttttccagcatctagtccatgcctggagcactaggcatgctatcactgcttgttaaattagaatttggaaaactacctagtgcaaatatgtttcccactgctagtagaccacccatatcggtagctatctggcctagttagctgacatggccaataaggctgccatagaggtataactttgtctttaaagtatttattcatttctgtttctcttgtggacttccaatacatgtagaaaacagggacattgaaaactgaaacagttgggggaagattgaagggatgtgggtgtggttataaaaggttaacacaagaaatttttgtggcattgaaactgctcaatatctttattgtggtgataaaattgtaaataatagacactcacacaaataccatgaatacaagtaaaactagggatatatgaataagattgggggattgaatcaatatccatatcctagttataatattgtattacaattttgcaaaatgttactgatagcaacaggagacagacaaattctgtcagatagacagacagggacagtcctcagtgaaacctgaccttcaatccaaggacagtttaaagcctaaaaacagagctgccagttctcgatagagtccacgactggagcgaggacctctgtgcccatcttaccctcctctctctctgttggttccttctggatgatgccttttaaccagtcaaatggtgctttttccaaagaccacccatggaccaatcagcatgcatgcttccattctaagcccataaaaaccccagactcagtcctatgggggctacctgcctttgggcccctactcactgccgaagggtcccctctcgcagttgagagctttgcttctgttgctaaataaaattctttgccttactcactctctggtgtgtgcagatgttattcctcttggttgtgggacaaggacctggaactcacaaagctgtgggcagcaggaacaagacagctgtaacacacccgcatttgcctagctccagacacaaaaaagcaaagccactgggtaccactccctcccactcgccgagcaacaagagagaaaaagcttctgggcaccactccctcccactcacggaacacaaaagccacaacatttcttgggggctcagaccttgggactccccaagcaagagctgtaacacagtggctacagagatttccagctggggaagtagtaccaaagggatcctgtaacattaccattggaagaaagtgcacaaagtatacaagggctctcttagtattatacaagtatttcaataaaagttttcatttaaaaaatgaaagttgaaaaagagagaaacaggaaaccaatgtcataaagaaaaggggtaaattatttcactttgagcttcctagttaaccaaagaagtcaaggcaaaaaagaaatatcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcgacag

SEQ ID NO: 4895 - DNA, 2458 bp, Homo sapiens
attctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatgtaagttcttttcacttttcttggcttgaattctgccttagctgacaaagctgtttctatggaaacaaatagtttaacctcttagaatgtcagaggaatgctgatcacttaaaatgagacttcccagctgctggtcaaagggcattacttgctggagaaagaggggaaggatgaatttaaaaaattctagagttctggacactagtgtagactgaacatgtttatgcgtatgaagtatatctcttctattttactctgcctaaaaattaagatactggtaatataggaaattggatttctgctgacctgtcttgattctcagctcttaaacaaatggttctattcgttggtacccttttcagtgggtctgtaccctttaggctatttcagtccctccagtctcaatcatttgcacttgttgtgaagcttatttagcttcccattgcccccttctcccgcaactaaaaccctttctcccttactagtttgaggttagcattgaaacagcttcggcatgccagcctgaaaatttttcttgctttgtggactatgtaaagatttttgtatttgtgttcgttttctggcagggatgggagcagggattctgatgaggatttgaaatgtagtcctttgaagctttctttctttcttattttttttttaaacttataattggcaagttgagaagaaaagaattagggccagtaactgcctctgctgtcttcataagatggcctgttatttacacacaatgaggtaattctctagttcagtcatttaccagcttctgaattgtcaaaggacttttttttttttttttaaagagagggagagtgcaattgctttggactgggaggactttttcacttttatgatgtatatagactacatgtatgggctagagtatttgtggagtgcctgcttaaaaattataatcttaatgctaaaactataggatacagtataatgtttctttaattctggaagaactttaggatctttcattgccttcattaaattaacttgtgagcattatagagtttttggagtgttaaatggtgaagtaattatttaacaggatagtctggaaagatttcttgtagaattagggacttgagggaggtcttgaaggtagaaatcaatggaaaagtagttcatcagtcatttgggcagaaagatgggatagacacaaatgaggaaggtaaattagaaggctcatgcaggtgcgtagtaaaagatatagctagaaatcttggattcattttttgagtttgaagtttattctccaggtagtgtgaaagccatcagaagttctgaacagaggagtggtttgctcatatacttaattaagcaaacacttagcaggtatcacggctatagaggtcaacaagacggatccctgccaattagataatttacctgtgtgatctacagttaccttgaaattaatgtgtctaaacccatatttccctttacttctatctgattctcctatattctccatcataattagtgacattgtcatctacctaataagccagggatagtggttaagagtgatggttctggagttatactgcctaggttcatattctgaagccttctgttgtttggccttctgctgggcaatgttacggattcagagatgggtcagcctggttcctgacttcaaggagcttctagtctgatgagatagaaaggcagagatataaatagcagtagtccaacttgatcaagaatgtgacagggattataggattccagaggacagtgtatttgagctcagacttaaaagagtaggcaaagatcagatcctaggcagtctgattctggaggcttttctcttaaacatgctgtcttgggtaactggatggatgtagtgacattagttagaattgaaaacagggagaggattaaagagaataggagattaaagggaaatatgagtttaattttggacatatttctagattcttgtgggaaattctgatagatagaataatggtcagccgggcacggtggctcacgcctgtaatcccagcactttgggaggccgaggctggtggatcacgaggtcaggagtttgagaccagcctggccaacatggtgaagccccgtctctactaaaaatacaaaaattagctgggtatggtgattggcgcctgtaatctcagctactcaggaggctgaggcaagagaatcgtttgaacctgggaggtggagtttgcagtgagccgggatcgtgccattgcactcaaactggacgacagagtctc

SEQ ID NO: 4896 - DNA, 927 bp, Homo sapiens
ttcacaggcatttcagtgactacaacagtgagtatttaggcaatacataattatgaatgttaaatatatgagggtcaagagtgttaaatatatgagggtcaagtggtcctcttgcccacattagggtggtgtgggggacaatagctgtcttcccgtaagtgaaaagttgtgaagtagaaaaatatagctcagtatggctcaatacagtgcaccaggaagggatggtagaaatgtgtaaaaaccatggtaattgagagtctatgatttgactttggatttttatttacttacaacagtgattagagttataagaaatatcctatctatattttgtagtagtgacatttgctttatgcttctggaagcaaagcagaaatcatgccctgtttgtttccatcatgatgaagcaccttgtaccctaagattaaccaaaaataacagcgttaccctgtcaatttctggtcccaaaataatgaaacattgagtatttcttataatcccagatccccagcaaacaccattttattcttgacttttatttagctcatgttgcaagatctttctgaatatgatcatcatgtgataagattttgttttttctccatgaacaaattaatgcaaacttagtaatcatggtaatcttctttatatttttctttaaatacctgttatatttttcacttgcttatccagtttttctgaagtctgactcccttgaaccttttcaagtaaactctttttcttttcaaaatgctttggctctgactcttcctttgaaatttttggggaaaaaatgttctctgatcttaaaagggattgtaagaaaacatgaaaagcctctcactgttgttgatgtttcattaatttgttgctctgtttggcactgtcaatttaaaataaatttctatgcctctttcagcaatcaaa

SEQ ID NO: 4897 - DNA, 3413 bp, Homo sapiens
ctttgacatcagcacagctttgaaagggggatgggagagcgagcagaaagcagaaaaaccagctttgaactatgcatgcaaggcctctttcaagcctcaaattctataaggacggcttgagccagggcagttcaggaaacacttgaggagcagaggcagcagggcgctggaccagacagaggacgggaatgtccaagaagtggtctctgtgtgcggtaatgagccgagattacagctggcagctggaaactaaaccccatgggtgccacccagagagagctgagactgaccatggagtaacggccaaggtcatgtgtgtagccccgggccatggagagggggtaccctggaggggctgggctggctggctgggctcaggctgtctgacaggcaacgggctccccagtgttctgaagagggagtggccctggtggtaactctctgtggcttagaggggctgaagctagaacaccgctgtgactccgggcccgctggttccctgagggcaagggccaccttgggtcatcgctctgaacaccttccccttgctctgagaagcacagatggccagtgtgaactgcctcagcaatccagggactgtgtcctctcattaagatatcatggcaaatcacgagaagacacaaaaatcaaaacatgcaagagaagaaaagactaatgaaagcagagattccctgcgcggctctttctaagctgactagaagagcagcaggcactccgataacttccgcacagtccatttttattattcttcaactaacaggcaagaagccaaagttcctgtaaatatatgcataattcatttgtaggcagttaaacctctacttttatggtaaagctttcaattgtatcagaaaataggcagggcgcagtggctctcatggctgtaatcctagcactttgggaggcggaggtgggtggatcacttgagcccaggagttcgagaccagcctgggcaacatggtggaaccccgtctctactaaaaatacaaaaattagctgtgcgtggtggtgcgcacctgtggtcccagctacttggaaggctgagctgggaggactgcttgagcctgggaggtccaggctgcagtgagctgacattgtgccactgcactccagcctgggtgacagagcgaaaccgtgtctcaaaaaagaaaataaactgctttgaatgagggtgaagtattgtatttgcatgagaggagagcaagagatataaaatatttaactggtattcaaaagccaattttaaacaattcaagtaaattctaacaataatgtaatgacttctttcacaaaagaccaaatactcggcaactcttttgccccagggtctctagttagttagccgataataagtcctacattattctgctataactttgacttctcctagtcttttcttttctaaaaatggcctcaaaaaacaagtccatgattaatttactcttcctataagtatcttaaaaaaaaaaggtctctttatttaacacttccaccttccagtccaaaaatgttaaatgaaggcattaattcagaataatcttacaatgaacaggtctgagggctatattcaacctcactggttaaaaaaaaataaaaatatgaaatacctttttctacttatcaaataactacaacttttacatgatctcagcattggagaggtatgatggacaggcatctcacatactctgtatgtggtgctactctctggaaagtgtgtagacaatatctattaagggtttttgaaaatgcctgctctttgatccagtacctccttcatcaagcttaaggaaaggttcaaagatgtgaacaacaacgataacaaaagattaacagaacagtatcatttataatagctgaaaaactggggtatccacagaatgaaataataaacggttgctaaaaatcatgcctctcgttcccactaatgtcagaaacaagacaagtatgcccactctcaccaccactatgtaacattttactgaaattgttttactgaatttattagtcaactggagagaaagacatgtgagtttacaattataaacagaggtgaaattatgtgcagatgctctaattaatacctgaatattcaaaagaatcaactgaaaaactgatgcaaacaatcaggtaattcagtaaggaagcaggttatgaaagcaaggcccccaaattcaatagccttcatataaacaactaataactagaagacacaatggaagaaaagactctatttacaagagcgatgataatgattatctaggcattagcttagtaagagacatgcaaaacctacaagggaaacttaaaaacagccttaaaggacatgaaagtggccttggaaaatagtcatagcatactcttagaggaggcacacatcacaagatgccagccctccctcagatatttgcaaaatgtaacaggatcccaataaaaatgccaacagtagccaggcatggtggtgcgtgcctgtaatcccagctacttgggaggctgaggcaggagaatcatttaagcccaggagttcaagaccagcttgggcaacatcgcatggaactgtctctaaaataaataaataaataaagtcaacagctgtttctttctgcaatgactatgggtcaattcaaagttccaactgtttgcagtaatatcaatattgtttttgggaactgtttaagagaatatacccataattacattagtgatgctagaaatcaacattttcagtgtaagacagagataaaactatgaaagccaagaaataagtgaaagtgataggaacaggaagcagggaagttctgggcagaagagggcacgtcccttgtgagggccctagcctcaagccgaaaagcctggaaccttggtccaaagtgagaacatgcattcctgtttccccactcgaatgttgccttttccaaaaccacccatggcttgccccgtgcctccatcctgtgcccataaaaaccccaggctcagctggtagagagaagagaagcaactggacataggagactagagttggatgttggaaagaagtggcttgacttcagagggacaacttgatggcgtaacttcagagaagaatctggctggagacagccagacttcaggggaagattaccttcccactctgtctcctttttagcttcccttcccactgagagccactttcattggcaataaaatcccctgcatttaccatcttcaattccttcatgcaacctcattcctcctggatgctggacaacaacttgggtgccatgagtatgggtgtaaaaggttgtcccactgaccctccactgagctgttaacacttaagtcatccatggatggcagagctaaaagagtactgcaacactttctctggggcttcagggatcacagggacccct

SEQ ID NO: 4898 - DNA, 15599 bp, Homo sapiens
acttggcaccccttacgccttacggtggccgctgcgcccagtcacatctattgcatttctctggaatgaccacagcaatatttccagcccttgatgatcttctagaactttgccacttccctgcatcaagagggtttgtcttggtccattttatgctgctataacagaacaccacagactgagaaatttataaggaatagaagtttatttgcctcatgtttctggaggctgggaattccaagatcaaggggctgcatagattgaggtcctttttgctgactcataacgtggaaagagagtgcactgcatagaagaaaggaggccaaactcattcttttatcatgagcctactcctgaaataactcactctcaagataatggcattaatccattcatgaaggcagaatactcatgatgtaatcacctcttaaaaggtcctatttcctaacactgttgcattagggattaagctgtcaacacatgaatattgggggacacattcaaaccatagcaagagttctttgtctttgtgactcggtgtggttcagcaaattgcgattggtctgctatagcggactttcccctcacctcccaaatgtttattatgaaaaatttcattttaaagaaaggtggaaggaattgttgaaagaatatgtcatctagtttctactgttgttaacattgtgtcatatttgccttttcatccatccaaccacccatccatctagctaccttataattactattattacttattattactattatttttaaagacacctctattaaagcaaccatcttattttttgattttatttattttcaaagttagttgcagacattagtatactttactcctagacattttagcgtgaacataattaactggagtataatacttgttttcaatttctttttatttttgaggtaaaatttacatacagtgaaatccaaatcttaagtgtaccactagataaattttgataaatgcattatgcctggtcttcacacacccttttcaatatatagaaaatttccagataatttattttgttgtttttttcacacactaagttctagacttttccaggtccgagggaactattaggggggaaagtacttgttatagtaaaaaagattttaggtgtgtttgtttttaaggtgcagaaacacatcgcagattaaggtctgcatctctgctttttgttattgttccagtttgatctcagtgacattacaagcaagcagaaacactcagacatgaaatggccagtgcctgtgagttaagagcaggatctaggtctatttttttgatatgtatctcaactacctggaatactttatacttttggcactcaataaatatttgttgctgccagacgatctgccacaaaaatttactgggtctattttatggctattgtttgttcaccttgaaaataatcatgggatcatagaagtcaaagtcatggagagcagcacagaggtttctcagctgttgataagttctttacagtaaagcagggttaaatgtagaaggtatgatactgagagcttctcaaaggtacagaggtgaatagaggaaaaagagcagataaattcagacagaatgtcgttaaggtcctagcagaaaaaagacctgaattcggagttctcttatgctttctactggagttccaactctgtgcttgacctttccagggcctgcaggtgcatgaagatgggtggttactattcctagaaaatgtttatgtagaaaaatactgatacatgctgatatggtttgactgtgtccccacccaaatctcatcttgaatggaacatattgcaaagtggtagcatgatattttactaaactaagttactgtcaagacattcagagatatttttaaatggtacaccaaatttcaacaccctaaatgctcactcaagctgattacaaatgattgcttgccattctttgtgtatgagtgtgattaccacctgcagtaacttaaagacgactattcagggtgaaatctgcctctgaattgccatcctggtcacaaatcttttccttcccaagtggaaatcttctccagaagaaataataacaatagtattttggttagtgttcagttgtggagagtaaaactcactctagctagtttaagcagtaaggtgttcatcacggagcattaaatggcccacagattttaggttgagtgtccaggaatggttcccaaagccacattggctgtcaagggattatgcctttgctaccattagaaagccatggtataagaaagataccatcacagctgttagctctagagcctctgctatcagtggaaaatagcctaccaagttaggaaacctttgctacagctgctgtcccaggctgccactgcagttctaaggcacatcaacaaaattggattccagactctaggctgagtgtcattcctggacactcaacctagaagtttaacatctaattgtaggaacttaaatctagaatcctaggtgcaagggattgggaaatggtgcaagggatttagtcccattatattaaaagaagttagaatgcatgcttactggccagtgtttactagaaatatctaacatttgtcaagaacctgtacgtgagtcacggtaattacttcttcacatgaatgatctgagtcttacaaccacccaattaggtagttacgtcctattagtgagatactattattatagccacttttacaggtgaggaatctgctggtaggaaaagttattttctcaagctcgggtcacagaacagaacatggtgaaattggcatttgaacctaagtgtgtttgactctaaattctggaatctggtctcttaacaatcatactatactgtttctactatctttaccaattaagtgaaaagaaaattagtttaaaagatatttggatatcatcaatcatcaagacactgtgctaagatcatacataaattttttttttttttgagacagtcttgcctgtcacccaacctgaagtgcagtggcatgatctcggctcactgcagactccgcatcctaggttcaagcaattctcctgcctcagtccccaagtaactgggattacaggtgtgtgccaccatgcctggctaatttttgtatttttagtagagatggggtttcaccatgttgaccagactggtctcgaactcctgaccttgtgatctgactgccttggcctcccaaagtgctggggttacacgtgtgaggatggcattaatctagaggtaaactataggcacaattattatacaaggtaggaagtaaatgtcataagagagtatagacaaaatgcccttggaattatttggagagatttactcagagaattcagaaagaagtttagctaacactgggctttgaagggtaaatggtttttgaacattcagaaaaggaagaaggttacttgtatcaggctgttctcatgctgctaataaagacatacatgagactcagtaatttataaagaaaagaggtttaaatgactcacagttcagcatgtcttggggaggcctcatgaaacttacaatcatggcagaagaggaagcaaacacatccttcacatggaggcagcaaggaaaagtgcagagctgatatgatttggctgtgtccccacccagatctcatcttgaattcccatgtgttgtgggagggacccagtgggagatgattgaatgatgggggcagatatttcccgtgctgttctcatgatagtgaataagtctcatgagatcttatggttctacaagggggagtttccctgcacaagctctctctctttgcctgctgccatccatgtaagatgtgacttgctcctctttgccttccaccatgattttgaggcttccccagccacgtggaattgtgagttctctgttaaacctctttcctttgtaaattgcccagtctcaggtatgtttttatcagcagaatgaaatgaactaatacagtaaattggtactggtagcatggggtgctgctgaaaagatacctgaaaatgtgcaagcgactttggaactgtgtaacgggcagggattggaacagtttggagggctcagaagaagacaggaaaatgtgggacagtttggaacttcctagagacttgttgaatggctttgcccaaaatgctgatagtgatatggaaaataaagtccaggctgaggtggtctcagatggagatgaggaacttgggaactggagcagaggtgactcttgttatatttcagcaaagagactggcagcattttgcccctgccttagagatttgttgaactttgaacttgagagatgatttagggtatctggcggaagaaatttccaagcagcaaagcattcaagatgtaactaggatgtggttaaaggcattcagttttataagggaagcagagcatgaaagtttggaaaatttgcagcctgacaatgtgatagaaaagaaaatcccattttatgaggaaaaatccaagccggctgcagaaatttgcatatgtaatgaggagctgaatgttaatccccaagacaatggggaaaatgtctccagggcatgtcagaggtcttcatggcagcccttcccattacaggcctagaggcctaggaggaaaagtggttttgtggtctgggcccagggtcccgtgctgtgtgcagcctagggacttggtgccttatgtcccagccactctagctgtggctaaaaggggccaatgtagagctcaggccatggcttcagagggtgcaagcctgaagccttggcagcttccatgtggtgttgagcctgccagtgcacagaaatcaagaattggggtttggaaacatcttcctagatttcagaggatgtatggaaatgcttggatgtccaggcagaagtttgccaccggggcagggccctcatgaacctctgctaaggcagtgcagaaggaaaatgtcaggtgggagcccccacacatagtccccactggggcaccatgtagtggagctgtgagaagaaagtcaccatcctgcagaccccagaatggtagatccactgacagcatgcaatgtgtgcctggaaaagctgcaaacactcaacaccagcccatgaaagcagcagggagtggggctgtaccctgcaaagccacaggggtggagctgcccatgaccataggaacccacctcttacatcagcatgccctgggtgtgagacatggagtcaaaggagatcattttggatctttaaggtttgactgccccactggattttggactttcatggggcctgtaacccctttgttttgtccaatttctgccgtttggaatggctgtatttatccattgcctgtacccctattgtatctaggaagtaactaacttgcttttgattttacaggctcacaggcagaagggacttgccttgtctcagatgagactttggacagtggactttcgagttaatgctgaaatgagttaagactttgggggactgttgggaaggcatgattggttttgaaatatgaggacatgagatttgggatggcccaggggcagaatgatatagtttggctctgtgtccccacccaaatctcatattgaattcgcatgtgttgtgggagggacctggtgggaggcaattgaatcatgggggcaggtctttcctgtgctgttctcatggtagtgaataagtctcacaagatctgatggttccataagggggagtttccctgcacaagcaccctctctttgcctgctgccatccatgtaaaacgtgacttgctcctccttgtcttccaccatgattgtgagggttccccagccacatggaactataagtccagttaaacctctttcttttgtaaattgcccattcttaggtatatctttattagcagcatgaaaacagactaatacaagagtgacgggggggaaagccccttataaaactatcagatcttgtgagaactcactatcactagaacagcatggaggtcaccatccccattattcatttacctcccaccaagtcctcctgtgacatgtggggattatgtgaactcaagtccaagatgagatttgggagaggacggagctaaaccatatcagtagttaatagtcacagaagctggaaatcctgaggcatgtgtggactaattgcacatattccaatttggttagcacgaacagcaaataaaatggagcagaggaaaatatggctgaaaaggctttgaatgctaagtcatttggaattccttttgtagattgtcaggaaccctgaaggtccttgagcagaggggttacatgagagctctgttatatgaagatattaggatcttttggataatctggagttggaggactagagatcaaattagattggagctacatctttacaaaaaataaagaaattagcaggcatggtgatgtgcacctgtagtccgagctacttgggaggctgaggtgagaggatcacttgagcctgggcagttgagactgcagtgaaccatgatggtgctactgtactccagcctgggtgacagagagagagcctgtctcaaaaaaaaattggaagctgatataatgacttttgagaactgacagacagatactctaatttgatgacagtggaagtgagatgaactgggtatgaggattagaaaaaagagagctggacttagcagttcttaacaactaattagatgttgatagcaaggaagagagaagagtcagattattctgaggtttccttcctgggtcatgagaacaatgatttcattaataaaagtgtataagggcataagaagtgcgtaagttcttaagaagaatatacttacatgggaaattaatgagttcgattttggatttttcaagtgaaaacactggtgtgacaacccaagagacatggccaacaaatttggaaatgtggaatgggagatcagaagagaagtcagactagaagcataagattttaaatttatctgcatatagcagtactcaagatagctgcacttcagtagcacctagagagctttaaaaagtacatgtgctggaccccagagattctgatttaattggtaaggctaaaaattttgatttaatcagtttggtcagtgatgcagatttaattagtatagggtaaggacctggtatttttatagtttgtaaagctccccagatgattctaatgtacaaccatgtttgataactactgacagaggtaattcatgagcatgaggttgggcaggatttgaaaaggatagtataaaaagagagaaaagaaagttaatggtagagccctttatagcatttatgttcaatgagtagaaagagaagtcagacaataggcaaagaggtagaaaataaaccaggaaaagagccagagagttgagaggagtcagcaatgccacatgccacagagagcagaggagacttctaagaaaggatttaatagaggcagggggtggcattggaggacatgttataatttgctttgtacatgcttgttcactgttcactcctggttaagttacaaattcataattaaaaggaagaagctgagagatgaaaagctgagaaagtgcttagacaggcaagtttactggggtaagccttcagatgagtgaaatgatttcagaacttagttggagttttggaatccaggatttcagaaatgtagcaaacctgcatgatgacaatccagtgggcatagttctgagagaggagtgctgtagtggccaaacatgttttaggagtctaggtcagacaactgtgaggttacagttcagtggatcttcacatgtatgattaaatcagctatgatgtgacaagacttgtagtataaaggagaatgctgaaccagatgcctgaagtcttttctttaactgcttattttaaaaattgtcacattgtaagtgtatatgtttatagggtacaatttgatgtttcagtacatatctgtatatggatcatgttgtataatgatcccatcaggatagttaatgtgtccttcacttcatgcatttgtttgtggtgagaccattcaaaaacctctcctctagctattttgtgatacacaatattttgctgtcaaccctagtcaccctactgtgcaatagaacaccagaatttattcctcctatctaattgtaactttgtacctgttgattaacctctccccatctttctctcctcccttccctcccttccctcccttccctccccagtttctggtaaccattgatctactctctgctgctataaaatcaacatgtgaattttttcagattccatgtctaagtgagatcatacggtatttgcctttctgtatctggcttatttcacttaacatgatgtcatctagattcatcacagattacattacattgatgttgttgcaaataacaggattttattcttttttatggctgaagagtattccattgtgcatatataccacattttctgtattcatccattgttggacatgtaagttgattccatatcttggccattggaactagtgctgcaataaacatggggaagtatatatgtcttcatcgtactgatctcatttaccttgtatatatacccagtagtgaaattatttgataggtagtggttctatttttaattttttgaggaacctccatatagttttttataatggctgtattagcttacaatcctaccagcagtgtgtaagtgttccccttttttcacatccttatcaacacttgttttcttttgtatttttgacaatagccattctgactggcatgaggttgcatctcattgtggttttgatttgcattttcctgataattagagatgttgcacattttttcatacacctgttgggcatttttggtgtccttttgagaaatatctactcaggtcatttgctcacttttaaatcagattttttttctgctattgagttatgcaagtttttaaaaacataatctgggcagtaactccttgtcagatacatagtttgcaaatattttctcctattctgtaggttttattttctctctgttgtttccattgctgtgtaaaagcttttcatattgctgtaatcccatttgtctgtttttgcttttgttgcctgcacttttgaagtcttattttaaaaaaattattacccagccccatgtcgtgaagtgtttcctctatgttttattctattttatagtttcagattttacatttaaatcttaatccattttgatttgatttttgtatatggtgcaaggtagagatctagtctcattcttctgtatatggatatccacttttcccagcaccatttattgaagagtctttttactttttaattttaggttcaaggggtgcaggtgcaggtttgttacacaggtagattgtgtgatgctgaggtttgaaattctaatgatcccatgacccaagtggcagatacagtacctgataggtagttttcaacacttacccctccctcttttctccctttttttggaattcctagtgtctgttgttcctgtctttgttccatttgtacccagtatttagcttccacttacgagaatatgtggtatttggttttctgttgctgcgttaatttgcccatgacagtggccttcagttgcatccatgttacttcaaaggacatgatttcattctatttttatgtctgtgtagtattctatgctgcgtaagtaccacattttctttatccaatccaccattgataggtgcctgggttgatttcatgtctttgctattgtgaatagtgctgcactaaacatgtgaatgcatgtaactttttggtattaatagaatgattgatttttctttgggtatatacccagtaataggattgttgggttgaatgataattttattttctgttctttgagaaatctccaaactgcttttcacaggggctgaggtagtttacattctcaccaacattgtataagcattcccttttctctgcaacctcaccgttatccattattttttgactttttattaatagccattctggctggtattagatggtatctcaccgtagttttgatttgcatttctctaatgattagtgatgctgagcattttttttgtatgtttcttggctgcttgtatgtcttcttttgagcagtgtctgttcatatcctttgcccattttttttttttttttgagacaaggccttgccctgttgcctaggctggagtgcagtggcatgatcatgacttgctgcagcctcgacctctggggctcaagcaatcctcccaccttagcctcttgagtagctgggaccacaggtgtacgtaaacacacccagctaatttttagttttttgatggaggcgaggtctcattttattgcccaggctggtcttgaactcctgggctcaaggaactcacccacctctgcctcccaaattgctgggattacagctgtgagccaccatgcccggcctgcccaattttaatggggttatttgacttttgcttgttgatttgtttagttccttatagattctgggcactagtcctttgttggatgtatagtttgtacatattttctcccattctgtaggctgtctgtttactctgttgatagtttcttctgttgtgcagaagctcgttggttaagtaggtctcacttgtcagtttttgcttttgttgcacttacttttgaggacttaatcataaattctttgcttaggccaatgtctggaagagtatttcttaggttttcttttaggattttcataatttgaagtcttacatttaagtctttaatccatcttagttgatttttgcatatggtgaaaggtagaggtccagtttcattcttctgcatatggttagccactttttgcaacaccatttattgaatagggtttccccattgcttatttttgttgactttgtcaaagatcagatggatataggtgtgcagctttatttcaggggtctgtatcctgttaccttggtctatgtgtctgtttttgtatcagtatcatgttttgtttactgtagccttgtagtataatttgaagttgggtaatgtgttgcttccagctttgttctttttgcttaggatcattttgactattcaggcttttttttgttcagtatgaattttagaatagttataattctgtgaaaaatgacattggtaatttcataggaatagcattgaatttgtagattgcattgagcagtatggccattttaattatattgatccttccaatccatgtatgtggaatgtttttccatgtgtttgtgtcatccctgatttctttcagcagtgttttgtagttctcattgcagcaatctttaatctctttgggtagatgtatttctaggtatttttttcttttcaactgttgtgaatgggagtgtgtttttgatttgggcaagagagcaagactccgtatccccccccaaaaaagaaaaaaaaatgctactgacttttatacattgattttgcattctgaaactttgctgaagttgtttatcaggtctaggagtcttttggcagaacctttgggtttttaaggtatagaatgctatcatcagtgaagagagacaatttgacttcctttttttctatttggataacttttatttttgtctcctgacgattgctttggctaggacttccagtactatgttgaatacaagtagtgaggttgacatccttgtttttttccagttcttagatgcctccaactttgcctattcactatgatgttagccatgggtttgtcagaggtggcacttattatttttagctatgttcctttgatggctagtttgttgaggaattttatcatgaagggatattagagtttatcaaaatctttttctgcatctattgggagttagggaggagtctctccttgaatttttggaatgtttcaataggattggttccagcccttctttgtatgtgcggtaaaatttggctgtgaatccatctggtccagggctttttttttggttggtaggtcttttttattactgattcaatttcattactcattatcagtatgttcaggatttctgtttcttcctgcttcaatcgtaggaggttttgtgttttcaggaatttattcatttcctctagatttttctaatctgtatgcatagcaatgttcatagtagactctgggggccttttatgtgtctgtggaatcagttgtaatgtcaccctttgtcatttctgattgtgcttacttggataatcttttttttctttgttaatctaggtagccatctatcaatcttgtttatcctttcaaagaactaattttttacttcattgattctttgtatggtttttggatctcaatttcatttagttctgctctgattttagttatttcttttcttcacctccaagatttcagtttggtcattttaatatcattctttttaatgtctatctctttgttgaatttctcattcagaacatgaatgttttcttagtttcattaaattgtttgtgttctcttgtatctcactgaatttccttaagatcattattttgaacttcttttcaagcatttcataaatgtcctttccttcggagcctgttactagagactatgttcctttgggagtgtcatgtccttactttttcttgtttcttgtgtccctttgttgatatctgcacatctaatagaatagggatttttttttgtttgttttatggagtagcttttgtaggaagagatctttttcttgtagacgcatctagagtattaattgggtatggtgcgttggctttatttctggtgaactcagtaacatggtccccatgcagtttcttcagctattattctcatcagtgatgtctgtgattgcttcagtgacctaggctgtgggagttttgatggtattggcacaggtttgctgggagcaggggcactggtctggttgtcaggctgggtacatgcagtcacagagggctgacaggctatctggtgggctttctggagaggcagagctgccgctggactggatgttggggtgagtgtgggtgtggtggtgccaggtggccctgcagtggtgtatccacgaaagcagggataccacaggactagctgtcaggctgggcatgggcacatatgggctcagtgatctagtcagctttgcagcacaggtgtttgtgaagtggctggccagctgttcagcggcttccttactgtataggtttgcctgttccctgggagtgggggtagtgtgctatgtaggttcagatgccagggtctcagttgttatgtggcctaggcttcacacagctggggtcatagtgctgcaggcatccagatgaacttggtagaatgatggcgagtctcagagacagtgagattctgtcacagagatagagactggctcttagtgcagggcacactctagctgagggtccagtgtcaacaaggcattgagcatagcagcttacattgttgaggtgggaggtgctcaaggtaggcttttctgaggcaatgcagctaagcaaactcctgattactctccaaactgaatttggagcttttgaggactggaggactctcctgtagcaaggactggcatttgtggtggtaatgggcaccactgcatatatccagcatacctcttccctgtaagaagttccccctgacttcaagctgatcttgggagacaatgtggcaaagtcagggtgcctttctcacctctctatggtgctatctgtgcttctgttctccacagggatattgctgctcccctggtgtctgctagcatacttcctcagtcactttagttgacatatagttgtttatttattgttttggtcccttcatgtgggagagaagtcaaatcgacttggcaaccttgatgatgtcactacctgggatgcatggagtcttactgattttgagggagtggtttggaggttggtaatcatggtaatgtggatgggaagagaatagtggttatatatagacatgagagtttcaaaggagagggcattgttgagggatattttttaaaatctgaaaatcacagtgtggactgagagtggtagcccagcatttccttctctggttacatggattcaaaggtgagtgaaagcatgttttctttctctcagcatctttgttacttcacttctcgaataagtttctctttgttagaattaggttcagaatagcaatttccttattggttactctgttttctgagaagtagaattatcaacaaagaaacaggaatatttcagatcatctactatgtaagaatcaaatgagattgtgtatttcagagtgttttaaaaagagcaaagtattccaaatatctttattcctattaatcacgttaaaaatggaatgagaactgaactacccataaagtttctacaaatgatgccattattttatagatgagtaaaattttaattgaaaaaacccaacattgtataaattattaagttcttaagttcttaagcccttttatacttggtcctgtgatcctggggtggtgactctgtggaccccattttgactttataagctgctttctgttggggtataccagtagggggtttaaaagggagactggtaggccgggtgagaaaggacttgattctttccatgggcttgcagctttctttctgccttctgtctgttcctgtgagcatcagtcctgcaacacttcctcaccaggcaggtaaaattccctcctatatatatattttgagattgcgtctcctctgtagctcaagctggggtgcagtggtgtgatcttggctcactgcaacctctgcctccgcagaaaattcttgtgcctcagcctcctgagtagctgggattacaggcatggggcaccacacctggctaattttttgtagagacgggattttgccatgttggcaaggctagtcttaaactcctggcctcaagtggtccaccagtcttggcctcccaaagtgctgggattatagacatgagccactgtccctggtctcctcctatagtttatctaaagctagtatgcaaattttccaacacccgaagaaaaaaatttatcatgtacaatcccctttgttcccaacatgtgcaccaagcaagtggcatctcttcttcagaggtttgggtccccatgggatccttcttccacatttctaagttttaacaacctcttcccttgtttccccaactctatcagtggtacctatttctgtaaagttgctctatctatgatttcttagggggtctcttttgtcctccagttttcagttctttgtattaaattctttctgtccaaatggctgatatggtttctgcctctttattgaacccagactaatagaattgtcatactaatttgttaattagcaagacaatttagggtcatatcttaactgtacattctgtctagtatttactatttatactgttatccataatacttagtgaataatgatgacatacactaaaaattaattaaaacacagatattatctataataataaaaaccaagtttagcactatgaaaaacttactacattgcttttatttttatcattttatttcatagtggtgaaaacttcatcagaacctcac

SEQ ID NO: 4899 - DNA, 5134 bp, Homo sapiens
catctcctcctccttcttctgctcccgattctcctcctctcctttctcttcgtcttctcctcttccttgtcccctcctcctccttgtccatctcctctactcctccttctcctcctcctccttctcttcctttcctcctttcctctttttctcatcctctcctcctcctctcgtcctcttctcttttcctcattcttttcttcttctcctccttttttctccctacttcctcctagcttcccttttctcctctcctctcctggtcctgttgtccccctctcctttttttctccacttcctctcttcttactatcttcttctcattttctcttctagttcttctctttcctcctccttttcttctcttctcctcctcctctttcttcactcctccactcctactccttctcttactgtgccactggccatgccaaacagcacccagcacaagtagtggcaccctcttcagcgctgcgctagaaagaactgatgtgcatttatattagcttttggaggatagtactaatccggcctaactcaggcggccaagtatatatatatatatacgtatatacatatgtatgtatatacgtatgtatacatatatatatacacatatatatttatagatatattctatgagaaataatcttgctctgtcacctaggctgcagtgcagtggcacaagattatgactcactgtagcctcaagagatcctctcacctcaccctcccgagtagctgggactacaggcgtggcccatcacacctgactaaattcttttttagtgacggggtctcaacacgttgcctagtctggtctgaaacttctgggcgcaagctctctaatgtttttgcattcatagtctcccttattttaatttctcaagtttttgcaaaattgttacataactatccgcccttttcatagagcgctgtttcttgagccaggtcttctgtccatgcatgtcctcttgagagagtggatgtcagccagctaccctggctgagagggatggggataatacagggatgcaataaaggagacagtgataatttatatgatctgggaccccaggcctcacaccagaactgtctagtatacttttagcaaacaagtgccactgatctgagccttgttctgcccttccactttccactttattacacaagcaggagataggcaagggagaaggcaggatgatgaggagactaaattccagaaaagaaagggctgcgtgcagtaagcagacagttgcccccaaagtggtctgggctcccacttaccttagagacatgtgcaacacttgtgaatagttgttttacaattcttaaatcagtggacagactgtaagcatcccattggtgtcagttgccaggtgcccaatgcctgttctctgcagcaacctttgtggtcccatacctgggcgtgagttctgttcctgcagagtgccctgtgcattctggtgcttttgtgccctctcctctaacctataaactgacaactctaactctatattttcacttacaatttttctgaagcagtgatcttttgtcatcttgatcacactacaagtcgctcaccctgcaagtacttgtaaaaatgaaagtaatctccattccttctggaaggtgattgccatgtacacaacctactaggccaggaacattactgatggctgtcctgatgcatgtctctctcacccccatgtccaatcagtcaccaggctctccccaaaaccatgctccggtcactgactttggctgtttaatcacttctgacctaaggtcctcattgagtcataagtacctcttgagttaattttctgcctccagtttctctctactgctgtttatcttccaccctgctgccagagtcatcatcctcaaaaatgaaagctgctctcattgtttgcctgcctaataacatctcttccctccctgttgtctacaaaaagaaaaatccaaactccttcacttgttttacaaagaccctcatctgcttccaaaccaaattgctagtcttggctcttgtctctgtcttccacatcactgccacactgaataattctttactgcctctgttgttgcacgggttgttctttttgttttgtctccatccccttcccccagcaaagaatatttactctttactcttctgttgagacccatctcaaatactaccttttctagggaaaattaggccttctgttcctaataacttttacccccatctatcaagtctgtctgctgtaatttatctgttaacatgtttctcccacctcaagaatattttttccatcttctgtacctagcacaattgcatggttggtgctcactgactactacatgttgatttatttattttacttgtttgagaggtggagtcttgctctgttatccaggctggtgtgcagtgatacaatcttggctcactgcaggctctgcctcccggtttcaagcaattctcctgcctcagcctcccaagtagctccgattacaggcacccaccaccacgtccagctaatttttgtattttcagtagagacaggtttcaccacattggtcaggctggttttgaactcctgacctcaggtgagccgcctgccttggcctggcaaaatgctgggattacaggcataagacaccatgcctggacttgcatgctgatttccgatataaaaatgaaatttttgaagattttggagaataccatcatgtaaattggaagctaaggcctaactattactacacattcagcaaaggaagtgggtataaactaacaactttggcacatctgtcatgcagtagtttgctgcaaggtggaaaagattttggtgctttggtgggaaatactgttgaattacagaaattctaaaacaaaagctggctcagcttaaagagaaaagaaaatgcttgctaatgcctgcttgcactaaaagctgtcacactgtggcctttaataattctaaacatttttaatggattttggtttgaacttcaaattcaataggaaaaataaatgcacagataaaggacccagatcatttcagagctccaatgtgtgaacccgttttctctacttatttagagttttgtttcactagtggcatgagttaataggagtgttgctttgtacataaattctctttattccataattcttggttttaaaaattgaatgcaataccagaaacctacagggtataaatcttgcttgatgtgtgtgcaatgtacatacttgataataattgattatatatcatatttataaaaagaatcatgtgtactgttttaggagaacatactttaccctgatactttattgttaaaaacaacaaagcattgttctaactactaaaaatcaaaaatttaactttcttttaaaagaggtacatgtatcttcagaaataaaagggatacccagaagataaggtaggtgttctgaaacacgaggtgaaacatttgaatgggttttttttgtcaaacaataaatttttaacaaagaaaaagtttgcattatgggtgaagtatccttagtatctttatacaagatgaaatcctgattgattaaagatacgttactaactttaaatgtcttttaataagtgcttacatgctaactagtatttagactcatacctggcagatacatttagacataagattctaacttagtttcatttctgaggaggcttgtgtattttcctctgtgatacagaaaatagatttttttaagccattttatcttttactttagagttttaattgtttgttaagtggtttataatggtttaattaacaacccgaacaggttttctgtgatttggttggttaaatctatatgtatttggttaaaatattctacgtcaaagttttaaaccaagagtaacttaaaggagtcttaacttgtgtttctctgaatttgatttgtgtttaaattatgaaattaagttttcaaagaacgatttttgtgttcaaaagcttaaggtttcacaacttaattttcctaagtacaatttttttctatcggacttagcctccttttagaagacagttttttactaccaaatttaccattcccatttttttttttacttttacagatctgtatttagtccataaatatccaaatatctgcttgtgaaggttctgtctttaccaccaagcctaccggtatggcaaagacatacagttgctaatctcattaaagatagatcacaatgagagagactcatctagccatgaacaggtcacttctatcagtgttaactgctcaaagttaagtatgacaagaagctatgaagtaaagtttggcctttgtgtatgggagaggaatggaggatgccaggatgcaggtcaaggaaggcatcctgtggaagtaacatttgagctaatatctgaaggatgtgtgatagaaggaaaaagaatgcttcagagaacagctggtacaaaagccctgaggttgaaaaggtggatgtgtcagggaaatgggggaagtacagtgtctggaagaagaaaagacactgaatgaggtgaatgacaggaatgatgaagtagataggggctagagcagattgtaagaactctggaaagctttgaaaactgttgggccaaaaagtagtatgatgaaatttgcatgctaaggactatttttacccaagtagtaaatagaccaggtagaaggaaataatgattggccttctgtttggaagatcagttagaaggctagtttatgaaaactttgaaaagcagtgatggcctgcagcatcgtgacagtaaagatgggagctcaaatggatttgataaaggtttaagaggtaagagaggcttgctgattggatggtgtggggaagggatagataacttcctgatcttggattttatagctgggtggatggtggtgcctcattgagactggaatgctggattaagcaatgtatatgaacagggcatgttccctaccctttaaagagttatgtatatgttttccatgtttttagctatttctccacttgtaatgtgttttagttggttaaaaattatgtacctggcatggatgacgcattaaatgtacttatgtaactgataaaccaatgttacattcttgaaaataaattacattctatgaaaa

SEQ ID NO: 4900 - DNA, 9231 bp, Homo sapiens
gagacacagcggagatagcgcgcctgctaaaggctgccgccgccaacaccttaggtgaataccgagctccaggaaggtcgctgtgggtagggcatgtgggaaacgaggccagggggagaaggaggcctcaacgtggccaaagcaccttgatgatgcgctctgtccccggaggcgcgttccacggccgctgccggcacctaggcagagggatacgttccagaaacacctcagcttagcgcggggatggccttcttgtgcgtgagtccctctgcacacgggaactgtgcgccctgggcactgcaccttccagtatgtgggccggagaggcgggggatcttgcccagcgggtccgacagggcatggaaggaagtaaatggaagccggctggctgctctaagttgatctggtgccttggtcactcgtggcttctttcttctatgccagctctgtcttctctacacttcctctggaggagtaggccttgacacaattacaagaagtcagggaccctgaacagagggaccagctgaagtcacagcagaagaacataaattgtgaagatttcatggacatttattagttccccaaattaatacttttataatttcttatgcctgtctttactgcaatctctgaacataaattgtgaagatttcatggacatttatcacttccccaatcaatactcttataatttcctatgcctgtctttaatctcttaatcccatcatcttcctaaactgaggatgtatgtcgcctcaggaccctgtgatgattgcattatctgcacaagttgtttgtaaagcgtgtgtgtttgaacaatatgaaatctgggcaccttgaaaggaacaggataacagtgattttcagagaacaagggagataaccataaggtctgactgcctgcaggaccgggcagaacagagtcgtatttctcttcttacagaaagcgaataggagaaatattgcgaattcttttctcagcaaggaatagccctgggaaaggaaagcattcccagggggaggtctctaaaatggctgctctgggagtgtctgtcttatgtggttgaagataagggatgaaatacaccctggtctcctgcagcgccctcaggcttgctaggattaggaaattccagcctggcgaattctaatcagaccagttgtctgctctcgaaccctatttcctgctaagatgtttatcaagacaatgcgtgcccagtgggacatggaacctcatcagtaattctaatttcaccctggccctgtgatctcgctctgcccttctgcgcttgtaatcttttattgcctcttgaagcatgtgatctgtgtgatttactccctgttcatacccccttccccttttcaaatccctaataaaaacttgttggttttgcggctcaaggggcatcacggaacctgccgacatgtgatgtcacccctggaggcccagatgtagaatttctctctttgtactctttctctttatttctcagactggccgacacttagggaaaatagaaaagaacctacattgaaatattgggggctggttcccccaatactttggttttgtttttctttttgttttattttctgtatgcgaaagcttcaagtattgatccaacatgttttctaatataagcatttagtgctataaatttccctcacagctcttgggtattggtataccacacatttttatatgctgtattttcatttgattctgggtagatacttttgttattctttgtttgtttgtttctatttcccatgagatgagacttcttctttgacccatggattatttagaagggagttgtttagtttctaagtgtttggaaattttcctgttacctttttcctgttgatttctaatttgattctattttggttagaaagcatattctgtatgatttcagtttttttaatgtcacaggacataattccaaaagtccctgtggacctttctcttctgtttttgtctcccttctctctgttggtcagggtagtttctctttccaggttcactggttctctcctctctcctttccactctgttgtagagcctgtctactgagctatttatttcaattctttcattttgtttgaaattttatttgagatggaatctgactctgtcacccaggctggagtgcagtggcatgatctctgctcactgcagcctccacctcccaggctcaagtgattctcctgcctcagcctcctgagtagctgggattgtaggtgcctaccaccacacctggctaatttttatatttttagtagagacaaggcttcattatgttggctaggctggtctcaaactcctgacctcaggtgatctgcccaccttggcctctcaaattgctgggattacaggcgcaattattccatgtttttattcttttcttttcttttttttttttttttagacagagtctcgcactgtcacccaggctggaatgcagtggcgcggtctcggctcactgcaagctctgcctcccgggttcacaccattctcctgcctcagcctcctgagcagccaggactacaggcactggccaccacgcccggctaatttttttgtatttttagtagagacagggtttcactgtattagccagaatggtctcgatctcctgaacttgtgatccccccgcctcggcctctgaaagtactgggattacaggcatgagccactgtgcccggcctcatgtttttattcttaaaatttttatttgatttttctgtgtgtcttctattttacttctatttttctaccttttcttttgattcaagcatttatgtaattgctcactggggccttttcatgggatgtgctttaaaaatctctttttagagagccctgggtggtggggtgagcatggaagtctgcctccctgccccctccttagctgaaggtggtggggatggagccacatttttttcctgtggtgttttcctagagttgggtggttactgtctaaaagttttctggcttgttaggctgatcctttagtggggcttttttttttttcctctatttccattaccatttccaggttgattcttcttcagctccaactatagaatacatgagatgacaaaaccacccaagtcccaggggccttagccagcctgcttttctctacctttcatattcatcttatgtttgttttaaatataacttccagcattgttatctacacttaataggagaagcagagaaaggtgtttactccattttgtctggaagtggaagtccattgtttttattttttaaagtattttattttacttagcaatcagcagtacatagtagtttgacaaagcagaaagtgcatgcatttccctttcagtgttaactgtgaacacctggctgtctctcttcatgaatatttatggagataagtgttgggcattgtagtaaggcgaaaagagagatgaaaagatgaatggatgaagagacagaaagaaaactggcattgtttagtaataaataggtttaataacaaaaaaattaatgttactcaaatttaaaaagaaaaagtaactagagaactaaagaaattgctgttcttcaagagaactatattgaacaagaggaaatccttgttttgtaatatttctctatgagtgaaagaaagaaggtaagacagttatgagagactcagtatgtttgtgtccacatgattagacattcaaccttgcttacatttcttctccctctcttttgtcctctatggactgttttttaaattgttgtaaaattatttttactttgtcaagatttacttatttaaatttttgttccggacccatatttattcctgtaactgtttttctcaatttaacatttaaattctcattataccatgtgttctacattgatcaattaaatggttccaaccaccctcttacaaggacaaaaaagaaaaaaatatgtctggtcttaacaacaatgtagtaagccaagaaagaaaaataaaatgtataaagattggggtaaaaaaacagccctcattaccattcattctgtagtaattttattccctagttcttcattgtgatcctcccttttttcttgggtaggggggtggatttaagtatcaagtagttaaaatgttctcctctcaacctgtatcttgaataatgagaagaaaaatgttcttctctttgtctttgcacgtttgagaatccctactaaatttattagctccataatacatttttgttctcagagtaattcatagcttttcatctctctttttaaaaaaatcatgttgggtggtgtgtatttcattaaattcatgtccttattgaattactctatagcacaagcatttttagaagatttcttgtattccttggatcttagttttcccagaatgtgttcttccttggatgtttttcataccatgttctttctctcctgtattggtgttatttctgtgcataatgataatgacaggatcctttttaaaaaatattattgatcctaacgtggctggttttagccagacctctaattggctgtgattagtacagatgggttcttgtagacactcctccaaaaatatttgtgacatctgtcttctaagctgcatctaatgcatttgatgttgcattctctgttcctttttaatagcagaggccttggggtaggggatgggagaacctgtctaagaaaacctttagctctttgttgtaggcctgaagactgttctttcccctctcaactttgaataaatactcctggggtctcattctcccaactctacatattgcctcaaaaattggcaagcccctggcagcccctcccagtgtctgcagaagagtagtgtataagggcttctgctcttgatggtgtatttccttgatttttcctctcaagctgcctactctacctgcatctccccatcttttaacagtgcctattaaatgatggcccatcaatattgttactgtaattcctaaactgattttcaaagcattcttatttttttctatcagagataaataaatcatttaggaagagattcatttgaacattcttgtttataagccaaagggtttccaaagaggaatagtttgaagattgacaaaaatggggataatttgtgagagtgaatgcctggagagtatcagggaacatctagaacatacaataagaggatacatggaagggcaacttttcctttgagacaggaagggaaagacatatggatgaaatgagtgaaattatacagagttgggatttcctcttgatggcttcttcttcaggtaaccacagagtctgagcactatcaaaaattcttcctgggccaggcatggactcctagtggattgcctgagctcaggagttcaagaccagcctgggtaacatggtgaaaccccatctctactaaaaatacaaaaaaattagccaggcctggtggcatgtgcctgtaatcccatctacttgggaggctgaggcacaagaaccacttgaacctgggcggcggaggctgcagtgaactgagatcgtgccactgcactctagcctgcgtgacagagcaagactctgtctccagaaaaaaaaaaagggggggcatggtggccggtgcctgtaattccagcactttgggaggccgaggcaggtggatcacctgaggttaggagttcaagaccatactggccaacatggtgaaaagttgtctctactaaaaatacaaaaaagttagctgggtgtggtggtgggcacctgtaatcccagctactcaggaggctgaggcaggagaatcacttgaacccaggaggtggaggtggcagtgagccgagattgcgccactgcacaccagcctaggcaacgagagtgaaactccatctcaaaaacaaaacaaaacaaaacaaaacaaaacaaaacaaaacaaaacaaaacaaaaaaactttctgtacatctcctccacctttcctgtgactatcagctttacacattatgtcaggaacattttctggatagctaaaagggggtgaatatgcttatattttaggagccagtgacattcaagaatgttgttgtagactttactgagggggagtggagataactgagccctccacagaggaatctgtacagagaagtgacactggagaactgtaggaatctaatctatgtgcgtaagagccgttttcttttgttactgaaaatcttcctatttgagggtctttgcgtcctcagttattaacagccatgagtcttcatagcattttactctgctgggcttatatggtcctcaaaaccaaaggttataaaatctagttggcccccaagacacaagatgttcctaatacattttccccaggtaaattgcctttatttttaaagagttgatgttaggagctttctatactactcctcccttaaacctcacagtagccatcattcagtgagccaaactttaaggggttagggctgaattttcagatatttgttatatctttctttccccatgggtgggctgtcatcccttcaaagccagtgttatctcccagctggagctagaagagttgtggatgatgggctgggcacccctaacagccacttgtccagctgagaaatagaagcatgatgttcttggaattggtcaatgaagaagacatttcttacagtgttgtctgaggaattcatctcatagtcatatctattttcacttattctttatctttctatcctattagtttctccttcatatttctgagaggaagatgtgttcttccttaactaagttcacatttccttttgttttcaaacttccttcccttcttttctcactcatctcttcccactcgtctctttactgtggcttgcaagcatgatgactccttctcactccagcattctcagctttgtctttcacagcctcctttctttagtcatttagcttttcatgactctttcacccaataaatagaaattcacgtactgtacattgtcagatctcactgcttcagagcaagatttggttaaaacttcctagaaaggagtttagccacatgtatcaagagttttaataatacccttttagtcattcttctgacaggacccctgtctagtagatatcatagaggtcaacaatgagtcatgaacagttctgttcccttggcattgtaagtaactgatttcaatatcatggcattgtttatgcaaattatgaaatatctacacattgaaaaattataatgttattagaaacatattcacagaaattttcaatgatgcggatagtgcattatgtaaagaaagtaaactatgaaattttaactacacttaaatttagcaatagaaatacttaaatcaaataacacttattacatgttgactctcctcccacctttaaatgcagttattatgatatgctattaagtgtaatttttctccttattttatacccaggcatttcctaagacttgctatttctgtccctccttcctacttcagtgtactgacatccctgtgtattttggttcttttgcccccatttgttcagcaaacatttattgggcaccatgcaggaaaggatctaaagggagcactccaggatgttgagggtagagattgctggtgttgaagttgcaagtcatttttctttccttctttattctctttcatttcttctaaactttccacaatgggcatattttcatttaaaaatctaacagaaagaaacactctgtatgatatatactgttaccatgtgcatttttccataattccttgctgattaaatttctttttgcttctcaaccatcattttggtttctaaatactgtccttctactgaaattacttattcagaggcaaccattagatttcttctaaaaaataggctaggctttttccagttttcttcatcttcagtttttctgacatactttgccattttgattattgactttgggtgtaataaaaatgtattgtggaaattttagaaaatacaaataagcaaaaaataaaatttgaaatcagtgatctcatgtcttggagagagatagctcatgggcatatgttatgttgtatttattatctactatctagaataatcattactcatcatataaaataactgataggcatttaattttatggatttgccattactgatgaaattaggtacctgggattgaacatttaggttattgccaatttctttcctttataaatgatacagatttaaacatccttgtaaatgtcttgcacatttgttccgtcagagcttagtataaaattcttagaaaatgaacttttttgcagcgaagattatgaataacaatcacttaaagcttttgttaacatgttgttgtttttttttcagaagggcaatactagtttgtttacctatccctcagttatacctgcatgtgacctggaacacgtggcagttcatggtttttcattatatttttattactgctgaatttttacatttttcaatgtagttactgaccctttactttttatattttataagctgtctgatcttctcattagcccatttttttcattaatgtgaaaatatgttttcaggatacagagctgcactgtacagtactaatgcatttggctcgtaaggcaactgaaacatggccagttctcactgggacatgctatgagtataaaatataccccagattttgtagacttagtaagaaaagaaagactgtaaaatatctcaatacctgttatgctgaatccctgtttaaatgataatattttggatatattgggttgaataaaatatattctttaattttacctgtattctcttacctttttaaatgtggctactggaaaacttaaaaataaatatgcgcatcacagcacttgtggctctcattatatttctgttgaaaagcactgatacaaatagtcaattcctgtatattttgactacttttgtcttttagctttttttgagttcattattattacaaaaataaaacatgcttgattaaaacattcaaaccatatagaaattcaaaaaaatacaaatctgctataaaaaatctttcatccctctgcagttccaatgatagccagtattaagccattgagtacagaatctgggatatgttttgcttatcataaggtttatgtgtgaagtcacattatccctaattttctaccctccagaggactaaaaacccagccctatcttctgaattattccttccctccacctaagttgt

SEQ ID NO: 4901 - DNA, 773 bp, Homo sapiens
agtccccgcgcgattgcagcgcgcgcccgggaccccttcccgcagccgcctcccccttgctgcgcgacccccagcacttacctgctttgcaaaccggggcgctggggctcctcttctccggcgagcttcggctctgctccggagacctcctccgatgccggacgcgggctgggggtggggccgcgctcacctcgccggtccacaggtgggtgggcgacgagctgggcgacgacacggtgcccagcagcggcggcggcggcggcggccgtggggggctcccgcgagctccaggcgcggcgctgcgcgtggggctggtgcctcgcgtggacgtcgcggacgcgcccgtctgcgtggccaccgtggggctggtgcgcgcggccgcgttcccgccgccgcgcgtggggctggtgctgcgcgaggcggtgcgcgggccaccgccgccgccgccgcctgcggggcctgaggcgccaccacagcagccaccgttgttgttgccgccgccgccgccgccgctccgcgtggggctgccatgttgctgctgctgctgctgcttcagctggaacggaaccgtcgccctcatgggctgcaagcggctcccgggtcccccggccgtggccaccgcaccacccccaagggagccggccggcgtgggggacccattgcgcctcacccgctgggacatggtcccccccctccccggtgactgggcgagacggggggttttgttgttgttgggctgcagggggaggattctcgaggccggagggcaggcc

SEQ ID NO: 4902 - DNA, 1807 bp, Homo sapiens
atttttattttacagacgggaaagactgagtaaatgtgagaaaattagctgaatagccactactttttttctggcataacctacccctgcttaagaacttccacgggcctttgattggggtttttaaccactttaacaaaccatgtaaccctgagagctatgcttgttggacaacatggtgtaatgtaccacaggctgtagagccagatactggggtttgaatccttattcaacatgggaacataggagctatatgacattaaacaactgtcttgtcttcactaaatttctatcaactcatttgtattgtggggataatagagcctgcttttacagggtaagtgagataaaatgaataaagtgtctagacaatatcatagcatagtaggtattcaatcctggtgagatcctgtttataaggcccactactttgtcttatcaggcagaataacaaaggaacaatatttaaaaagcaactagctcaaatctgtccccagaaggaaaaacatatcttgtccttggtccttaaaaaatttcctctgtcactgtctagaatcagcacctaagaacacaggcgtttagtgttgactggaataaaatggaatcgggtgctggtgcagggagattgagcagggatgaagagagaaaatcacagagtggaaaggatcaggtttggagagttcaatggggggctgccaggacataagcctaatatgtgtgggacaaggaaacccctctgaaactcataaaatggtattgtaatacccatctatgaggtggttaggagaattaataagtaagtagaactgtgctttgtgaattgtaaagtgaatttatatataaggtgtcaagatgaaagggaaaaactaagaaataagttgcccaaagatatcattaggaccaggagaccattataaagtatatccaggccgggcacggtggctcatgcctgtaatcccagcactttgggtggccgaagcagacggatcacaaggtcaggagttcgagaccagcctggccaacatggagaaaccctgtctctactaaaaatacaaaaaattagccaggcatggtggtgcatgcctctaatcccagctactcgggaggctgaggcaggagaattgcttgaacccgggaggctggagtgcagtggcatcatcttggttcactgtaacttctgcctctcaggtccaaacaatcctcccacctcagcctcccgaataactggaactacagggatgcaccaccacacccagctgattttttaattttttttgtagagatgggattttgccatgttgcccaggctggttttgaactcctgggctcaagccatctgcccacctcagcttcccaaaaagctgggattacaggcttgagccactgcacccagcctgttgatcatgttcattaatctgtttgaactccatatattaaggaaattagtcctttgtcaaatatgttgcaaatattccctccaatttgtcacttactttcattttgttggtggtttttctgttttgttgttgtttttctgtgggtttttttttttttttttgccatggacatgtttttagtacttatgtagtagtcagatgtattactcattttttctgtgctctggatcttatgctttgaatggctttttgtgaattccaatattttaaaaataatttacccctagcttcagttcttacatttaaatatttgttccttctggaattttagtgaatgtggacaaggttatgcttcagttgccttaactagttgccttggcatcattaataagttttcttttcctctactg

SEQ ID NO: 4903 - DNA, 2764 bp, Homo sapiens
ggtagatggcactggggatttcagactccagaactgaaaacaagctgagcatctggtggagccatccgctgatccaaaaggctgctctctacagatgaatgggtgttaagacagctgtccttcctagaccatgagcagctgctggccagggttgctgcctgccaaaagggtggagttgggagaaaccaggagtcaaccacagctaccacagtctaatgagttagtttgataccagggacatattaggaggacttgctgctgccacgagcttgcacatgactcttctcaactgcagaggaaaaccagtatgatgccaggctagaagcagcagcatcaccatcagcctggtcacattctacttatagcccactccatctgacagcataaagctagacctgccctgggctgctggtagcataaagccagacctgccctgggctgccaaaaaagtcttcctgaaagccatgaatgacatgcaaaggagaaatatgaaacatctaagtgaatatagaggagagggcatttctgatagacactcatgagtcaggcccacaggcttaaaacacagtgatacttgtactggtttcttacagctgctgtgacttaaaacaacagacattttttctctcatgattctggaggctgaaagtctgaaatcaatgtgttttcagggccatgctctctctgaagtctgtaaggaagaatcctccttttcctcttccagcttttggtggtttctggcattccttggtttgtgggaacctaaattcagtctctgcctccatcttcattcacatggcctcttccctgggtctctgtgtgtttctcacagtcttcttatgatgtcaccaattattggattttggacccaccccactctagtatgacctcatcttaacttgattagatctgcaaagtccgtatctccaaataagatcacatttactggcacagggagttagaattttaacatatctttttagggaacacaattcacaccacaacactggcacatgaagagggaataggaagtgtctggatgaatgtgggggagagggtattttcctcctctatagtcacttagacagaaagaatgtcatgaatcaagcccaagggcttgaaatgctccagtgcttctgtagaaaaccagcaatgcctcactcctcactccagcaggatgctttactttccctgtggtaagaccagcaacacttatgattatttgctccttgtatgggtagaagggtcacctgtgtaagtataacacatcagcccacccctaaaattttcagggctccggataagaacataaatggagacccaagaagcatatgtccaattatttcaaagttatatttcatgctacaaattgttaagccaaatatgttctgttctcctattttgacaaatacaccttcattactacaaaatttttataggtattagaaagctgtggtttttatttaactgaaagttggcaaaatatcagatggtctgtctgggtattctgttgaaaggctgatgatgttaggatgagtaataaagacatacaaaattcataaattattatatatttatttcacagaatttactgtctttcctttatttcagaaaatgtactaattatgttgttgttgctgggggcgatggctcacgcctgtaatcccaggactttgggaggctgaggtgggtggatcacctgaggtcgggagttcgagaccagcctggccaacatggtgaaaccccatctctactaaaaatacaaaaaattagtttcaggattatttgcacatattatttgtttctccttagagtcatttttgtttccaacttcaaattttcttatattttattgatatgtcatttttattgggtaactcacatgtagtttctattacttataaaaatacatttcataattaaaatactatgatatgttatatacatataatatgtgtgtgtgttaaatcttttaaaagtaaaagaagactagatttgtttagggttttgtaaactttttctagcattattaatagcacccatccatttataccaaataactgtgcacaaattatactaattataaaatttattctaattataaattactttgattttctgtgatgactacaattttctttttgagcatcttttgcttaactctcttggtgcaacttgtatttctttatgtgtccaagagatgctgtaaggtttaatcaaaacatttcatattttaaaagaaccagaaaatattacatataatctatgtactattcccaataatgtcatggataagggcacagtaaaggccatgcctcctagtaataagcacaaaggaattacacaaaagagtgccaagtacaaagatagatttggagcaaactcttggcttgtgcaccttttcctttatcagccatgttagcaccattttcggaggcttgtcattgattaacttttattttgaaagagagatctgttaaagaatacaaaattatagccagataggaaaaataagttctagtgttctatagtactgtaggatgattatagctaaaaatttatagtttcaaatagctagaaggaaaacatcgaacattcccaacataaagaaatgataaatgattgagatgatgaatatgctaattaattaccctgttctgatcactctgcattacatgtattgaaacatcactacataccccaggaatatgtacaattattatttgtccattaaaaacataaaacatttaaaaagcaaagaaaa

SEQ ID NO: 4904 - DNA, 4358 bp, Homo sapiens
taattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcctccttagtagctgggattacaggcgttagccagcacacccagctagtttttgtttttttagtagagacaggctttcaccatggtctcgaactcctgacctcaggcgatccgcctgccttggcctcccaaaatgctgggattataggtgtgagccatggcacctggcctaatactacttttaactaccattttcactttttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagtaagaaacacatctccacaaaaatttaaaaattagctgggtactggggcatgtgcctgtagttggagttactcagaaaggggggaggctgaggcagagttggaggctgcactgagctttgatggcaccactgtactccagcctgagtaacaaagacagaccctgtctcttaagaaaaaaaggttgattccaggcctgtagaatagataaacagcatgggatatgagggaaatcctcagcagtattaattttgcattccaatttcatgttgatgatatacacaatggctttttgttttaaaggcttttatcttgagaacatggtgtctggagttaaaggtatgtctcaatttgagttttcacatcatatttgtttatgtgtaggaaacagtatgttgtcagagcaagtttcattttattcagggacatttctaccatgcttttaattcccatttatactgatttctgaaaagaagaatcctagattcacacattttatagtgatgtgtcagattcattttagttgcaagcattagagggtcctgaatttgttagtttgtagcaataatcagaactttggatttcctacttgaagcctacagcattattttgaattaatgcacaatctaaaatgaggcagaggattttatggtttaatgcaaaatatagtataataaaagatgattacacaggtcataagaattcataaatttgaatgatgtagagtttgattaaaagttatataatgccaaagtcgtaacttacaggcacattatattcctgtattttataatggatgacaattaattttgagccaagaattaaaatttgctgaaatcttcgaattgggaaaacaacatcctctgttgcaatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacact

SEQ ID NO: 4905 - DNA, 3788 bp, Homo sapiens
agctccaagtcgaaaggaagcgacgcatgagttgtttggtgcggtgggtagatacctcgagtttctcctcgcccaccgtaggccccgacccctaaaaaggaaacttttgggacgtcagagtgagaggagaaaagtgtctttttagtttagttttgtcaaacctgaggattcgtttttcagtttagccggagctgtgccgcaaacgtagctgccgacatccccacgacgcacccaagtggtggcccggaagctggggatagaaaagtggcctccccgaatgccaggcacacaggccttactaccagaagcttgagctgggagcctcggccgtcgcatctctaaggtgcagcgatacggccaacttccttccgcgaagccctcagggtgggcaacggagcttttcaccagactgagggaccgggcgacctggccgaccggcggctcctcaccgcccccttggggatttcttgataattctttgccacgatgcgggcggatgttgtggagctactgtttgtagatcgcagtagcgtgacagcacttaatcatgactactaaatcctcagaagtcgaaaaagcaagtccatacagaatagtttgaccctaattaaattgcgcttacaagatacagtttgtttactgggactttggctaggtcccatcccgtctctgcctcagagtggtggttgctcttagcaccaaggaaataccagcttgacatttgactctaggaagcacaggcccaaaagaagaggcccaaggagggacattcttctttccctttcctacctacagtttctcaaaccaagtgtcagatggaaagcaaggggtggtatcatcgtaattatacagttgaccatagaaaataaatttcaatctcaaagtaaactcctaggccacccccagaatcttagagtttctcaatcatagaactcatttcttgtcacagtcttggttcttagccaatgtaaaacacccaactgacagggaaaattaaacaccttttaactcccacacaccttaaatgagaatttaaagtatctttcagcaaatgtatttataattttgagtgcttttagccatgttaaggacaaattttctccttctgaatgcagtaataatttggcattacccttttggcagtgtggtacaaagtcttataatctaggctttatggagctattgaggaacaacatagatggcttcatgcaaacccaaacaatgtaatagtagttcttttctctgtagtcggtctactgcctgtagatgtttattccttttttttttttttttttttttgagacagggtctccctctgtcacccaggctggagtgcagtggtgcaatcatagctcactgcagccttgacctcctgggctcaagggattctccggcctcagcctctggagtagctgggaccacaggcacatgccatcgtgcagaattttaaacggaagaacgcagaagaattctctttatgttacctttatttagcaacaaatcaacttgactcaactgatacttactgagtgcctttaaaggtaagtgaataaaagtctaccccttgtaaatccacttcaaggaatttgtaatcaaatattgatgtttgaggataatgggccttcctgttacttcttagtactaacctagcttacactctactttcctccctaaagtttacgcaaactttacaaacctattaaaatcccattccttctgtgaaagaactgctctctccttccttgaattcctatagcatattaattaatcacatacttatttgtaatatcttctcttgaactatttaacttcctgctcttcctacctagattgtttctctcagaagaaaggattttttacttttctgtacttgtgcatatattaagacctcatttatatggaactctttgggaatggatggtatgggagatccaagtttttaaatagttgaattacgtgtcaaaacaactattttttattaaattctttctggaatagactacctacttatttcattgtttttttaagcacagagggttaacatgatgaacattagctcttataccatgttctatagaaagatagtgggacaactggtatggagtagagggctaatatatacgtctccagcagaacccctaagtgtgtgttctttatcctttttcttatcaagttagaatgaaatatgagcaatggcatacaactacaaactgtaacttgactagctctctgcaaaattaatgaagacattagtctaaaatattcaagtcaccagaaaaatcttcacagttcgtagtaggttgtgtgacttgtctgctttattggctttactacaacagatcacatgcacctccctgtcagcttgtactctttcccttgtactccagcctatggatggagaatgaaaagaaatatttcataattttaaacacctgtggcaaagaacttggatacaacttaccccaacaaccagctgattgttcattattgcaaaatatctttttttttttaaacccaacgcatttttctggatgtaagaaacaatacaacctttattgttattgctctcataatgaacgaactttttatgaaacgtactatttgttgactaaaaagttgaattaataagctaataatggagggtgtggcggaaaaaaaatactagaatacaacttaggtagctttttattgtacaatcttgtttcttccttcaacctaccctctttgataagaaaaaccgaagtggagatacctaaggctttatagggggaatggagctactcctcaatttctttatcttgcctctgctgttcctagttgctttcacctttagctactatcaccaatctctacttgcagtttttagtgtgtattgacagcctcttctcagctttcaaataaaaaggctgatgatattttacaaactgccagctaagcaatggtgaagtgatggttttatagacaagtacaattttccttccatcacaattgttttttgctagttactttagcaacttttctgcttccaaacaggctacagctaaaggatgagggatctgcaaagctggatccttaagctacctgagatattcaaataacgcttactgatatgatttgatttgttctaagaaagggcttaggaaaaggtaacaaaaattggcttaatgtttacattttgtttcactacactatgttaggtcacctcacaaaacttacttaaaaagcttcccaaattgttcctggtatccctgtcttcccatatattcaggttagactctcagtgacactaatcttctaatgacctttcttcctatcatttttccatttaggactttctaattccatcaggtctgaactcctatttattataagatccattcctagccctcaaaactcatactatatactaatagatagcatatgttccataaaaactatcttctatctccacaggctaaaatatcctttttacttctgcccttatttcctccctaaaatgtcttatattttcacagaaagttcccttgaagcccagttctagtaccctgcacactgaaaagcacacaggagggactaaaatacttgctttatttgatctgccagttaatttgggagaagtaactaatatgacagaaattatttaaaaatcaatgttttctgaaagcttatgttattaaaccttttatttccttcaacattactaaaaatttaagaatcccctttaaatttttccataaagttttcaggatgaatttgtcacataaaaagagccactcattttcatgtta

SEQ ID NO: 4906 - DNA, 1114 bp, Homo sapiens
tgcccgcgcaggctcataggcagaagggacttgacttgtctcagataccctattttaatcttgtgaagcatttaacacctgcctgtccaaatgtatatagtatatcacagtttcatcacacaaccccgtacagcaaaacacacagtggtgagaaatacaccgatcctttcaaactcggttggagagacttgaaaggtctgtatgagggtattagaaaggaaccgctcatatcaacaacagaacttaaggaaatctctgagtactactttgatgtaaaaggaaaagcctttcgatcaattattgtggtactaatggcccgagcatgtaatattcatcataataactcccgacatgtgcaagctagccagcgcgccacagccttaattgcagaaatgatccacactgctagtcttgttcacgatgacgttattgataatgcacgttctcgaaaaggaaaacacacaagatctggggtgaaaagaaggctgtccttgctggagatttaattctttctgtagtatctataggtggggcacaaactggaaatacagctgttatatctattttaacccgagttattgaagatttggtgtgtggtgaatttcttcagctcgggtcaaaagaaaatgagcatgagagatttgcacaataccttgaaaagaccttcaagaatactgcgagcctgatagccaacagttgtaaagcagtctctgttctaggatgccccgacccagtggtgcatgagatcacctatcagtacggaaaaaatgtaggaatagcttttcagctaatagatgatgtattcgacttcacctcatgttctaacataggcaaaccaacatcagctgatgtgaatctcaggttagccactggtcctgtcctatttgcctgtcagcagttcccagaaatgaatgctatgatcatgagatggttcagtttgccgggagatgtagacagagctccacagtatgtattacagagtgatggtgtaaaacaaacaacctaccttgcccagcagtactgccatgaagcaataagagagagcagtaaacttctcatccccagaaagagacgccctcattcaactttcagaaattgtactcacaagacataa

SEQ ID NO: 4907 - DNA, 4349 bp, Homo sapiens
agagaaggggtttcgccatgttgcccaagctcgtcttgaactcctgaggctcatatgatctgcctgtctcagcctcccaaagtgccgggattacaggcatgagccaccgcacctggccagatatgagaagttttatctgtttcctagactaggggtctgccaactttttctataaagagccagagagtaaatattttaggctttgtggaccataaagtctctgctgcaagactaaattttcctgttgtagttcaaatttgccatgaacaacatataaatgtatatgcatgctatgctctaacaaactgtatttgtatttataaaaagaagcaatgggccaagtatgctgacccttgccctagactactaatttatggcctactcaatcaaaacattctttcaaagatattgacatatctttacacagaagaaatttctgaaaacaacgtaagatatacaaaagcagaaaactatagtttgtcaaatctttgttcattttattcaaacagcaaatatctttaccaaaactagactccagttttaaaattttctcttgacaaacaggctttgaatctttgataccttataatccatcatatatatatatatatggggatgggcctcactctgtcgccctggttggaatgcgcggtgtgatcatagctcactgaagccttgaactcctgagctgctggaattacaggtgtgagccaccacaccgggctatagtctgttatgtctaagaaccacccttacttccaactagacttaaggcaaatcctgatcatattatttcatctacaaatactgttatatatctctaaaaaataaagtttcctgtaataagtacaataccattatccctcctaaaataattaacaataattacttaagaccataaaatatctagtcactattcaaatttctctgattgtcccataaatgatgttttttaaaaacagttggtttgcttaaaacaagatccaagcaaggcctaacacttgcatttggatgtcttttttttttttttttgagacggagtcttgttctgtcgcccaggctgaagtgcagtggcacaatacatttggatgtctttttaagcatcttttaattcagggtcagcaaactccaacctgcctttacagagtttatttatagccacatgtaaacaaactggccttcacacctggctttgtaaataaacttttaccagacatagccatgctcatttgttaatgtactgtctacgactgcttttgcatttgtgacagagtctatatggtctgcaaagcctaaactacttttatctggcaccctttacagaaaaagtttgttaactcttgtttggtctccttctctttttttctatttatttgttgatgataccaggccttttgttctgtagaattttccatatcctgaattttgctggttatactcctctggtgtcatttcacatgtcctcctgtattttccatagagaagaagttagacctagaggcctgatttgattcagatttagttctttggcaagaatacttactattttgcagttggtattgtatactacttctaattctatcaaattaaaaggtacacactctttgggttatctctctgtgatgttactattgatcagtttagttctagtgccatcagtttaagccatcaattatgaagttgcagaaaaactatttaatggttttaggaaggcattttcacagattttaaggttttaaaacaaaaaacaaaaaaggcggcactgatgatcactgcttacatcaatggttctcaactgggagtgattttccttccagcagacatttggtaatttggaaataattttggttgtaaactgagggggacaactggcatctaatgggtagaatctagggatgccgctaaacatcctacaatgcacagaacagtcttccacaacaaaaaattatttggtctgaaatgtcaatactgccaagattgagaaaccctggccgaaatctattatttcagcatgggttgcaaaattataatattctaattctatcattccttctgcatctattatctaaagattttcactgtttttttttgagatggagtctcgttctgtcgcccaggctggagtgtagtggtgcaatttcgcctcactgcaaaactccacctcccgggttcaagcaattctcccgtctcagcctcccaagtagctgggactataggcacgagccaccatacctggctataacttttttgtatttttagtagagacagggtttcgccatattggccagagttgtctcaaactcccgccttggcttcccaaagtgctgggattacaggcatgagccaccataacgggctagctaaagattttctataaaaaaaactttgtcatatcaattactgctaggcatggtggctcacacctgtaatgttatttttaagcacatgggaaaagaatatttcaagaacaaatttgtcaagtcagtgttttgaacatcctattattgtcaacagatgattactggcaaatcaaatggtgtatttgccatttaagaagaaaaagtattagattagcagaaattttcattctcggtatttgttttaagttaaatagatctattattaaagcatttcccaaactgtcccaagggacacaaggtttcaaaagatatattctagaacaacaaaaaagtgtcatggtatcaactaagtttcagtatgttaatatagggtaatagttcagaatgtagaccctgtagccaaactgcctggttcaaatcccaattctaccacatactagctaagtgccctggggaaagtcacttaatctctgtactttgattccccccactccgtaaaaagggataaaatcaccacttatttcatagagcagttgtgagaaatataaggatacctatgtagcactcagatgaatacctagcacatagtaagtgctacataagtgtttgttattatagtaaatatattgccataagacccagttaaataggcttcttgactacaaagctttagggatgcttttttctcctttttttttttaatttttcttttagaactttagagatgcttttttttttttttggcggggggtggggaggggctcactgaaacctctgcctccaggttcaagtgattctcatgcctcagcctacagagtaggtgggattacaggggtgtgcctctatgcccagctagctaatgtttatatttttggcagaggtgggatttcaccatgttggccaggctgttctcaaactgctgacctcaagtgatctgcctaccttggactaccaaattgctggggttacaagcatgagccacagagccctgcctagagatgctttaatatgccaatgtgcatcatctattctccagaatgcacccatgtgctgaatgtaacatatcccgaacttacccaattatttttcctttggaaaactcttgatcatctcatgaaacattattccttaaaacataattaaaatattcagctgaaaggccatatagattatactatcccagtggctattaacagacaccaagctcaaaagaagttcctttacccctaaggataagggaaagaatccctaatagggttttgcatacttgtgggatgtatggcaattaaagactaggggcatttggcagtaagggatagattagtaaagagaattaaggaagggaataatgtgcacctatagattctctaaaactggagaagagtaggaaagaaatgggaaaaggaaaaacgaagttctttggttaacatcaagggaacttacaagactgtggtattatgtcaacaatgtagtactttatataaacgacagtcattggctgctgcttttctccatggaacagtgagtggcaaacaaagctgtgcatacctattcagatatgtttagaatatagcagactaactttgatttcctctaatctgtgtctctgaactgacctccttttatcacattagaaaaactgaagaggctcattcactcatctatgttcctcccctcacctccttgtcatctagccaattctgatgtgcagatgtgtccacagtgactcaccattacaattcggtaatacttaccgtttaaagtcaaaaagaggtaaagaaactttgcccaaagcttctggtccctttctctgcttattagaatcaggggaacttccactgctctgatttaaaattccaaaaagagtaaggtgaagaactgattctaatggcaattgtgatatctggataggaaaaatgattctatggggggaaaaatgtattaatagaacaaattagattgaatgattttgaaatttaacactttaat

SEQ ID NO: 4908 - DNA, 8547 bp, Homo sapiens
gttaaacggggcagtctgtgtcaaaagagcttctctccagagtagaaaggtaggtacgctcagagcggctttcttttcttttctcttccagagatttattcttgtatgaaggataaagaggtattgaaataaggtttttaccaacacagtgattaattttttgtgtgcttatgtacttatccatggctatagttaaaatgatttttaatatttttcttaaaaatattatttttttcttttgggttttaagcatttagcaaatctcaaggttttaatttattcatttaacaactatttgttgaatgcccactgcatacacaggcacttttatttttatttttttgagacagagtcttgctctgtcacccaggctggagtgtggaggcaagatcttggctcactacaacttccgcctcctaggttgaagcaattctagtgccttagcctgccaagtagctcggtttacaggtacgcgccaccacgcccagctaatttttgtatattttgtagagacggggtttcgccatgttggctaggctggtcttgaactcccgacctcaagtgatccgcccaccttggcctcccaaagtcctgggattacaggtgtgagccactgcccctggaccacaggtactttaaaaaccacaataggtagaaactctatttctaataaccaactataacaattctaaatatattttactgtaaattattgagtacacaaaacaataacaggtaactattcagctcacctcagatttaatacttaaacattaaagaatatcaacctacttgcaagaaacttaacaaaacctaaggaacataatacaaataaaactttacctatgcagattataagctggatattataatatccaggaaaatatccaggatgttagaatggcttgaaacagaattgaaaatttttgagctataagacacataggagaaattttaagttcattttttttgggtgagacatttattagtctcaacaagactgaatgattttcttttaaggtcacacatttaaatagttaacaggagaaataccaaccagaatcatagtcaaatacccacctactccctttccaagacaactaaggtctcaaattgcgcccatttttctcaaattatttctagaatatttagcaaaagaggcttttaatttggcatgtctttgtctacaattttgtagtttatgtaaagaaaggtagactaagggaatttcattttaaaggtgagaatcagaatgacatttgtgaagctatgatgcctgtgccatctggcatacacgagggtgttgtactaaatgggatcagaatgagctccttttggaaggaaacctttaatagactgggaaacattaagggaatcttcccttttttatttattttattttattttatttttttttagatggagtctcactctgtcgcccaggctggagtgcagtggcgcagtctcggctcactgcaagctccgcctcctgggttcacgccattctcctgcctcagcctcctgagtagctgggactacaggtgcccgccaccacacccggctaattttttgtatttttagtagagacggggtttcaccgtgttagccaggatggtctccatctcctgaccttgtgatccacccgcctcagcctcccaaagtgctgggattacaggcgtgagccaccgtgcccagcctcttatttttaatagagcattggaaaatgaattctgtatacctggctaatgaaggaaatccagattcgttgccaaaaccaagttttaaaggaatttgcaatccttcacagttcattcaaggaggcaatggaaattttgatgaagaaattttttaaaatctttcttaaaaggagtccttacattggcattgtatcatgactaaagtcttcctccctctctcccttctatgctttttgtttctgttttctatctttcaatgacatcagtttcatggatataaatggttaaaagacaatgattacaacacacagttgagtgacacaaatcttgttgtagtgttagaaatacatcaatacattgggatcataaagagaaatggcaagaaaaaaaatcttaagttaataacagaaaatgctgattcccacagtccgtgtagaaaataacacgtttttttttctgtcagtggagataactgagactagttaatattgtcaattctgttccttctgactgagccaggtgaggcaaaatttagcatatgagttgagggacaaaactattaccttggcaacataaaaattaatactgtctacattgtttactaggaaatgcatgcaaaattaatacactcttggtagtacaggttcgtttcacttctatagtgtgtggttaatagaaagctgattcaacagacgatagattcaacagacgatgtagaattgtctaaaatccagccaggcgcggtggttcacgcctgtactcccagcactttgggaggctgaggcggcagatcacaatgtcaggagatcgagaccatcctggctaacattgtgaaacctcgtctctactaaaaatacaaaaaaattagccgggagtggtggtgggcgcctgtagtcccagctactcgggaggctgaggcaggagaatagcgtgaacccaggaggcggagcttgcagtgagccgacatcgcgccactgcattccagcctgggcgacagagcgagactccatctcaaaaaaaaaaaaagaattgtctaaaattcatcgtcggtgagtccatggcatgttttggaatttattcacttgtttgcctcaggaacagtagctgttcagatttgttctgtctttgattttggaaatgaggttaccgtgctctgtagtgtgaggaagatgacatggcataattaggcaaacggctaggcattttctcagcagtaaattaccagtgcccttacttgccatgatacccacaacaggcagaggcagtttcctgaggcaatccaggccacaaagaactgtacatttggggaaaacatatcttcaaatatatatgttaaactctaaaaaattggttagtatgtattacttttgtggatacttaaacattccctatgcataaagacctagttaaagagatgcaggcttttggcatgttaaataactccttgatgagaaatcacactatgaataataaatatgacttaataaaaatgaaaaataatgagattagttactattgaactattcttgcttagaatgcccctgaatttcagtcattgaaattcacttgtacctgggtaagttacaagttcttatttgtgctggtttctgttccattggcaattaaaattttggtaagttgaataaaagatctttctaaaaagggagttttttttttttttttcttttttgagggggacggagtctcgctctgtcgcccaggctggagtgcagtggcacgatctcggctcaccgcaagctccacctccggggtccatgccattctcctgcctcagcctcctgagtagctgggactacgggcgcccgccaccacgcccggctaattttttttgtgtttttagtagagacggggtttcaccgtgttagccaggatggtctccatctcctgacctcgtgatccgccctcctcagcctcccaacgtgctgggattacaggtgtgagccatcgcgcctggccaaaagggagttcttatattggcagtgtatcatgattaaagttatcctccctctttctctccctcccacatatatattttcgtgtcagtatatgtatatgtgatttgtgctatttgtgtgtgtgtaggtaaatgaaagtggcatcaagagaatctcacattaaaaaaaatttgagatagtacaattcttatgcatcatatgttgcataacgtttgactattaagaaatttgcatcacacgtctacttatttcattaaacatgttacagtcaattaattcacttacaccctccatttccttcttccccctctctcgttctcctgctgcagggtcattatacgttcctactcacaaaatgtccttgttttttcccttactcctgtcattgatcttctgaatctttccggcgaacttaacatggatgttttgatagaaagctctggcattaactctggagttgttttgcaaggaaggttgttcgctttttcaccattttttttttttcaggtccttgaagtgttttcacatagatatttcacaagagccatttcagaattgagaacatttggcgtgcactcttcctcttttggtcccacagtttttatgtgtcctacttgaaattatgtttgctcccgtttcaattgtaatattgcacttactcattagtttttagtttgaactctcctgcgaggtctaatgtagagtttggacaagaacacagattcataataaacctacccagtcaatttggtataaaggcttagaaggtggaactggccacattttgaattggaggtaaggatcaggaatgctaatggagagacataggattttcttatggaaacaagaaacaaataacctctgggcagtattagagcccagagagtgataagcctcttctaacttcaatattctatgtacaaattcacaagactttttttttctttcttttttttgagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatattttaccatgtttacatttgaatggatgactggaggtacatctatgatgactaatactttctaaacacatatttacctctcatatatctgtgtaaatgattgtaagaggaaggggaaaatagagatgtatcattaggtatactgtcttaaagcacattcagctgctctcatgtttggagaattttgaatgtgatgaatgtttctctttcaccgctaacaggttgtatgtgtgagccacattttattgcaagtgtttgaaaggccattgcaaatatgggatattgccagacagtaaaaagcaaattgagtctattgagaaattaattcaccagctgaaggaagtacatttgccttagagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttcttttttcattctgtcctcattctgttggtttctcagttttacggatgcaggatcatgcacagaaccctgtaaatgagcatagttcgtttaagtatataaagtgctttcggtggataaaatgaattttaacaggcttaagtgatgtgcctaaatgcacacaattaatgcatggctggaattcaaaatcatgtcttttcctctgttctgattgttttataaatatgggttgttttaatgtgtggctggaattcaaaattgtgtcttttcctctgttctgattgttttataaatacaggtgtagtgattgattttctacccaccatgacagggaataggttcaaaacttaaaaccctgtttgttttataattaggtagactcaaatgacaggtcaaggcagggaggggagccagtcatttttactcccatatgggtttgctccttcaaagacaggattggggtagcagtgtcagttcctacaggttataacgatcttaatgataaacttaaataaccgtaactgaatacttataatgtgctagcacttttcataatgtatcccaataatactcacaaaactttccaaatattacctttttgttgtctttgttttattttgttttgttttgagacagggtctcactctgctgcccaggctttagtgcagtgatgcaatcatggttcactgcagcgtcaaactcctgggcttaagcaatcctcccacctcagcctcccaagaagctgagactacaggcatgcaccaccactcccagctccaaataaatattcttatcccattttactgatgcagaaaaatgtatggcccagagaagtaatgttaagtttattgggggatttaagttgtaaaaaattattttatcgaaccctaatgtaaactgtggactctgggtgatagtgatgtgtcagtgtaggttcatcgattatagcaaatgcatcattctggtgcaggatgttgacagtgggggaagctgtgtgtgtatgggagtagggagtctatgggaactcttctactttccactcaattttgctgtgagcctaaaactactctaaaaaatgaagtttattaatcaagaaaaaaattcttatgttttatgaatatatgggacagctattcatgtatgtggtaaaaatgaagagatttgttacagtactcggcaggagtgtgtctaatcgactgatattcatgtgtcacttataaaaactggcttcattatcaatctatagattcatttcatttgtgtatgttcgcttaagggcacacacatggaaaccctttggtgttattagaggtctgttgggagggctcctctttggtggaagctatgtctgtttctcagaagtgatttaagagtaagatgtgaaatagcacttgtccccgaggatggagccaacagagcacagagcataggggagttatgtgatgctgtctctgagggactggagagaggaatataaagagcttatcccttaagaaagaataggggaggacttccttgcctgatatctcagatcatgaagctacagttctctccctgctttagagaaaaaaaaaaacagactttttgcaaaaatcaattattgaacatattcctatattctagatttataatgaagcatttttgtacatattcattaaaaagagcaattagaacatttttctctggtttatagtaactaggatggcaacacatatatatcttggaagtattttgtggtatgattcttcaacataaaattatttttcaaaacttcttagaagtctccaggtactcaggaataaggtcattttaaattattccttattgactataagaaaaataattaggcaagatcacaaaataaatgtttagactgtttctcctgtttcctgattttcaggttattttttatcccaattttattttgctgtatagtcataaatttcatctttgaaataaagcatataatcactttttttgtttgtttttttgagatggagtctcgctctgtagcccaggctggagtgcagtggcgcaatctcggctcactgcaagctctgcctcccgcgttcacgccattctcctgcctcagcctcctgagtagctgggactacaggtgcctgccaccacgatcggctaatttttttgtattttttgtagaaacgaggtttcaccatgttagccaggatggtctggatctcctgaccttgtgatctgcccacctcggcctcccaaagtgctggga

SEQ ID NO: 4909 - DNA, 6411 bp, Homo sapiens
aaacagcgattcttctgcagtgaatcacttccagaaatgaatagccacagttttttggaatgaacgttgtgaaatccctcctttataatggcaggttttcagttggtggttttatcagaatttctcaagatcaaaacgaaaccttctctttaaaaaggaaagaaagtactatcgatacagaaagcaaaagtatttccagtctcctactgaactgtcacggcagacctctctgtatctatatttagagctgtatgtccatatatttgcctgaatgtgtgagttcttggaagtatggattcattgccaggagctggtgatttcctaagcagaggtcgctaactacaagaaatgttacactcggacaagtcctgcgcttggggatcctctgtacgcccgttcactggtgcaggtcttctgaacaaatgcctcctgaggatttctgtgcctggaaaatatctgttaacagactgcttttacacctacctatttggtgctacttctactcctcatgaccaaagctggctttcatggtttactcatgtacttactgatgaaaccctgagacttggggccagtgactgttcagaggtccatgtgaagatgcgctgaatggtataaaggacagagcagtaaagagtgctggctgaatgcctgggctggcaatcaggcatgttggagtttgagtcccagtctgccactccagctctgtgaccaagaggaagtgaagtcatgtaccctttctaagtctctagcccctcttctgaaagacgaagatgccaccaccaaccatgttagtggttgtgaatgccaagaaagtccatgtgaagcacatagcatagtgtctgccatgcgttaagtgttccaaaaatggaagctatgactatttcacagagtacacttcccatcacttttcagttcattttggccttctccctcaaaagcactccagtgttctgatccagctgataaaacaccaaacattcacatagtgctttaaaagtgacccactgtttttacagactgcattacatatgaccctaacaaccactgcaatatagaaattcgcatctccattctccagatcaggataccgaagctcagaaaaattaaatgatttgcccaggatcacatagttagtaagcagcccagccagatcctgtgttaacttgttcatccgcttcctataagaaaacatccattcaaggcacatggggcaacaaagaaggacttagagctgtgtggcccctcgtcagggcagtaccagttgcacccatagtccggcctgaatactcagcttaggactattgtgtccaatgtcccaaacattttgaagctacatcttaaagaagtgtcctgctcagatgcagttctccttgtgaaatccgcaggccccaaggaaagtgactttaatccagtttgctcatgcaagaacagactggcatttcacatccaggaaaacaatggatttgtactgttcagcttttgccatgcaaggagttcctggtgtggtttattaatttacatctcaggctccagcttcactatcaatcagatttggaagaaaaaagttacaaagaaaggcagcttgctgagaaacagcggaagcatgacggtacagactgggttttgaaatggagacacattctcatggcttgtgggctgagagacactgagaaaggattttgttcttgaaagatgattgttttaatgctggagatggagagttttgacaattttaagtgcatgttctgtgtgtaagaaagagtcattacgttttttttttctttcagatgttgccatgccttaaaattgctgatgattaaaatagaacatcctgagttacagaaattcagccctagtgtatcctggcctaaaaatacagaacaatcaagttgattgttggaaatgagaggctaggcagggttggaaacatgctaatgtttactgagtgaaatctttccttctcagtagagttgcccttgcagctgaaagtcactgaaagactcaacaaaataagcagatcccacttgtctcactctgttctcctatgcatgccctggaaagagaatgaatgagccctttttaatttatcaactggttttcttccatctctttactagtgagccatgggggttttttgccgttaactgggtagccagtctcttcatggagacttattttcaggaaactagcctcttgctttatgtgaaaacaaggacccaactcaagatgtcttatcacagtgtgttctgttgcgtaacagttgcatctgtagtccagcctcaatactcaggttgggactgttttgtcctgatgtctcgaacatttcaaagctacgttcttaaagaaatgtcctgctcagatagagctctccttgtgaaatcctcaaaccccaggggaagtgaccttaagccagtttgctggcttttcatgtcacagaaaacaatcgactgccactactcagctgttgccacacaggagtacctggcgtggtcactacttgccaactcagtaccccactttctccccaaggacataaaagcaatgtgggaagatataccaaatgaccttgtcacactgggctaatatgaagagcccacagatgcaaaataatgtatcatacctttattcttctgattttttttttttttttttttttcggagacagtctcactcttttgcccaggctggaatccagtggcgcgatcttggctcactgcaacctctgccacccgggttcaggcaattctcctgcctcagcctcccgcccagctaatttttgtattattaattagtagagagagggtttcaccttcttggccaggctagtcttgaactcctgacctcgtgatacacctgccttggcctcccaaagtgctgggattacaggcgtgagccaccgtgcctggccttttttttttttttttttttttttttttgagatggagtctggctgtattgcccaggctggagtgcagtggcatgatcttggctcactgcaacctctgcctcccaggttcaagtgattctcctgcctcagcctcctgagtagctgggattgcaggcatcccatacccggctaatttttttgaaacagaggcttgctctgtcacccaggctggagtgcaatggcacgatctcagctcagtgcaacctccgcctactgggctcaagcaactctcctgcctcggcctcagcctcactacaggcatgtgccaccacgcctggctagtttggttttttttttttgtatttttttagtagatatggggtttcaccatgttggccaggttggtctcaaacttctgacctcaagtgatctgcctgcctcagcctcccaaaatgctgggattacaggtatgagccaccacgcttagccttctgctgaatttttgagaagcatacataaagacaatgtaaaaaacttagcatatttgtttggccctgctaagggcatggttgaatatatagtgtgtgtgatgtatttggtgtatgagatatatatgatcttatcagacataagtaaaagaaattcattcttcaggaaaaattttccccataactgaagtgtcaatcatttgaaaaaacttctaggcagtaggcaaacactgtgactagttatttatcaaaaataagcagactttagagttttgtaactgatgagaataatctggctgcttcttttgtacttcagtcactgatactgcgaattagagtagcatatacagaaggatgcagggggtccctaaaggaatcacagaattagtgaaaccattatttgagagttgcagtgattcttctgtcctggcacttttcccagttttggtgcttaaatttactatccacttgaaatgtgtcactgcctgtcacttcacaaagtatgtgcctttcactgcagtcaacaagctgtttacatctttgatgaaatgattgccacgcatctccatagccctggtgttctattcccttattcacagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattggagcctggttttcacaaggtggtatgtcatgataaaacaagccaaagaaaaggttgggtagtgttttgaggctaaaagagaccaaagagtcttagtgaatcaaccttgatgcgatctgggtttgaaaaacctataaaaaaccttttgtttggagaaagtgggagaagttggatgtaggctggatatttgtgggtaccaaggaattgtttgttttcttaggtatggtaagattttgtggttatgtagaagagtgtcttcattttatagaacgacctcaaagtagttaggagcagtgtatgtatgggtggttatcaatttactttcaaacaatgcagcaaaaaatatgtatctatattacatataattaaagcaaaacatgataaaaaggaatagttattgaatttagatagtatggatttaggaattcattgtattgtcattccaatttaatgtataaaattttttataacagtttataaaaacagtgcacacccctttaattaggtggcctgggtacatgaagtatctttttggatgcctagaacacaaaaagggacgacaacaggccacctaataagatgataccaagaactataccatgacggcgaaaaagaactgctgcaaaaaataatttgccaaggagaactcagagtacaaagccttacctttggagtagagggaaggagagtcttaagtaaagctcacaaaaacccctaactcatagatgcagtctaaggaattcattccggaagcgacattagcatctcattagtgccattatgtgacttacttggcctctgagctagtctattttcttccctagaccccaaaatctcagtaatcctttggatccaagttatctccaagtgaaaataataggtttaggaaagcgtttttcttcaacttctatggagcacttgcttgctttgtcctatttgcatgtccgacggacggttctccagcaccactgctagtcgtcctccgcctgcctgggtacttgatcacaggatgcctctgacttctcctgcctttacccaagcaaaggattttccttgtcttcccacccaagagtgacggggctgacatgtgcccttgcctctaaatgatgaagctgaacctttgtctgggcaacttaacttaagaataagggagtcccaggcatgctctcccatcaataacaaattcagtgacatcagtttatgaatatatgaaatttgccaaagctctgtttagaccactgagtaactcacagctaggtttcaacttttcctttctaggttgtcttgggtttattgtaagagagcattatgaagaaaaaaatagatcataaagcttcttcaggaagctggtttcatatggtggtttagatttaaatagtgattgtctagcaccatttgaaatcagtgttcttgggggagaccagctgcgctgcactaccaacagcaaaagaagtgaatgggacagctctgaagtatttgaaagcaacagcaggatggctgtgagaacctgcctcacatgtagctgaccccttcctcacccctgccaacagtggtggcatatatcacaaatggcagtcaggtctctgcactggcggatccaactgtgatcgaaagttttccaaaaataagttgtgtctgtattgaacatgaacagactttcttcttgtcattattctctaacaatactgcataacaattatttgcatacatttgcattgcattaagtattctaagtaatctagagacgatttaaagtatacgggaggatgtgtgtaggttgtatgcaaatactacaccattttctatcagagacttgagcatctgtggattttggtatccaaggggctttctggaaccaatccctcaaggataccaagggatgaatgtaattgtacaggatatcgcattgttggaattttatacttctttgtggaataaacctatagcacttaatagatagtacagactcattccattgtgcctgggttaaagagcccaatgtatgctggatttagtaagatttgggccctcccaaccctcacgaccttctgtgaccccttagaggat

SEQ ID NO: 4910 - DNA, 220253 bp, Homo sapiens
accccagcagggcctgggcagtattatgtaatcaaacagcactatttctgcagctggacataatccactaagttgaatacacaatcacaatagcctcctgacagttcactcaggctttgctccaactgagttcaagttttgctaacaaatgagttaaattttgttttgctttgttttcagaggatgatttttgaattatagataagaaatggtacaatgtactactatctataaatagaatacagagagtgagcaggttgtttgttcatttgttttttgatgagatgaaggttctggtttgaacatatataatctccagtgatgaacaaatgttaaagatgtccaataggcaatcatatagaaaagaaaattagtttggacagtttgaaactgaaacaattatagggaaaaggtgtacttgggggaatattctctctttagtgccaaaaataagagcccaactctgagaatgacccaaggaagtgtcatataattgtcagtagtctctaatgacctagaattcagagtcctacttgtctttgctttgcaataagtgaatgtacttttgtctcttgccactgctggaattgatttgaattcagttttcccccttagtgtacatgagttgtgttaaatttcacccaaattacatagtatgaattattttgatactaactaaatgcataattgaacagctaactgaaaacaccttccttttcaataggattttatatctataaagtatctatcattccaaatgtatttttgcacttgatggactaaagaactgaatacatgtgaagatgattcaggcactgatcatttctaaaatcctaaatatgataatattttccttaggagaaatatttcacccaccaagaatgtaaaggcaggttaaaattgaaagtgtctacggaaggcttaattatccaatcagagcttccaagactacattcctacaaatcattgagggatctattttaatctctcaatgtagtctttttgtggagagggggagtgtaattcctacaatttgtctcatacttgtttcatagtaaaaaagaaaagcattaaatattaacagaatataaaccaaataataaactggctatgttttctctaataaattttcagactccacccagaactctaactcagtcataaaactttaagagttcagaatagagctggacagaaggtttctccctcaaaatttcactgaattcttatcatcaaaatcccctcagaaaaaaatatttctagtttttcctgttcccaaatacactacagcatgatgagaacccatttaacacaaaatatgtataatgaacaaggtttcatgtagttcttaatatttgaaagatttaatctagcaccaaggtcctggagcctcaagccctacaatacatgtttaattaggattacagtaaagtttttaagaaataatttattttctttcatgtgagtgggtgtgtgcctgtgtgtgtgtgtgtgtgtgtgtgtatacgcatgtatgagacagagaaaaagaaagctggtagaaaaatcagcctttaaaagaacaaaaattcaacagaatagtgctattttcacattgagggctccagcactttcgtggtcataaagcagtctaattgtttagaccaacgtttttaaaaataaaataataaagaacatacatgttgtaaggttaagcactgttttatattaataaaacttgtttcatttatatacactcacattggagtttacagagttgaggcagagaataaattagttattgaggattgcagtaaaaggaaaaaaaagtttaaagaaacttagtgttaaggaagtgtgcttgaaataaaaaatctggagtgttgcaaatggatgaaaggcactgggtagctgcctcataaaatatattttaagccaatataataaaaagatcagaagactaaataatgttatccacattgacttaaaaaattaactgtggcttggaaataccaagaaggaactaaaagtctcaactgacatggcatcatcaatatgcatgctattccacaatgagaggagcatgatgccttcactgggtagtttccacgaagtcaggcaatatttggacaagtagaaatgagggtaaatcagagtgaagaaagagcaatggacaattctgtaattacaaaggccttacaaattatatgaaagaaaaaagataaacatcttatggtaagtgaggatgtgggtggtgaaaagtaagatacaggagtcatgagtcaagccactggaatgatcatgccatctctgagtgaaatgaagttagaatacctctcttggcttcaatttttcataaatggatggtttgagtattgaatctccaaagtgagaaagggatctcgagaatgctagggctggaagatactcctgattgtttttaaggttttgttatcttaatctaggaaagtattatttttcctatttaacagatagattaagttacactgttactctagctaatgaaaacatgttacatttctcactagaggttaagaggaaagacagtctggtaacatctgcctagtaagtaatgaagactaatattcaaaattcagggaacaactcctatatctcatatttaaacagtatttagcacatttgtttctctgtatggagacaagattaagaggtcaggtgagatccttttaagaaatgtagaaaagtggtgattgaattaataattacatcatgttatgctgtggttggcttttagatttccatctaatcttaaaaagaagaagaaaaataaccccactacatgttgcatcaggcattttaagtaaaacgtgcaatttaaaaaatatttttaaaatgtgtggagatagaacaaaacaatggaattgttattattatcagaaacttctacgtaaaaatgttggttaaagcaatatataaagattgattctcggtacaaattgcttggaaagtttaacatgtgcactagatttcagatattaaaagttaaattaaaaaaaagaatctaatggcagcgtgtgactttaacctcatggattttagccacaaacgcaaagaaaaatatatacaataaaagaagcaacagattttcccacaagcagagattttctaattaaaatgctgtcactttaatattttttagctatagaatttgactgtaaatgtcttcattatgtagtgtaacttctatagcaagttatgttaacgttttcaagaatcggaaatattggtaactcgatggggttcttaaaacagaaatagtttctttgatgagttggaaagagaaggaaataaaagtctaaggtaagcgccagtttcaccctcaattcttaggcttcagaaaagcctaattaggcagggaaaggaatctgggcctggcacacccaagcttagacgtggcaggatcctgaaacaatgtttttttgaacctttgagtcatatgccacaggcaaaccatagccgcgatatgcaggtccttaagtcaacaggtcctctaacgagatggtgagtggttggtgcgtggcagttggatttcttcccgccacggaagaaaagaactcttctccattgatcaggaaagtgggcccaactctggcctggagagcgcacccggaaaagtgcagagtcgaaacagagagagaggggtgtccgcgtcccggccacagagccctttccaaaccactcggaaaccatttaaatggctcggcggccgcggtttgcagcctagaactgtttggggtccccggctaggaaagttgcctggcaaagccatgtctttcgctgtcgcgggatgtcctctcgggcagagaggctggaggagacaggcaacctgctagccggagtggaagcgcgcccgcctcccgccgggccctccctctcagggtccccacgctgcgaccctcccaagggcaagtccggggccaccaggtctttggtctccgtccagctcctcaggggccgccccatagggactggcgggggcaccgtgggcgagagggtgtgaccgggctcccccccgaggcgccacctgccccttggcccagggcgcccctttcgggatctctccaggggcaaccgacacactgctctcgagaccgtctccaaccggccacctggaccgtagccctgtccccaacacgtgaacccctgcggccgtcctcccgcctgctctaacgcagcccaggggtaccgcgtctccctccgcctgccgccggcttacctggcgggtgggcagggcagggtggcgggaagcggcggccgggcaggcgctggacgtgggctaggcgccaggtgcaggtggcggcggctgcgactccggttgctgtcgccacagttgcggctcagtagagctcctcctccgccgccgcctcctgccttcccgctgggcctcccgcgttgcctggagaggcagaaccgaggctcggcttccacttggagtctcccaggtgagctccagcctgcgacgtcggcaggggcgaggccccacttccgcgcctgcgcgccagcctcccgccccgccccagccctacctgagcgctccaggtgagaaccttggatcgcgcgcgcagggtgggggcgccgtccgggccaagcctggctgtcgcgcggcttctctctgagtggtcggcgaggctgctgctccgcgcaagttgtggctcccggcccatctacattggaggaatcctgcactgacctggtggcagtgatcaccttgtagccagaacacagtctgctgggtccttggggaaccagaagttctagatttcccccacacggttcctcccttcctcctcggttcgccaaaatgaaggggtgcgctgcctccgaggaccacttcgggagggcagcaactgctggctcatgtggtttcttcgggcagggttcagcagcttctgtcaccagttaggtttcgtgagcttccttcccgtgtagtcttgatttcatcacttgactcacttcagcgcagctagtggtttccgtttctgtacgcgggcgctctggtaggggcgcctcacgtccaaaggaggagtcttcttccaaagaagagcctttggtatttggcagagcctcgccaatttggggcgcacctccccttcctgggatgctctcagaaggcaaaccaattcccagaagagagggaaaaacagccacaacagagagaacctttgctgtccctgtttggaaagagattgggatttcctggagagggcttgcttctactgcaggtttgtttaaaagctcaacatctattctggaagagaacaacgcagactccaggaagatggtgggttttgctgtttttaagacaaaaaaaaattgttaaacagtatttgttccatttatgacacaactttctgtttcagccttccttctgctgctgcaacaaacattgacacacccaaaaccaggacttaaaatggcctttatacctttctatgaactcatttctttggccctatcccaaagatatctagggatataaatagaaaactagctaaaaactttttggtgtcgtgtttaatcacatggtggtaggttttactatgaagtttagttgtggccttcctcctacattttgacatgctcttatggtgcttattcactgttttattagtgctatgcgtgacctaaaaataaggtttaaaatacagtttagtatagtatcaacaagtgtatctttagtatttgactactctaagacattggttttagcatccatagtgctattttatactaggacatctatgagttagggtttaagactttagtaaactaggtagttctttgcttgttttacatgtcatggttattttgcgagcaccaaggaacctccatgtatttgcaacattttaatatcagtacctacaagcaattgccaagctccctttccctccaaaaacaaacaaacaaaaaaatagttcaggagatacttgtgtgtattgatatactaacttggcagtgtttttccttaggtccaggtccagaactgaaaatactaactactgaaattctcttctccttctccttcttcttcgttgtgccactttgtcgtttacccctaaccagaggttaatgttagtctttggaaaatttgtaaggtatcctaaatgtataaccaagaaacctgtacccttttgcacgcaccacccatctctgaatgaagagccaaagattgtcagagttttgatgtcccaccaggcgaagagcaacacttttcactgacaatcaggacagagcagatggatatagaataacaatctggaatccaaggactgagatgcattgacagcaagactagtaacgtcaaataacaactgaaaagagaagctagggtagacctattaaaagagagagccagcaaacaggaccaaaatgctggatgaggagtctaaaaagaacagaagaaacaaaaaagatcaggagttactaaaatttgactgtcagttttacaatggagacagacaatttaaagaaggaagcagtttttctgagtgtggcattacttgtgcacgttgagtgtcatatatatagagagagagaaagagagagagtgagagagagtgagagagagagagagagagatatcttggggatgagacctgtctaaacacaaaattcatttatgtttcatatacaccttatacacatagccttaaggtaattttataaaacattgtaaataattttatgcatgaaacaaagtttgtgtaaagtacttatgtgtggaattttcaacttgtggtgtcatgttggtgctcaaaaagttttgaattttggaacatttcagattttggatctgtggattagggatgctccacctgtactattttacacaacgttgcttgtactatttcaaagcattctgaaagcaaagtcttaatattaataaaaaattttctatgtgacaataaaattaaaatgctgcaggcccaagaaaaaaatattatcatattgaaatatttaatgccccaaatctaatcagatgcaggtttttgaaagtaccatcctattcaaaattatgaaataaagaatttgtttcataaagagaaattagcatttcatcataaataaaatccaggaaccttagtgtagacatgcttcagaaataagctaattttaatagtatatgtttgacatataatgacagttaagatagaaaactgggcagattttacacaggaaggaaacaaacattctctctctctctctctcacacacacacacgtacttattacacacacacacacacacacacacacacacacacgactagccacaaaatgctcatttgcatggatttgaaacaatactcactccttaatactttctgttaacatttaaattaatgccaagaccagcacctggcacttagtaggtacttaataaatatgtgttaaatgaataaattgacccatcaagtaccataaaaaaaatgcctagtgtcttgagcaatttacaggtctaaagaatggttttacccaacagtaatgacaaataatccaaggcagataagaacactagactggtaatctgaattgcaaagttctaagaacaatagctaccagctttcacatacctacatttcaaaagacactacgcaaaacaacttacactcctacaaattactttacatctggcttaaatattctcttccacaaaacaaaatagtggtacaagatgatctacaggcttctttacattctgattcatataaactctatgccaagagaattgggcaaataaataaataaataaatgaaaccttctggatatagcaataataattaatgggacagcaaagatgaagaaactgaaattatttagctgagatcgaaattttaattcataaaaaatagttgtaatatataatgtaacaagtaaatgtgtaaagttactaagcctaactttaaactattttagtttgttaattgtttaattgttggttacacaactttgctttgaaacatactctagaaacagttttgcctcatgagggaactagagcttttagtgaggatctcaaagtcagactgagagatttggctcaaagactgaacagactggaataatttcttctcaaagcagtaaaagtgttgaaatgctattgattcaagcagagaatagaggtggtatcacagtgaagagccacaaacacgtgggtattttttaaataatgatccaacataattctacattgtgtttaaaatatagcaagttaaaacagggaaaatataaataggttattttagtatgaacttttttggacattgttttatatgattcttccccctgtagaatctcagaacaatcatctcagattttcaaagtggttcacatactatgaggggttgacttagattacaacaaaactatgtcttgctaatcttgtattcttagtacttggcacatagtaggcactcaataaatatttgatgaaatgtattgaatagagtgcattgtttcaagcttttaagcattagcataagagcaaaaagaaatgtcatgctgagtcagaataatattcaatctaactggctctaaattctgacagtggcaccaaagaatattttgtggaaaactatggtgatagtcttgcatgatgttgacctcagtgatgtactcgagtatccctcactcactcttttcctaaattgatttctctttttctgtaacatgtttctttaaattgaaaagaaattaatattcattacagagaaatcagaaaatacacataactgcaaagaaactagctttgaaatactcagaattccttataccaagatgaatcagtgctatcagaccctttctatcatgtatctttgcagattttttttattgaaaaagttggcaggaggcacggcatggaatggggaacatagagggatacagagacaggtttgtaaaataaaaactagatcattctggggacttgttttgtagccagagttttctacttgacatataattaaatgtcaataaatttattttacagtattattttaatggctgcctgatatccctttgtaaggatttaatctgtcaattactgttggacaatgaagattgctcccaaattttgctattgcaaccagtgctataatgatcatactcttcatctgttgaaacatttattacgattttcttctaattgacttttattttgtttttgttttatatagagatgggggtttcactatgttgcctaggctgcaattgaactcctgaactcaagcaatcctcctgtctcggcctcccaaagtgctgggattacacgcatgagccaccaggccagggatatttttgtcttttgagacagggtcttgttctgttgtccaggctggatcacagtggtgcaatcatggctcactgcagcctcaacctcccaggctcaagtgatccttccacctcagcctcctgaatatctcggactacaggcatgtttcatcatgtctggcttttattttattttattttattttttggagagatgaggtcttactatgttgcctaggctgttctcgaactcctagactcaagcaatcctccttcttcagcctactgtagtgctgggcttataggcaggaaccaccatgcccagccctgacttttattaagccacattgtgtcaattatccagatcctaaactatgacaatgtcattagaggcatcatatcacaaaaacaagaggtagaatacctattaacaatttacaattttctattggtaagaaaaataataagaatattaattctagctaccagaccttcatacaaagaacgttctattcaatgaacaccttataattttagaaatatggaaatagaatacgtcacttattttaaaaaaaaactcagatctcttattttcctctgatcataccacagtcagtttcccacctgtgaaagtctttgtatcttctaatatgattttcttccccctctccaaatcccctccagcccaactgaagaccctagtctcccatggagtcttgatatggtttggcggtgtccccacccaaatctcaccttgaattataataatccccacatgtcaaggattggaccaggtggagataattgaatcatggtggtggttttcctcatactgctcttgtggtagtgaatacgtctcatgagatctgatggttttataaattggagttcccctacacaagttcttcttacctgccaccatgtaagacgtgactttgctcctcattcgccttctgctataattgtgaggcctccccagccatgtggaactgtgagtcaattaaacctttttcctttataagttacccagtcttgggtatgtctttattagcagcataagaacaagactaatacaagcctcctggatcagttcaaatcaccttgatatttcttaattccaatgcattggcataaagtaaatttccttcctcccttggccctcacctctctcttgactccaataagggagagttgtggagagatggtacctgggtttgatataatttgttgccagataagttataataatttgttaaggaattcaagccgtagaggatgaggatgctcttttagcatattaggtttgaggtaacaggccaaaaggaatagcatttggttattaaggtaaaaagagaaataatttttatgcatgttagaaggggaattttgaaggaaattacactttttctgtatatttatatattttactttttatttaccaggagaaaaggcatttgctgcccaaggtagaatcccatcaccatactcctttcctacatccaatcacaaaatcagaatatgccaattctctattcccaagtaagtcaacagaccctaagattacattccctttctcccctctgcaaagcttcagggacaggagtccctgacaggcagctgacatttggggttgcatacaaaaagtcaagtcattgcaagagaaggaagtttgtttctattggaagagttagtgtacaacatataaaaacggagtgaggatggggatattgtagtagggagggggttaaagggcttagaaaatgatttttttaaaggtggacaggggaagagtagaaggcaaaaaaatgtcatccatgtgggacatcttctgaacgcccaaggagaatctttggggatacattccccccaagatttaaagaagtggcttcactcctgagaatgtacagggagcggagaagctaaaccaggagcaacatccaatttctttgtctctccttctcttctcactgcaaactctgtacaggtttggcataactatctaaactttctagtaaaaatcatagccttcatgaagatccattgtgtatttgattcacagaaagttggtattgaattgtaaaacacggctacaaatttctccctctccaacaggcgtgtcattttggaatgtgtcttgctgctcttctcatcaaaggtaaagtcctcttcttcaccttttaacctagagtagctgtgcaactttctttgaccaatcaaatatggtggaagtgatgttgcgtgacttccagatataagtcttaaagagatttttcactttctgctttcactctcttggaatgttgccctgagatcaccacaccatgaagaagtctggggcgaaaggccatgtggagtgagaggctcagcttcccagatgatctcactgagcacagcccccagccacctgccagctcaatgcaacctggtgatggacccaagcaaataccagcagaagaatcacctggtcaacccacagaatcatgagaaatactaatttgttgttgtcttaagccagtaagttttgagagagtgttttaactgtttcacctaagtttggtctcttaacatgaacataagcacttttttgcatttgtacatcctttgtactcttcctgttcataccgagaaagcttttgcaatgcaaaagctcaaatgtattggaattttagaagtttaagccttgaaggactctgtacaaaaccatgccaaaaaccatatattttgaagaatatgttctcagtctgagccagttttctatttccacctcaaatcttgattggtgcagactggagaaaggagaagagagtcaggggtaagaccgtgggtcggaggtggatatcgacaatgtacctgagtaaaagccctgtagcctctcaccatgttggaataccatatggcacaactacatggaccgccatttacatagagtaggatgtttagtactgcgtcttgacctttgaaaccagactggtgagaggactcaccaacaaaagtgaagctagggtcataggccctaccttggagattggtaagaccccagagttattccttgcccaatgttaagtaagaacagaaaacatttctaaagagggtcctgaggcagacaggtcttaagcagtcccacagccctcatgtgccctagaaagatgcagagcgcccagaagcggtttttcagtgcaggtgagaatggtttagatccacatgtttttgtaaattagtttttattggaagagaggcaaacccatacatttacctgttgtctatggctgctttgacactacaatagcagagttgggtagttgtgacagagatcatatggtacacaaagcctaaaacatttactatctggtcctttatttttaaaaagtccttatattagatgaaacacaaagaactggtaaaacttaagccttgtgtaataatacaaaacaaaaatataccatgtagaccataatcaaagggcccattgtcttcagccgctgacattgggaccagggtgtagtgtcagaacatgaaagcctggatacctacaatggcctaattttctcatacaaatgcatcctaccactcccatcccataccttatgctagataggatccatggaattagctgcatctccagtgaaacaggaaaagtccctgattttactgagatttagctattgtcacatggtgtaacagggatttaagagaaaaaataacctcaggtatagacataggaaaataatgttagattaagtttcttatacacctggttctgtcttcagaaactggcacccactataaagccttccatagtgataattatcgcacaaaatcgatacaaaggaaatacctgctgaatgttctgcctcagtaggttttcctttggtcttttaccttagaaaactgcatgatagcatttttctattattttgacatttcatgtaggaagcatgttattcacaacttatgttttataaaatctttttctgatgatgatgatgatgacacttgttaatttccatctccttccttcactgtaagtttttctattccctgagacaactatttctctcacttgtcctaaaccccaaggatacaagagatgcataggaaaatatctatgaagtgtgtgggaggagacaacagggcagggttccagaggtctgtggtttattgcacgtaaaacactggaaagtgctttggatgataaggaagtagcttgttgtcctttgcaatggcctgacattcttacactgagaaaatcttactccccactttgagctgggatgtgggagctgggaggacatttactgagtattaactctgtgccaggaattattcctacattatctcatttagtctccggaaaaccctacgtaacaggtgagaagacctcagtgacaagctcaaagatgcatagctaaagagctgaaatgtaaaagcaggtctgccagactcaaaaacccatgctctataaactacatcatagaagttgtaaaataattttaccttgaatccaagggtgaataatttgtcatggttagcttgccctttggcattcataaacaatttctactgtcccagtttttgttccattcatataggagtaacatgtggaagtattaagcaatagaaggctttgttttcatgtataaatttttacgatattttcaaatataataaagccaaaattgttaatttcacttcatgtagagattccttcaaatataagatgctatgaaacagtgtcataccaaaaagcaaacacactgatttctataatcaaaacattgaggaacacaggaaactctagataactcagaggaaaaagggagtacaaaatcgggttgacacaatgcttcatttaagaataggaacattgtttgttcatttgggtactttataactttaagtataatgaggtttctttaaaaaattgtaacaattttggtataattgtataataacttggtatgtggtatttttatttctatttatttatttatttattttgagacagagtctcactctgttgcccaggctggagtgcagtgatgtgatcttggctcacagcaacctctgccttctgggttcaagcaattctcctgcctcccaagtggcctccacgcccagctaatttttgtatttttagtacagacagtgtttctactaaatgttgcccaggctagtctcgaactcctggactcaagcaatctgctggcctcggcctcccaaagtgctggaattacatgcatgagcctatcacactcagccgtaggtgttatttttaaaacatatccaaaatgatttggatcatttttaaaatgatcctaagtaattctttataatattaatagtataatttggtccattaaattataactagaaaaaaataaataaaattcttccaaattgatatattgatgtaaaaataagggtctctcctttaagtctctccataaactttagttgagagtgaaagacttttggaccaatgattcttaactaaagcaatttcttgacagaagcaaaagtgtgaaatgagaagatacaataaatttaacatcaaaacaagaactgtaagttttatcatttaattgtattgaaatacatacaaaccactagatatgtggaatttcagaggcatttaaagagtcattctaaaagtatatgaaattatttcatgaaaaggtcgatcaaaataagaagaggatcctcataaataaaaatgttttataatatctcgattataaaagtaatttcacagtaacttttcctttctgcatcttgtgaaacacaatagacctgagacagcctgtcagtttgctttatggaatttgactttttgcagcctcacagaccacgatgaactggtattaccagttttgccatcttatctttttatttaaacagcaattaaacactgccataatatcatataaatcattaaataatgttccagaccacacacaagtggatgagttatgaaagactgaaggattatattacttttaaaatattttgcttagatagaataatggcaataaatattagcaccctttgttttatacttttaccaaatattgagtagtttcaaaggaacacttactaaatacatgcaatacataaggaatcataatacaataaacaactatgtacctactacttacttaaagaaaaataatatttttgtatctgtcatggaaccctctcagatcctgtcccctcctaattttgaattttgtgttcaatcatttccttgtttttctttagaggtttactgcatatgcctaaacaaaacactggttaatttcatggtttttacagctttgaacattaatgaagtgtatcgatattattttgctacttgatttttttgcccaaaattggatacatgagattcgtacatgttgttgcatgtagctgtaatcaattaactttcacaccgtattatgttaatccattctgctcttgatgaacatttgaaaaatctccaggtgcatgtttatgtgtgagagagattacaaatagtgctgctaagaacatttttatactaccctggttaaagagcatgtgaaagatcttctcttggaaaaataactaacagtgaaattgctgggtagtagcaaatttaccagataatgccaattattttccgaagtgcttatataacacacccttatggttttaatggcatgcttctttactaatttatctctctctcacacacacacaggcacacacacatacacgatatagagatatatccttttaatatacattactccttttctgaaaatgattttatatactaaaaatctaaataatagtattagtgctggcttttcagaaaacctagaattgtgaaagatgtggttgattgggaatttttgtcatttgttgccaggaaacaaaatattaaggaaaaaatgggaagaatgttttagttgtatttttttttttttttttttttttttttgggacagagtctcgctctgtagcccaggctggagtgcagtggcgtgatatcggctcactgcaggctcctcctcccgggttcacgccattctcctgcctcagcctcccgagtagctgggactacaggcgcctgccaccacgcccggctaatttttttgtatttttagtacagacggggtttcaccgtgttagccaggatggtctcaatctcctgacctcgtgatccgcccgtcttggcctcccaaagtgctgggattacaggcgtgagccaccgcgcctggccagttttatcttaacagatggaaaaacaaatgtatttatctttcatatgccttctattacacttctgatgtcttcatttatagggctaaaatatgcattcactctattttcaatcttggtctttggtcttttaaagaagcccaagggctgactggtgacattcaaaataatgtgttatgcaagaaaccaattttagggatgaacgatacttcttcagctataactcctaaaaatcatcagaattggaacactggaaaagaatttaagatatttttgtctactctgtaactctttttgtacattttttctcttataacaagcatctactttaagttgaagaggatccgttaactatccaactaagtatatttcaaatgctctaaaagttcagacttgacttaactaaaatcctctaggtacaatactaccagaagcacatgcttctcatttttatctaataaagtttctttaatcagtgaaggcctataagaatgtgatgtcccttaaaagaaatgcattgcaaaattccaaaaaattatttcttttatactctctttgtgtaaatatcctacttttcaaaatttaccaatgttataagaactccaaattatttaaattagaatcaagcaaatggtaatattattttaaaatgttcctagagtggtaccctcccagctcttgcactctgctgtttttaatgtgtgggcccctgatggtcttccatgagaaccagaaatctgtaagactctatcttgcatttaagataaagtggtttaggtacttcattacgtgttcattttaatggtgcagtgcactcattaatatgctttatcaacactaaataagtaacctagtgtatgtatgagcaatcattgatattagcctaatgagaaattactgggcagtaagtactatgataagaaacatatcataggtttatattacaaattaaatagagaattgcaaaaattttctgagttttctaagcaaaatatattgggccctaaattatttggctattgttattgctttgttgatggagaaatactcagcacagagatgcttttctaatctataatccagtatcacaaaggaagcatccaccattaaaaaaatcaaaaatcatacctcaaataataataaaaatatcaatggaatattaatgattgcttattatatgtaccaataattttacatactctaatttgtacaaaagcttttcaggtaggtaatattattatcatgttgcagatgaggagattgagttttagaagatttgtgtgaattacccaaggcaacaaagctagtgagcagcagagtgaggattcagttcatgccagctgatgtagaagctatgtgcttactatactattcaactctaataagatatgtctttcattagtacctttcttctcatatgtatgaactctgatggtccaaacatatataagcaccaggtacatacactcatgcctgaatgaaatgcctgctgtatacactatgccatgggaagtaaagtaaggactcattcaccctttcctcaaggagcttacaatgtagatcgaggggataagacgttaacaaagatacgtataatcacaagcaaaatatgtcaatagccataagaaacatattctggcaatgcacggaagaaagaaatcctgttggctaagtgggacaaaaagagtctttataaagaaggtaaggtgaatcttttggggaacagtgaagtggaaaatcaggattttgcacaaagcatgctttatgccaaaaagcttaaggtacgttgtaggcatgacttgttttattctggctgggctgggacagggcatgtataaaaactgcctagagactgggcactctttatactctttgatgaatttgtaccaaattattaaacagtgggaaactattgaagtttttttttttttttttttttttttttttttttttttttgagacggagtctcgctctgtcgcccaggccggactgcggactgcagtggcgcaatctcggctcactgcaagctccgcttcccggcttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctccgcctcccaaagtgctgggattacaggcgtgagccaccgcgcccggccactattgaagttttgaagtaaggaatgatatcattcattcaaaaactatttgtggggtgtcagtatgtgcctggcactgtgacagatgatgggaatattgaggtgaacaagaccagtccatttcctgccctcatagatcctacaagttgatggggagaaagaggctaattttcactatgactaagaatgtgatggccctgcatgaaacagaagcaaagcctctgagtagaaaaaactttgatggtttggtttacatttcctctactaccttttcttaaagtaaatattttattttagaataattttagattctattactattagagtctaatatcatttaaaggtaatttagaaaatttatttcaattactattaaggttgctatttgatcatttaatgcgtatccttctatgtcataactctgtgggacaaatttcagaaagactaacacatttaaacatcagttagttgcacaatctaaactgctactgcaactaggtagataaacatgttaaagaaatgtctttggtacatctgtacttggctctgatccctctgagcatagcaagttacaaagtgttgagttggaaaactttgtaatgaccaaagaggtattacaaatacagaaaggccaattttaaaagaagtcaacgagaaaggtatacaaactgcccaactataatcaaacacttgcatgaaaaaaaaattgtaggtaagacctgcttgtattaaaggtttttcacagaaacataaaactcagagatttatgaaactaaaaagtatggaagattactgaattaatcctgaggtaaataatgtcccagtagaaattagcagtaaggtaagcactccaaaacaatcaaattagcagggggacataaactgatatgagggtaaagggacgactagtgagaaataagaaatcagactacagccaaattaaaaaaaaatttaaatatattgatgcttagtttcctttaagcattgcaacatatgatattgacaaatgtggtgacagctggtaaaaactgtatatgttaattgccaacatcacataactaatatttactataaaaagtgtccctaaaataactttctttcatcatcagatagccatatccatctagcattccctgtttatgttttgaaatgtatgtattacattttttcttctccttttaggattaaaatataaagttttatgttccctaatatatctactttaagaatattctaaatattgaaaataaaaaattttttaataaaataccactgacagctgttctctacttatcatttcttagcagggtgaagactatatttgctcacataaattgtgtccttataacagaaaaagcttcttagggctggtgcggtggcttattcctgtaatcccagcactttgggaggcggacgcaagcagatcacttgagttcaggagttctagaccagcctggcctacatggtgaaaccccgtctccactaaaaatacaaaaattagacaggcatggtggtgcatgcctgtaatcccagctacctggaaggctgaggcaggaaaattgcttgaacttgggaggcagaggctgcagcgaaccaagatgggaccactacactccaaactgggtgacacagtgagactccatctaaaaaacaaacaacaacaacaaaagaaaaagcatctcagaaaaacgttcccctttttcattgattccatgcaaatgatacttcaccctattgtttacttgtcctgaaatttcaaagcagcagaaattctgctatacattatccttttatctggtatttattgaaaatgtatttggctatgatttgaaatatataacatagtgtcaggtttattttctcatgtaacgagtcaagaagtaggtggttgctgcctttctttcagttattcaacactataatcaatcactgtcttgtctttttatatttctgttcgctatcttctatgtgttgggtttccttcccggtgggtgtcatatcagggtcacaaaatggctgctattgcccagtaatactcgaatgctcgagcgagggcaggatggagggaggggctgctagctgtatctgtctccttttgtcagaaaagcaaaagctttccgggaagctctcctagcggcgactccttacatctcaaggccacaaatttcaaagagtggaaaagcagaaaacaagattctcatttttggcaccattgtgagacattgcctaggaaaggcatattgacaattcaaacaaaatcttaaattctagtagcaaaggacacagaggaatgaatatttggtacgggacagaaaggatctgcctaaatgccctagttcatttgaatgtaaaattcttaaaggctgggattgtgcctgttctcttctttgtgtataggactcagatcataagaaaaatctttgacactacaaattctatacactaaggcagtatccccaaatttcattcaatttttctaatatgggggtgctactgagcacaaaactagaaagagattataaatatacatattcttggtcagtttagactactatagcaaaatatgatgcactaggtggtttaaatgatctcctcttagggcccttgctgtgtccttgtatggtggagagacagttctctggcctctcttctcttcttataaggccactaattccatcatggggacttcaccctcacgtcctgatctaaacctgagcaccccccaaaggttccacattcaaataccatcacactagaggttagggcttcaacatataaatttgggggaagataagcgtttagaccattatttatttatatgttaaaaataatatagaatattcccagaagtcaatttttgctccatgtattagaatacttattaaaccttcctatgcccagcaaaattgtagacactgaaaaaataccaacagaaaatggtccagcttttaatgcatttaagctgaaataagaagtggtgaacacagatccaaattgaactaaaatgttatgtaatctataatagcaaccttttatctggtgtctattatgtgataatggtataacgtactttatctaatcttcacaacaacactgctaggtagttattagcctcatcttaagtgttagaaaacagagaacactgagaggctaagaaattcattcaaggccacccagggcataagcagtggagctgaagtttggacaagatttctttttctccccaagccatgcttgcacataatgcacataccactacatgctgattaattcattttatgaataaaatcttccctcttataattctgctttgtttttatgctttttcattcctagctttctcactggtgacttatgtggatgaatcaatgggaacaaggtcagatcatggacagatgagaaaataatgagacattagattattaagagagatgaagttaagagtgagaggtgaatgaaagggaagaaggggtgaaagctcaggattatgaagggaataaacaggaaagaggagagagaagaagagaatgaatactacccagatatttctctgggcactgtggatctgatggaatggtggtatcccaccctgtaaccctgtcttctctgatctctggccaagtgtgtggcttggcactgcacaactaacagttagcagcattctggggagaggctcatggtagtgaccaaattgcactttccctagctattcttgtgttctaatcctcccctgaaggtcttttatggttaatctcaaaccatataaatatttaactctccttttagttacattgcagaagcctgttctcaaacaagtataagtttcagtaaccacaaattgatactaatctaccctaatgtcactgtgttcctcttcttcaagtgagttgaaagcatggatccatacaatttgtcttgttcagtttgtacctacttgtatcttccattaacagagcatagactctcaggtatggagaacagattaagatccaattactcagccaaaatttcaatccacctctctccaggacatttttttgtttttgtttttgtttttctttaacatcctccaaactggtagtatagctatatcgagtacttccagtccatggaacctaacacttcctcaagtagtcctttccatgcttagacaacttcgactttagagtgtggtttcttatttcaccagtcaggatagctaagctgttctgcagtaacaaacagccctaaagtgtcagctctaatacaacagaggctttctttttttttttttttttttggctaacattatgtgcctatcaaatcagcttggctctggtatatattgatatccatctgggatcctggctgagggagaagcccctctctgggacatttctgatctcatggcagaggaaaagaggtcctggaggatcgtatactggccattagagcttccacatgtcattagccaacatgcatcacatggagtcatcccacagagaaggacagggccaggagcaagacaacccagagaacagccgtaaatatctggaataacagtgcaatgtaccacatagttattgagtcaaatccttttccaagtcatatccctccttccccattgccttttctctttaccagctctacaaatgttaggaatccttagccatgttttcttcgagctgtctttcttctagtctaattggctccaattcctccactgacctgttccctgtatctagtggtcttatctgacattctcttgagccttttcagctgtctcaagtcaactggtgagagaattgttggtctattctccaaaggaagtggtcccttgacatactttcctttaggatgatgggtttggcgatgtggctgagccttctagacaaaaaaagctttccttaaacaatatctcaactaatcagtctccaaatattttagtagcttaaatctttaggcttttcacaaatgcccagacactttgcctgttatatattagaatgtagagatgtttgagcacttccagagggcaaatgtcacatccctgactatactttaggtaacttagcaatatatatacatggttgtattgacaaaactcctcaagcctactattttttcataggactggctcagaatgtggactttggaaataaccagtcttggatcaaaccctgattccactcagtactacctatacgacctttgacaagttaattaatcctgagctcttatttcctcatctaatgagatacagacaataagagttatctttctcatgtggctgttgagaggattaaatgacaacagtggggctcaatcagtgtcttcttttgttaccatactggggtcctagcactcagagctatttctggtcttactcaaggaccaggtcctctagcatccctgggtttaccatggttatgcatagctccctcctctctcccaggtgtccttctctcctcctgaaatgtttcagcctcaagtcagcatcatccgagcttgaccagtatctctcaaggtgttgtccaagaacaagctgcactggaatcacctggaggcccacgtggctccatttcagactaactgacagagttagaagatgaaactagtaaatctgtattttaacaagcttcccccagctagaggtgccagataaattataggacatccagttaaatttgaatttcagataaacaatgaacaattttcagtataagtatgtctgtcccatgcaatatttggaacatacttatactaaaaaaaaatttattatttatctgaaattcaaattaaatggagtatcctgtacttttaattgctaaatctggcaaacaaatctcagggattccaattcttactaaatttgaagaccactggtttaagatatttggcaaaaatctcaaattcaacttcatgagcttccaaggagggagggagggaaagaacgaaggaaggaaggaaggaaacgaaaggaaagggaagggaaggaaggaaggaaggaaggaaatgaaaggaaagggaagggaagggaagggagggaagggagggaaggaagggaagggagggaagggaaggaagggaaggaagggaaggaagggaaggaagggaaggaagggaaggagagaaggagggaggaaggagaagagaggaaagaaagaaaggaagaaagagacaaagagaggaaagaaaagcaaagcaagcgaagcttatagacggaacacagatggcccatgcatccacaaaacaaatatgcacaagaccaagtaggttagcatttgtttcagcagccacagtggcaaacatagacaatccagcagccagagaaaaatccacttccttgtttctctagtttggaattgggctttaggtgtctctgtctccttctgctgctttctccttttttttttttttttttttttttttttttgtctaaacatctccatgctatgctagccaacacctactcatcctcatttggtatttcctcttttgcttttttgctttcctacaaagcatcttgggcccatcctcctctgtctgccccaaacatcagaatacctaatcaaatagtcatatagccatctttctccctctaatattaagtgtggactccctcaattttagttttctgatgggattttcctaattctcaaaccattctgtcttatgtgtactagagtaatgcattgtgtttttggttcgtgtacatttacagaggccttaaaagagacattagctgatttttcacaataaccccataatcgaggcagatgaaaaacggagcccttttattcctaggccaagacccttcttactcagccattgtctcatctcaggttattatactcacatcattcatttgtcattttagaatagtgattaaagcacagctgtgtgccttggttagttttatttttttcttaaccaatctaagcttccatttcctcatttgtaaacttaggttaacaatagtgcctacatcatgagcactgggtttagtcagatgatcaaagtcttagcactgtgactgcaaattgtaagcactcaaaatattagccattattaaaactatcttgtgggccaattcttttccaggcccagcttttctcttgttgtctttcagcaaatagagatataaaatggaaaacttagactaaaaccagcagaacaagaagtatcaatggctgcacaaggaagtaatgcagacctatgctaaattttctcttggtaaacacttcctttttcatacccctctcccttgaactttttcacctccactcctacaattttatgttatgcagagtcaaaaatataatcatcctaaactaggctcagcagtgtggacagtaactgattgaaatatgaggttctttaattagaagcaggaactagagtatagtactaagaataatggtaatataattatttgcatcttgtctaacttcctcatttacactggccttcttcatttctatctcattccctgataaatatggtatctcaaagccaaatgtttgggactccaatattatcattgtgttcaccttctttacccattagggcctttatatgataataagtgtaatatgatatccccaatgaatgagatagagtggcccatacaggagcgacctcaaagcactttttctgtactgcagatgcagtgcaaaattaggaatattaggaaaattacgactgctttcttcagaaaatactcagggcaatattgttgtggataatgggaaataactggtggtttttgaacaaggaaagtgaatgtcggttatagtattgaatagaatagtgttctagaaatagacaatctatgtagaccagtaagtctgaagtcagggtcactgtgcagcaacagaggacataatctgagaggctaccttttcatgactgtgtcagcaaatacaccaccattgcttttcatcttagaggcagcacaaaactatgcaaaagaaaaatcaatcaagaacatatttaggacacagcagggaaggctcctataaacatttttttgggaagaacatagatatatgatgcttttttaaaaagttatcagtggaaaaaattggaatttcacaggactttgttatatttgtttttggcttagagtttgttttgtttggtttctttgtttaactatatttttggaagggtagaaggtggatggacattgtaatcttctttactatttagaaactctaaatgtcttaatctgattcagtccaggactgcataggaattacttgatttttgccatcgacacaggtatcataatccctttactgctctatccggagaatgttgtgttttttcccccctttaagatgaggaatctgtcagtatggttgctcccttatgactaacaggttagattatgcttaagtattctacgtggtccctcccataaaaactgcctcagaaacctccagtgcctcaaatactcttgtccttgaatggtacaaggaagtagaggattcctggggcatatatgatacttaatctctctctctgcctactgacattctaacattttggtgagccccattttatttgctatggaatttgacaaacagttcaatcccacaaacatcgagtgagcaagtaccatgtgcaagcaattcattcaatgaatattttcaactcctactacgtatcatgcataagattcaccctaatgaaggagaagaaggaggagaagaaggaaggaaggaggacaaggaggaagttgggaggaatccctgttctcaggagcttcaaatcctgctggctagaagatatgtaaacataagggcaatagaaatcttatgctgcctctgtggactgagagtgacaggggatagatccttgaagaaatagcagtgtgcttgggggaaacagatgctgggcaggcaaaaacttctcctgaaaaatacaaactgtgacttgagccatgcctgagggagaagtagaactttgattccagttgaagcataggcagtagaaaatgtatggatttgagagttaaaaataattttgaacccatcttcaccaatgagctgtggtgactgtgaataagttattttgcttctctaagcctccactctaaaataggaattgtgatgtttagcccaaagtgttgaggtatacatctcctcaggcctcaatgcagtcttgtataatgacttagagcatggactctgaagccaaactgcctcagtttgaagtctggtgctaacacttagctattaaacttgggcaaattattgaatttatcagtacctcagtttccacatctgaaaatagaaatgataatagcaaactgacctctcagtagttgtaaattaaacagacaggttaatgatataaagtactttaataagtgactacacatggtaagccctataaccatttgctattattaccaagtgtttagtgatacaatataagccattaaattaccatattacctggttagtagatgctattttttattatagtgcactgtgataaacattgtaagaaatataaatgttccttgtatttttagggaagacatgaaagaaattatagcctagtcataagtgacactcacaagtaatcataataaagatggtatgtaataaatattgcaagaaagatcagatatgtccaactgatagttcagaagaataagggatcaggaagaaaaaaaaactataatagagacatggccttctcatcatggcctgggcatgatagcaagaccccatctcttcaaaaaatgaagagatatcccctaggagcatgcaatcctagaggaaggcatgggtgtaccttccagattggaaggagaggtaatgattgttgagtcagcaatgcaagattaggtagactattgctgggtggattagtgcagggaatgccttccctgatgaaaccaacaatggttgcaaaggcatagaagcatgaaagggcaaaaagtgtgtgtgtgtgtgcatgttacagaaaaagcaaagcagtcaagagagatggaagatgtgtacttggggacatcacatgagcgatggagacacaaagatgaataagacatgaaggaaatatttttggatgatgcatgctggagactgtttttgttttttgtgtccttttgtccttaacttcctccttccttttttccttcaaaatacatttactgatacctacaatgtgctagagaaatatgactttccttatatcacctgttatataacagagttttgtcccatgataagtgatataatagaaatcgcctcatatgaaacaaagttatgttatatcagaaatgtgataaataattttccaagttacaccgaaactaggccccaaatagggctctttcattaaactctttgttcagttgctttctctcactcccatgtccctaaagtacatggatagtagagaatcctttttttttttttcagtttatgtgggcttagcaaagagtgggcaggcaatagagacttgcagatctcaactgaattactggagaatttaattttaaatgctctagaaggttatcttcttcacaacttggtggcaaattctttcaggaactgaaagttgcatgtgttttaaaggggcataagcttgtggagaacctttctctttggtttagctgcatcgatatgctgattttttaaaatgcactgaacatgcaaaaatgagtatattattgacctcaaatcaatgcccatcactgtttctatcttatacagtgagcttcttggctttttaatattttcattgtgaagttattccaatgaagacaaaattttgtcaaatttattacccagggagctttcaaaatgaagcagagagactttgaccgagcaatttcacttctggaattttattctacttatgcatacttatacatatgtgcaaagacatatatatctgaaagtttattattttttcgaagcattgtttatagggagaaaaagcaggtaacagcccaactgtccttcaaaagagaactagttaatttatgatatatccatataattaatattattcagtcattaaaaagaataatatagatctatgtgagcttatttggaatgatctccaggacatgtttttaaattaaatcacaaatacaaacaaaagaaagagagaaagaaaagtacagaataggtataaggaagatttccatttgtgagacataaatatttatctgtgctttgtatatttatttagtacacatgaatgctatgtaggcatggaacatttctgaaaagatcagcaagaaagtacaaatagtgattatttctggatgggaatctggactacgcagcaggcacacttttcattgcctgtcctttgtattatgtgatttttaccatgctaatatatttttattaaaaattaattaaagaaagaataactactggagataagccatttttggtcaattccatagtggctagttagaggctaagtaatatgcaatcatgaaattaatgctcaaattaataaaacagtatttcccaatcttgattttattacaagttcatttctgagtagttcaagaacttgtagaattattttaaagatctcaaaataaaagaaagtggtaatctaattttgaaaggaaatatgtttcacacagtttgggaaagagagaagtattgttttcaaatagggagcagtgccttagtgagtaatttcatttgcattcctgtgtatctttaagctgagtacaaactaagaaaaactgttcttgcagaatacactgtaaaattactttaatcagtaattactttgacctttccctatcaaaggtcaaaacaccggacagcctgttgctcttaacatcagctcttctgcgtaatatttctctttgctctggaacacaattagctcttgggaaaagaggccaacttttcagtttctgcctttcatggtttctgtcttcccctctgcttcagtgcaggtcagtcacacagataagcattatgcccagaataaaactggctctgtttatctggactaataaatgaatggaaccagttattttcattggcttggtctggaaggaaaccaaactaatttccacagaccttaaattggacctaatccaagctacttgtcctcactaataagagcaataacaattagtataaaagcaaaaatttttacaaaagcaatccatatttactgctgggcaagaaaattggataaaactaggaactaacatgagggactctgaaagctctgagaaatccacttcatttgtatttcaatgagtctgagctttgcaggtgaatacaacctttctttaggttctagatactccagtttctctctggtcaatttttctaatcaagttgtgctaacttccgctgatgagcagaaagtatgtgtatggtacagtcaaaacttttgcacttttgtcttacttaagaaacttaaaactcacatttgtattcctagggtttctgacaagtcggcatactttatttcacaatgtgttcatggaacagtgagattttgacttccattgtgcacatgtaataaaatgttctcattagtgatattcactcagtgtatgaaagcagttactgcctctgcccaaaaggcattgctgtttccatttaagatttatggttggccttttaattatactcccaacactgcccctaaatatatccccatggaaaaatatataaaagtatttcacttaattattatcttgctcaaagatcagggcaatatcttggagctgcttccaagactattgctttatgatttgaaagctgtttagctatttttaccaaataattaattcagatatatcaagaatagggtaaactctttattgaaacgatttgtagggaacttaaagagtaattaattttccatatgtatttttaaatgaaaataacttattctttctttctgatttaaaaaaatgcctacttgtagcaaaacaaaataggggaattcattaaaaaattgtttaaacccaatgcaacccacctatatttctaggtaccaagaataccactatgaaaatgttcatgaacatcctttcagacatttatatggatagacattaggcatacacattttttaaaacaaatgagataatactgaaggagttcaggacattccaccccaaaatatgtccctttggcgtattgattattttgatttaaagacacctggggctgggcatggtggttcacacctttaatcccagcactctgggaggccaagataggcgatgacttgaggtcaggagttcagatcagcctgactaacatggtgaaaccccatctctaccaaaaaaatacaaaaattggccaggagtggtggcactcacctgtagtcccagctacttgggaggctgaggctggagaattgcttgaacccaggaggtggaggctccagtgaactaagattacacctctgcactccagcctgggtgacagagtgagatcctgtctcaaaaaaaaaaaaaaaaaagacacttagaagacaataggtattagaagggctttctgaccaccccttttctatttaaaaacagtccataaaatttcctatgaaaaagctgccttccttgtatcaaaaagtgaagaacatccttatcagcagagactgggaatcaacactaaaatgaatccatatacacaaatttactaaaataactcttattgtccaccagttttccccacttaatgttttatcacttccccgcaattaactgcccctagcccaaaccactttgtcttgtcatttcttcacaaattcatcacttctttgtccaaaaggtacatatgctttctgctctggtcctttcttcatggtttcattttcctgtgaggattcccatgcacatgtgccattctaataaaacatatgtgcttttctcctgttcatctatctatgtcaatttgacttttaggtccagtcagagaccacaagaacgcagaagacacattttatttcctctataataccatactgttttaaaattaacaatatattctttaaaatatgtaaatataagtagatgattagatagagagatctccaactcaccacttaaagtgctgcatcatattagattctgttttcatattttaccaatccactattgatgaacatttaagtaatttcaattcaattttaaataacactatagcaaataccaatgtgtgtttttctgattatctttctaggttttattcccaaaggttactgactatggatatttaaaatgtttgaaatgtattcttaacttccccttcaacaatgttaaaaccaatggttttaatatccttaaaggtagtttctactttacacaaaagttatttggaaggagatttggggtaaaggaagtgattaggaggaatagaggattaagagatgaggatgatactggatatatttcttaaaaaagtctatgagaagatagaaaaatgagtacagcttagagatgctgaaatatcataacagtaaaaaaggtatgtgttacatgaagttaggcaccaatccaaagaagttgctgagagaacaatcttgtgaacctacaagttaattgtaggagagaaactcagaagttttagtatgaatgagctggaaggttactgtttcactcaggagattagaaagataacaagagacattgcttaaatctattttcaaatataatgctaataattttttcagtaggctataaaaacaagtcttccctttcctactgcagttaaaaaaaatgcattgtccttttcccccctcacactttgtttgtatcaggaccttcttgtttagatcaggttactaaatatctttagaagacactacatttagaaaaagaaattattgttttgaagtttttccaaagcaaataaagataattcttatacttctatagatatttaaatccaaatgtgtctgttcaatggataaaaccatagaggtctttaattttgcaaaacaagcccatggcaaacccatgaaatagaaaaatgtattattttgaatactactatccaatcttcccccacgctttctctggtgcccagtttttccaggtgacactgctatacctcagcctgaagcctctacccctcttgttcagctctgtccctgcagacagaacttctaggtgggtccccaaggaccagatttgcctcactctataccctctgaatgctttagcctttgacttgtttcctcaaggcactcctaaatgatgctcttttaactgatgaactattttgaaaattagtgactgagggtagaccagtgtgttactactccaagtaacaagagcaatttaaaagtgtccttcagtgcttcagtggaaagaaatctgttccataaagggaattcaggcttcctgcaacaggatgttttctgttcaatccatagtcataccaagcagggcaacagctcttagtttctagtcacaatcatagatacaggtaggagatactgataaatatttgataaatattatttcattggagcttcaattctatttaatttttaattttatcagagtaatgcacagatacatgcttttataaagtaaaatagcacttagagagcttttaataaaattagcttgcctgccgcattgccccacttcaaaagcaggatcttccacacttgatttgtttatgtgtacttctgaatttctaaactacctgcccactttattgacttttcaattttagatatcattattgaatgatatccctgtaagagaaatgaagattaagcagtctgatgcacgcttctcaccacacaccacaaatacatgtccctccttccatcttcttattctgtaacagactttggggttaaattaatatttaatatttccattgatgtcactgtgtctatcactcacatctgaaagatgccatgttttgtaatttacatttcttttctcatattaattttcattattcctaaactttaaaatagccatgcactgttttgttttcttcatttcctatgtgcctatcatttacgcaatctcaaattttctgatactgctgctaaactctcagtaaaatcagacacattaggtgaactatcagtagtacttctcctttcatggagacattactcctggggctgtctgtccttttgcttctctggtctattgcagataatctgttattcctaactgtatctcttcattcaaatgacaataaagctcaatatttagtgaagagcaatcttgacatgtgattcgaagacataactttattttcattttgattatttttcctatgtctcaaataaggtttcttgtgtgagtgagggataaccaggaatgagcaaatgtttctgtgttttgcctataaaacagacacagagtcccaagactgtctctctagaagaatttttccagagattccttagttcatcctactctcaaatggctaattttattccccttgcaagtctttaccaaaaatgattttgtagcctgaactgctgtggtactagaaatttcatctgcttttttctgagtattcccattccttctcatttttaatcagccctgtatagtttagatttcatgtcctcctcttttttatttaccctctcattttgaagaagcaaatagttcaacagcctcttgagaaggaggacttgagaggtaaatatattgaggtattgcatgtcaacaatatctttattctgttctcatgcttgattgtggcttggcacagtgccaaactcaaggttggaaatcattttccctcagaatgttgaaggcagtgctccgactggaatggagcccatgctgctgttgagaggttcagtggaatctgatccggattctgaatccttgtaatgagaactgatttttctctctgggagacttttaaggtcttttctttatctctggcttcctgatgataagccttgcttcatgtgggtctttcttcattcattgtgttaggttcttaatcagacttttcaatctgagaatgtgtccttcagtaccaaaaatgtttattctatgatttccttgataatgctatcccctctgttatatctctttcctgtttgtgaaactcctattaatccatttatgcctagtgttccattattggaacactaagcttgtgagagttatttatatcttactgcccaaggtcatcaccaaggtctgatttttcacacaaaaaaatttgcaacctcctgcataaatgggttaattggatgtgaaacctctgattcttgtcttttctatactgtttttcatctctttgatttttatttcagtttctgattttctcaaattttgtgtttaaattcttctgtttttatttgtgctactgtatttttttttaatttaaagagcttttaaaaaatttatttcttttagatagcattctgttctttttcatgggtgcaaaatctacttttgtttctggggatattgcttacagaaacttttcctgttactccatgaatggtttccagtatatggtgtactggctggaaatttagactctgcatccagcttaaatgtcaatcaacaccaccattgactgtgcctatgaccttgggcaagttatctaaactctgctcatcagttgtctcagtaaaatagaaacaataagagtatacagtaacgcatggcattattgtgaggtacaaatgagagcaaaatgtattcggcactcagaacagtaactggaaaagaggaagcccatatgatatgttattatatccatttcctccaagttcctttttttcctgttttattttactctttatcatttgtgttagacatttttctcaaatgcctgatgatccttggctgtgtgttcatatttaataatgaggaactaagaagtaaattggaaaccttctgtgtgcctttgaactcctgaagagccatgtgggaatataacaccccacagcttcagtgctggaaagacctcatgatagagagtggtgatcaaggagcaccagatgttgcaatcactgcctgcagccatatcagataccccaataagaaccgcctcgctgagtccagtcagcacccaaaaccatgagaagtcataataacaacaagtgattgctgttgatttgttccaccaagtcatgtaacaatagacaaatgatgcagagaagaataggccctagaatgagcaagagccccacctagtatcagatcttgtgacttgaaagtttcccttcccatctaggaacagcctctcaatctctattcctctaaaatctactagacaatatccttgtttgattctctatagatattttagtgttaatctttccttgaagtttaagacaggtcatccaaacacagctgaaggtaaatcggagtgttggagatgatgccactctaaggcatagtaagccagttttctaagagttgagataacacataatgataaattacctacgacaaacacaatataactgttacttggattaataaccctctttttctcttcacatctcatcagttccctctgtcatctaaatacattcctatgccaggaatagaatttcagaaaacagtttactttgcaaattcaaaagtatctcaaatttagggaaaagaaagtgagatgaaagtttcagtgaagtcttctccaaagctaaaacaatcatttgaaaatagatgcccacaaatgttgcagcttgatttatagaggcaaataattcagcattaaatgaggagcaacatgattgctaagagtatatatgtttaaactgtgtcaacagctattacactgtgaagagggatttggattttgaacatcttgtcaagtcaagagacgttgtttacatttcactgctcactttatttctgctaccgagaatgagatttgacttcttccaaagaactcattgctacaaggaagggtaaatacagagagtagtcaaggtgatctcacaggggagaaggtaactaagcatccaaattgaaacacttaaatttaaacagctgtaaaacatgtaatcagccattcaaaatgtaattgtcaaaactggctacacttaccgaacatttcactctgcatttgtttgaaatgttttgaaactctaagtttaggttgaacattatatttggttagcagggaaaattttgcctattctgatttacagtgaactacaggaagctaataagttgcctgggagatactgactgaaactatgatctgcataggtcacttagttactaattggttatgggaaaggcatggctaagcctactgcactgaagatttgaaactatgaacaccacacacaggaggaaccttaacccttagcagtcaaatgctgcatgtaataatatgcagaagaggaaaatctatcctttaagtttgttaagaaccagcagttttaggaggaatcatttgccattctctgacagtttacatgtgtttccctgaaaaatgagataaagtaaaataaaacaaaaataagcacaagtttactcagagatgatgaaaccccaaactagattggtggttgagaaacatgatattcatggccttcatagtaaaagcattgttgttaagcactctactctcattacctcttttagcccttgtaactgctgtgatggatatgtctatatctccccctctatatttgaggaaactgatgcttaaagagactaagaaataggttcagcaaccatcctgatttgcccgagactgagaggtttcccaggttgcagaattttcactcttaacaccaggagactcctgggcaaaccagaatggttggtcaccttatgcagcagcaggtcacttacttactaactggttatggaaaaggcatggctaggcctactgcactaaagctttgaaagcaactccacatggcagcaagcatttctttctgtgttatagggtatcttacttttttggagacagggtcttgctctgtcacccaggctggagtgcagtgatacaactatagctcactgcagcttcgaactcccgggctcaaaggagcctcccaccttagcctcccaagtagctaggatgacaggtgcctgccaccatgtctggctaattttttaatttaaaaaattttaaattttggggtctcactatgtttccagggtgatctcaaactcctggactcaggcgaccctccttcctcaccttcccaaagtgctgggattacaggcatgagttgccatgtccagccttatagggtatttttcattgtactgatttagatattcaaccctctccactcatccttagacctgagagatactcactccatatgatctgctaaaccatccaaatgtgaacatcctcccgtgcccctgaggctgaaatggcagcattcacatgtatctgatacaaaatcttatttttatgatagagaaaactaaagctcagagaggtttaagtagttaaccaaggtgccatttaacttgacttctgtaaatcaccttgagacttaaaggaacaaattgtttttcctttaaattagaaatctttaatacctggattaggttcaaagggtaaactgtcaagggtaaatttcaagagagataatatttcaaattggtggtatcgaatgataaaaatacataatctgtaatgtgtatttgcaagtaattaattcggctgtagaaggcaagaaaacaaacaggatgggtgaagctcagaagatgcattaagcatagataagtaaattagtaatctgtaagacgtgttcaatataaataaggtaagtggagcatatgcgtgtgaaaatagaaatggttgaaaggacgaagtgactttaactattcatgatatactaattatatatcaagcatgtgtgttcccaactagtcacattacatgaagtatgtaatgtaacgtgtaagtactcagaagaggaactcttgaactatatatgaaaggtaagttttctagaagaggtgatacctaaaccaaattcttaaggctctgagaaggtaagggtgggctggggaggggcattcagatggagacaaccataggtagttgggtatatggatggatacagggtaaggaatcactgtaggttaattctatgaaaatgattgaagtcaaaacggaagcacagtctaaaaagtatgcaggatggaactcaaggagctcacagactgtcaaggaaagaggacgatatgtagcatctgacttacttatattgcaaataactcaaagcatgtattaatatctttagtaataatagatccaggttgggccttgggaataggtatagatttggacttatcatgtcaaaagacattaatgttcaaaaattttattaccatgtcatcaaaaatgtctttacttaggaacctaagaggttttcttttaatactaatacagcaactgaaaagagtaaaaccttgacatgcatctgttaaagtcccatctatagtcatcattatcatcattgttacctttattatttaagtaaatctagactgtgttaaataaccaccacacattatcttacttaatatgtaatactataaagtactatacaatatgctatactaatattataaaataggtacaatagtcccccacttatccatgggggataagttccaagaccccagtggatacctgaaacctagaagagtaccacacctgatggccatcaattggaatacacttctgttcatgtcttccattcacaagtttaatgccttttccatttaaccaagcacttagcatgcactgtggctgtaatttctgcaatttgcgatgtgacaaccaaactggcagaaatttcttttccttcttcacaatttcacagatagaacatcttagcaatctcagcatatgattcttttccttcctaaagttgacaacttttatctttcacttaaaggaagcaactgacagcttctttttggcatattcaaattgctagtatccttcctcttgcactttggagccattattaagtaaaataaaggttacatgagtccaagcgctgggctgccaggacagtcaatctgataaccaagacagatactaagtgactaataggtgagtagtgtgtacagcgtgcaggctctggacaaagggaggattcatgtctcagggaggacagagcaggacagcacgagatttcatcatgctactcagaagggtacaaaatttaaaacttaagaattgtttatttctggaattttccatttaatattatcaggttgaccagggctaactgaaactgcagattgtgaaactgtggataatgggagactactcttgacttaaatagactttaactgaaaatgaggctctgagagttgaagtttatacaatcaagaagtggcaaagttggcctaaaaagcctaatgtatatgattccaaaacaataaggtttgtatctagaatcagatacattaggcttcttaggccaactttgccacttcttgattgcataaacattatcagaaatacattctgataataaatattttaacaattagactttagttaacataactcaagtcagtacaaatttcaacaaagctgatagtaccaggagtcgttccaagtgcttttcatgattatataacacttttctattcttccatagccatgagcaaaaagcaagaagcacaatctgagtgccaaccctgcccacaatgttcagtagacaaaaatttcccatgatactcaaaattgcctggtgcagtctcacctaccaccaataccactgtgaggatttatttagcagattcatgatctatgcattcttcaccatcaacatgaaaggctaaatagcatcacaacattaacctttctccagagtaatttatataccattaagagatgcagtctgtcaaaggaaaaatgccactgatggtagaattttaatcattgacaaacatctttaggagacattttgtggttttcttttttttagattagggaagggagatagagataggatgtcagggggtatgatagagagtagtttggggaaaagcaaaccctctcttgccataggtccctcactttatttgtaatgactctacctctggatcataaatattgggaaaaaaatcattaatgagtgcaaattgttgtaaatgacaaaatagaaagttattagtctttagctacacatatgtatgtgtgtgttatcaatacactgctctaaacactacatggtgtgttatgaatttaccactaaaaacattatgcataaattggaacaattatctgtatcacgaggtaagatctacctgtcaaaacaaggggcttatagtgccaggaaatggagtgggaggattttatggcataccccaggagaggcactcgtgattagcggtccacttcccataagacaaccaaagtcagttgactggtgaaaaccaaaattcagtggcttccagggccacttctacttagaataccaagaaaaatgcttctgctgtccactcacctgcaaagaatggaaggaccttctccaactcacaggaaatgcatttctttccaacctgaagaattaagagttcgctagtcattctccctactttttgttttctttcctgtatcttggtcaaaagtgtgggaaaatcgaggcatgctaaagatattttgagctctcctaatcctcagttaaaattgtctgctctgctgaggcaggagaatggcgtgaacccggcaggcagagcttgcagtgagccgagatcgcgccactcttggacgactgagtgagactctgtctcaaaaaaaaaaaaaaaaaaaaaagaagtctgctctggagaatggtaatgaaatgtaataagagctctagaatgaaaccccatacgtaaaaacttttcatcacaccaactggttattctttctgagatgggcctgaaattaaaccaatctttaaagacagaagttcatagcaatctctaggatgagaaaacctgggctcattcattcattcatgcatccattcattctttctttcaacaatatttaccaagtgaattctaggtgatgctgcacttccatgtcttcttgttgagcgttgaagcagaaaacgagtgggagccaaaccatgacaattcaatgcctgacactgagaaactagaaaattcaaatgcagatggggcttcatttttgtctactgataatgtttttgaaagccttgatttcctccccacaactgaattcccaataaaggtatggaaagttcattgtgcaatggccggggaattcctgggtcacttgcaccgcttgaagaagcgattagggatggggtcactgtgttccccagtgactgtagtaaagagctgggaagtcaaggacccagtcactttctgagcttttgtttcctcagatttcaaataggcattaaaaaaacaaaacaaaacaaacctatttcaagaagaattaaagagagaacttccacaaagaacctgatcatggtatgtgagataacatacaaaattgctaagtcaggaacttgaaccaaagaccttctggttcaatttgcaagagatctacatagccacttgagagggtcagacaaaaattttactattaaaggagggcttgactgtttttctctggactcctgaccactcaggggccatgtgatgtgttctgagaaatggtgtcacggcagtaaaagatagtggccttcttcagagtcatgccttacagagcctccttagtgtttcacctggacaaaaagaaaaacagaatttcacagaaaattaaagccttactctctttctttgacaaagatatttggcaagattcatcatacaattccacaagcattagtcattgaaggatccaaagcacggactgaagaacagaaaaacctgctgatacaagtcccttctcaggaatggcttggactgaccaggctggttcttccacccaatttggccaatggatttcaaagacaaagttttggacttgaatttcggtaactttaagtctacggaagaaacttatcgttttgacaaacttgaaatatgatttgtgtgtacttgtctattctatctaatgagagatggcaaactccttaagaacaagaattgtgttatgtctggcacattgtaggtgctcaagaaatatattcactacatgaataaataaataaaggtcaacaaaagcctgcaaaatagtttgtgtgattattttttggaaagttttaatgataaagagtgtggtaaaaattaaatagaataataagaagaaatgaatccacgaattcatgttatttaaaaaaatttgaaattttaaaaataacaaataaaaataaaaataaaaaaataaaaaataacttgaaaagaaagccaatatatccagaaaagcagagcctgagaaactgcagaaaaatggagcagaagcctactttatctctggacttagtgttgagacaatatgtttcctcattgcttaagccagtttttctattatttgcagtgaaaaagtgctataattgattcaaaatcaatgcatttgcttccagtggggcatattctttccaataaccacaaggcattggttgcttcccctagacactccttcctctattggaagatctgggaaaccaaattagttattggaaatttctctgcctcaactcctcccttccctcctgagggtgagttctttaaaagagaatgggatgaattttcagagagcctgaaatacatttttagaaatcctgttgaagtactgtgacccagaaacaaggtcccctctccagtgactgagagattcaagacactccacagtgagaactttttttttcttcttgaacaatggtgaagaccctctgtccttgtcttctcctttgcttctctttgtgtagaccatcattgttcaaaaagtgtacatcacatgagcttctcatgcaaactacatatatgtaatttaaatttttctagtagttacatttaaaaagtaaaaagaaataggtgaaaataaagttaaatttattatgttttatttaacccaatatatctaaaatatcacttcaacgtgtaattaacataaaaactatagagttattttacatttttttatactaagtcttcaaaatcctgtgtgtattttacacttagagcacactgcaatttggaccagccacatttcaagtgctcaatagacagcacagttgtagccacacacaaatctcctttacttctgttacagcataaaactcttagacacacagcgtttagcatctaattaattatgtaactgtattacactgttattgcaataatcattaaacaagtgtcattccaaccccctatctgttttaatgcaatcttacatgaaacagtttcttatattgagatataggccagtcttgatgggtatagagatgtcattcctctttatccaaagatttccttattattctttactgaatgtcacatttacagctattagatgggaagattataatttattctagaaacttctatttttaaactatgtattaaccaaaattacacatgtatggggtacctgcttatttctagtaagcccactagctgatgtagcaaataggtagccaggccaaaagcaaaattttgatagttggccttttgtttaaaaagtgttttatatctgattagctgaattctaactatcttaggaaataaatcaactaacagtgtaagagacagtctactatggtggaaagagataaacttcagagtcaaacaaacttaaccctatcacttactagctttgtaatggtggatatattcattagcttctcacttgtagaatgagaataataatatattatgtctgagactgctagttttatcccaatatccattctccccttcttcatcagtaaataaccaccaaaagttagctagacacagatgcccagaaaaaagtccatgttttcagccctttcttgcagctagatgtgtttatgtggttaaatactggacactgaggtcaaaataaaagcggtgtctgtaacttccaggaagtatccttttaaaaagcagggagaatgctattttcttccttatggctagaattcagacatgatgggtggagctagagaagtcatcatgaaccatgaaatgtaaactgtgttgagaacagtagaacaagagcagagccctgggtctctcctgatcatggaatcgccaccaaagcccagggttttagaaaagaaagaaatgcatttctatttttttgagccattgttgttacttattttctctaacttgctgctgaacctaacacatgcttaatccgtagcatctttttgaggattaaatgggatggcatatgtagtccactttgtacagggcttggcacctgggaatgcaggtgcttaatataggactgtttttattactagcataaaatatctccttaaaagggtcactataagggtcagatgaaacctataagtgagcttgcttttcaatctgtaaatctgagaatcactgtataaatgttggtcataattatcatcatcaccattaaattattacaaggaactggctaactgccagcatgctctactatgatcaatctatatttaggtcaattaaaaatagatagatacagacttctttgcttttgttaggtttacttaactttagtcaactgtgaatgattgattataggcttgccattacattgttgcttcagagcttagatgaaacactcatttgggtagtataaagaaagcttagaacttgatgaggctatgacatcttttattcatttacttttaccttaaaaagttctctattacaaaaatcaatatagtgtttgttgttaaaataaattatagagacatgagtaaagtgaaagaagagagttcacccccttccttcttttccatcccattctttagaattaaccatattacaatgtaaccaattattccttgtatgtaaatatcatttttatataatgggatatacacatgtataatatacattttctatttccaaatgaaaaacaaaatcttttttttgcagaaagttcaaagttgttgaaaagaaaatcttttgcaacagcttttttgatttgttcgtttcccaatttaaaatgtctcctgggcatctttccatgtaaatacatattcatcaatcccattttaaaaaccatatacagagtcatttaaacatttttactaattaattattggaaaattgtttgtaaaataaaggagactgcccttaaaataaaatagcaacttagctaggattaaattaggcaattcagaaaaatgcttagcaaatgtttggcagattgtaaatgattgataaataaatattagccattatgatattgatgatagtgatgattaaagatgactatctctctaagctcactctcaataaatttctgttgtcagagaggtggtttattttatttaattgcccaatatgtacatttatatataatattcccattttatattttcattttaaggacgtacttggctgtgttatatggtggaggtgggtgccgtgttctggaaggactgtcagactcaagttggttctcttcaggatctgcccaacccatggcgacctagtacagtgccaaaattgaacaaaaaaaatacaatccatccatctgtcagttagtgaggcagcaaagaaggtatttagcttctaggacatttaaaaacctaagttaattctatctaaaagaaagacatctgtggggtgggactcgcctcctctgagcctttgagaccagtggggatttaaacaggtataaataatgactcttgaatagccaccagacagccagtggtgcaacctactctagggagatgagtcacaggctgagccgtgggtagtaagtccctaggagaagggaagaggggtgtctgggatcccaggaagagcaataaatgcagtctgtcagctccgcagcagaggaggggctgtgacagcagccctcacccagaaggggtgaatggtaaatctacctcaatagacagtggcctgtgcattgtaaatctgatcattttgctgtgcccaaaacatcttaagtataattataccaaagcctgaaaaaagactggctaaagagaaaactaaaatagattttttaaaatgcaaacacacaattctgcctacaaaaatgttaagtgccaaggaaaatattgttaaaatccaagaggacctcctttcctaagctgcagtgttcaggaatttatatgtatataaggttggtagtgaccatggacaaatcattgcctacacctctgccagaacatctgtcatttctcatgaagccggaactttaaatgtcacaactagatcagaaataacattgatatcagaaccatcatgtactttttttctgctctgcatgtgagcatctggggtgcctaaaatccaaccctcacagctcttgaaaagtcctgtgtcttgcagaagggatgcctttcagtgatgcatccgtgaggaggcggcgccttttgataattcacacaaaggtcttgctagtagagggaggccttaccttgactggaggagagacctacgtttggatctcggctaaagtatcttccaagagcaacattcttgttagcataacatgccattttcatgtcctacagattcatagatttatggagttttgaactagttaaatgccttagaaatgaccaatacccacccattttgttgataagggacctgaagcatagagaagtcagatagtttgaatatttgtccctacccaaatctcatgttgaattgtaatctccagtgttagaggtggagcctggtgggaggtgtttggatcatgggggcaaattcctcatgaatggcttgggccatccccttggtgataagtgagctctgagttaacactgagatcacatagtttaaaagtgtgtggcacctccctcacacctcaactctctttcttttgcttctgtttttgcctcatgatgtgcctactctcccttgacttctttttgagacagggtctcactctgtcactcaggctggaatgcaatagtgcaatcatagcccactgtagccttgagctgccaggcttaagcaattctctcaccttagcctcccaagtacatgagaccatacgcatgcaccaccatgcccaggtgatttttgtattatttttgtagagatggggttttgccttgtttcccaggctggtctctaaattttgtgccatgcaccaccatactcagatgatttttgtatttttttgtagagatggggttttgccatgtttcccaggctagtctctaaattttgtgccaagcgatctgcccccatttggcctctcgatgggctgggattacaggcatgagccatcaccacacctggctttgctttctgccatgattggaagcttcctgaggctgctattcttcttgcacagcttgcagaactgtgagccaaacttcttattttataaattatccagtctcggatatttcttcatagcagcacaagaatggcctaatacaaaaagtgaagagtttgcccaagtttagatagctaataataatttttattaaatgatattacaatataatcttcactgggtttgtttatagattttttttactaatgcatcagtagaactacatgtacttattgattgaggtttaagctacaatttcaagcaaacatgtgaaaataaaggcaattcttcttgctctttagatcattaatgtttagtcctcaatacagatttccacattccactacttcattactatactacgtttttaactagaattttgaggtcatatccgctgagaagtcttttttcccctctagaatgggttgggttccctcccaggtggggtagccctatcatcactttgggcttgctctgtgatcctgtttgtgacaatatcttgggattgtctatataattttgattccctagttaattataagctctgtgaagattaagactgactgggcatttttttcatcattgtatccccagtatttaaaatagtgtttgcaaatataaacagggataaataagcatttgcagaaaaaggaagaaggaaggaagcagagatggagggagggactcatatagaaattgatatgaaaaatggaatagcaaatgaatgataaggaataagagatagaagcagaactaaatgtgaagaattgaagagttacctaattcacaaattttaaaatttctaaataagtatgacagagcataacactattcagcagagtctcctgtctttgtctttgtttgtctacttgcagatggtggtgtttgagtcatgtggcagaaatgctccaagatttctgcctcctggtgttcgcatctttgggtaattccttcccattgagtgtggccagaagctcctgtgacttgcttctaaccaatgaaatatggcaaaggtcatcaggtgtcactctgtgattatgttacatttatataagattctgtcttgctagcagactgctctagagactccttaccggcttgatgaagttacaatagcagctgtgttaggaaagcctgtgtgatgagtaactgcaggtggcctttgggcactgagggtggcctctaggagctgagggtaacctccagtcaacacccagcaagaagccagagccctcagtcctacaattgcaaggaagtgaattctgccaataatctgaatgagattattattcgaagcagattcctccttagttaagcctccagatgagaactcagcccagttgacatctggtttaaagactggtgagacaataagtaaaggactcaactaagccatgcccagtctcctgactcacagaaagtgtgagataataaaagtgtttggttttaagataataagtttgggggtaatttattaaacagcaaaggtaagtaatacaaggtgtttggttataaataagctataaaactagctgagagaaagagagaaggaaggaaggaagcaaggaaggaaggaagaaaggaaggaaggaaggagaaagaaagaaagagaaagaaggaaggaaggaaggaaggaaagaaagaaagaaaagaaaggagaaagaaagaaaggagaaagaaagagaaagaaaagaaaagaaatgaagaaaggaagagagagaaagaaggaaggagaaagacaagatggaaggaatatggccttagttaaattgtatggattttttttttaggtttaatttggtgattttcaaatcagtacagaaaacatctgaagaaattacaagattttaagaaaatgacaaacatcagcaatttaccaaggcttcaagggaatataagaaatctgataactcatcaccactaaggcaaatttgtgtgagtgaattctatgaatacataggactggacaagatcttaagaagacagatggtctatactcatcttcaggtaaggcttttcctaaatacttccaaacaatgatgatgatgatggtgacatcaatactgtgagcttttatttactgagttcctcatatatgcatatcatacagaataggaagaaactaatttttatggaacacctgcagttgtccatgtgctatactgcaaactttatataagtcatcttatagaaaatagcaagcccttacaataagtcccaattatttcccccattttacacacacacacacacacacacacacacacagccagccagagacacacaaagaaaaagtatcttgctctaattcacccaacaattaagttgtaaaactatgattcaaacccatatttaatagtcctcacgatctgaaaaatttcccaagtaatctaatttccaacttctaggccatcttctaagccaaaagatgctagataggtaaccatcctaattttttccaatcactttacattaaaaaaaatgtgaataggctataaggtaaaacaaatttaaatatttggaaaagatttgaaaacacaattaataaaagagaacttcaaatggctaacaatgtttggtaaaatggtcaccctcactaataaccagaaaaacacaaatttaaatgagatatccctttatacccatgaggtttgtaaaaattataattttcaataatactaggtgttggggggacagtgagacttggagcctttgtacaaggttagtgggaatctgggactgatgcagtcagttagcaatgtttggagaaattggtgggtgtaccctagatccaatgatagggtctcccacgtattttgtgggagctaggagctggtgtcaaacaagttctattattagggaacaaataaataaaatgtattcaatgcacactatggaataacatgcaatggtcagtagcagtgaattagcacgtatagcatcatcttaaaaatagcatgttgagccaggtgaggtggctcacgcctataatcccagcactttgggaggccaaggcgggcagatcatgaggtcaggagttcgagaccagcctggccaatatagtgaaacccagtctctactaaaaatgcaaaaaattagcctggtctggtggcggcgcctgtaatcccagctactcgggaggctgaggtaggagaatggcttgaacctgggaggcagaggttgcagtgagccgagatcacgccattgctctccacctgggcgacagagtgagactccatctcagaaaagaaaaagaaaaaaagcatgttaagtgaataaaaagtatggcagagaatgaaatctattgcacaatatcatttatctaaattaaaacatgcatgcatgtaatgagtttatgtatttttcaaagatatttatatattcaataacatatatcaagctcattagaatggctgcttgtggggtaatgcgaaatggaaatgaggtcaagaatgaactgaaaaaacattatgaaggaaaagaagagagaggcctgaccagacagctaatgactgaacattattaactacagaatgtgactaactcatctctcagcacttgaggtatccccaaagacaactaaaaatgttgtggaatgaagctctattgttactggctaaagagcttatgctgaccttggatatttgaatttacaaaagtatgtacccaacattttattgggaaaggaagccacaccaggaaaatgtggtctgaaattctgtagggagcagaggaaaattttttctaaagataaagtaattaatttcttagatttgtacttggagaaaacatgatggcaaatattttggccagtgttagaatttgttcattagtcttatcttaatggaagagaatctgtttgcctttgagcagaacagtcttgtggtagattgttactctatgtataaatagcaaaaagagtccttcagcctgagttccactgtcaatcccgctcattcactcaccaatcaagggctttgtgacctgcacacacaggttcctgtgaacaccttgctctgcaaggcagaatgcatcaataggattgttcttttgtcctggtcaacctgatttcataaggaagaaaatactaggaaaagctaatataatcctcctccaaataatcacacaactttaacatttttagacatagggtccagaacacattttcaatccagtgtttcaggaagttagaaatgatacattaataaatgagtaaataagtaaaccaaaaaatgaaaacaagcaaaacaaaacagaaaacctaagatacacgtctttaccttaaatacaatatttacccttggctacaaatttgaggtaatatgtcctacaataaatgttataatttggctgaaagtgattttatccattttgataagatagatgaaagataaagaaaaaataggctaaataagaaataacttcatttatctacactttttaagaattacggtttatcttatgtgattcatcacttaacctgatgactactttttgttagttaatttcccattttaaaaaaacctaaatgttttcagtagaattatttattgtttgcagtgattagaaactaactatatagttttggcacagaatatccaagtatccataacaattaatgtgctataacagtaatgtctgcaagggtcactggaatgcgaggacttggcatgatgcaaatagccctgaacttccacatgtttacaaattctatttgcctcttcttggtacattttctctctgttttcttttacttctttttaccatgattttttttagatgttacaccctcccttggccatcctcatgcctaccatggtcatatcttttcctgtgtgtgtgtgtgtgtgtgtgtgtgtgtgtgtgtgtgtgtgtgcatatatctatctatatatatgtaaaatgtatgcttttatatatatatataatatgaatgcatatatctatctatatatgtatatatccatatataaaagtccatgggttttgtgacaaccatgtagagaagttacttgctgtttactttagggtatgtgtaccaacctcaattatccaggggaagttctaaaaactttgtggtacccagagtagggaatcctttctgttcaaaattattttaaatacattgtcacggtttttatttggatttatctgcctactaatagatatatgtgttccatctggggttgatagttcatttctttctataaggtgatcaaccaaaagcaacagatagaattttagtagtacctgttttattttgcagctcctgaattttaccaatgagttaaaaaaaaggtgtttttttttccctttggctaactccaaaatattcagaggctgacaaaatctgaatcttatttagttcttgttatagcaacagcaaaatttagcattggaatgcacaaacatttcttcatctgaagaggtatgaataacttctcagcctcttttgtcattagaatgctactctccagttgcaaagagtaaacctcgtgaatggggctatgtctccacacttagcagtggaattgtaataaaattacagtaaccacctttttgttagaagttctctgaagttgagctattaacataaccaacagtacctaaagtgtgacctgcaaacagagcttttcaaacaccaaatacaatgccctattcatggtcgatactctataaatagcagatcatcatttcccttcccttaatccttagaatagccttaactagtaaatactgttatctgatttttaagaataataataaaaaaaagaagatgtatctggctatccaagctggttacacaaactcagtggcaaaactatttctgaattggtctatattctctcaatttaagagcctcccagcatcgaccatcatgcctctttgcaaaagtgcaattgttaaagaaagattgggtggtttgggccctgcaccatgggatgcaccaacaatttcatcaaatgaccctcagaacagcctgaatgtcacatgaataattttcaacatgtaagcacagagggcacacaaggatagcaacacttaaaagctcaaaaaagcatgaattgcaatatgctgggctcctataatcacacataatccaataatgtcttaaatcagtattaaaacaaatatttttttcaagggttcacaggttattttcatgaaaagaattttaaaaatgagaaaattatcttctaatttgtgcctttatttctttaatattattaagtaataatatactgtcaaccctgatgtcatactgagaaaatatttctgtgtaaatctaacatcttcattatactctcaagccacaaataacattatatcacaaatttacatgtaatagatagtttccccaaaaagaatttcattccttaaaaagtgacaaagttttagttgtatttctgaatagtaacattcagataaagatcaccaacaagtgataggtggcaattttcaatgaagaaaactattgaaaataatcaagtttaccagtggaagaaataaaataatctactcttgatgtattctgtgatattataaaaacttttcagtgatggcaaatgtaaaaagaaatataaacatacatatattttttttctgatatacatataaatgagaagaaatataatggcaactacaattttaatgtagtttttaccttgatttaagaatgtccagtggaaagatacttttaaagcataatgcaacaataattaaaacatgtacaattcatgaaacttaatatcattcttatactttccaccttaaaggtcagaagtgaatccatgttataataattccttttgtaatttatctcaatttagtagcacacgtgtgaggttaacttatctgcaactttcctttaatattctaggacttaaaagttcttccagggttttaaaaatatttctattttcttcccctttatgtataggaggagttagttgttttaaaaaaaacaaaacaaatacctgtgaaatgtgaatgggcattggttaagcattatattggtttaaattaggaggagatcaaggagaaaatactcacaaacagataattgtcatccagactcttcaattagttacattttctttcttttttcttcttaatgaatgagaggcaaataaatctttggcattcccagtgcctctgaagtgtaaactccaccagatcatctagatgcacaactgtccgacaacattataataaaggcagtaaataaatttgttcaaaataccagccgaaatgcctgaggtttcgtcagtggccatggttgaagctcatcatgatttggacagtgcagccgaaacctcgaagacttatacaccgagcaacaatgaagatactgtataatcaactaggattacagaggaaaaagcacaaagtgctttcagtccataaaagaagtgattatcacgaggaaagagaagtgactgttggatttaaaaggcatacagagagagagagagaggaaaaaaaatatatattatatatataaaatgtcaccaccctacccccagaagatgttgaaatcacaaagaacaattttcaaaggaaatataataagcttacagatgaaaaaccacttacacaaaccattttcagctgtacactttgttaaatgatctgcaaaattagaaaaagaaactgaatcgttgttgaggtacattatctaaagggtacacggtatccagaaattctgttgcctctttcatctgagtcaatgtgaggtttgcattagtaaaaattgtgtatttaaaaaaaagaaaacaaaaaaagaagaaagctagagaactagtatcaagccaagaaacaaaaggtagtcaacaatgttcttttctcaatgcagagagggcttattgaaatataagcaagaacctttttttccttcagctagtatatatgagttaaaattttccagttcttctgaaaaaggtcatttctataaatgatgcattttaaataccatttaatagctgttattgaaatttggctcatgaaaaaactacagttatatttttttgtgtgtaatctggcaaaaatgtcactatacatgtcagctaattgtgtaatatcttgctgctgttttgtttcctgtgcacttccatcaacaatttcagcttataacagtgattcttttccttttgcatctcaatatacctgatataaactttttctcccatcaataatagtgattcatgacagtaatcatgaaatctttcataggagacaatgttgttagaatctgtctctaggggaaagttgagaagggattgcatagttcagcattttcctcaggagattcggatgtgacccctagaggttataaaccgtaccaccttttgagaatcactgatcttcctaggggttataaactaccttcccttttgagaattactgatttctgaatgaagacaaagaatttatagtttttctttaagccaaattaacatacttctagaacacagtgtatagatgctagacacatcatgggcattcacttacatttgatagagcttgcactttgattttttttttttctggtagcaataaaagatttatgcccattcaccagcttagttgtgatcaccatgtaagaaggttgtctggggttaaggtactagataggccattggatagaacaaaatttcactttggcttatttgcttagcaattccaaccaaagctaatgagctgtagatcaaagcaatttgttgacaatattaatggcagtctcaggtctaagtaaattatctgacctttcactccgttacttggctgtcaggaagctgaaaggaagagttcaagcctagtcttggttgtgactacatttgctagcacctgaaataatgagttttggtagccacacgatttttttttgtaattaatatatactatttgtacacttttatgcagtacatgtggtattttgttacatgcatagaatgtgtgatgatcaagtcagagtatttagggtgtccagcaccttgagtatttgtcatttttatgtgttgagaacatttctagccctctcttctagttattttgatatatatacaatacactgctgctaactatagacatcctactctgctatcaaacattagaacttattccttctacttaactgtatgtttgtaccaatttatgcccatccattcctctacccacccacacacacacattcttgccaattggtaactattacttttaacattacttttaaatggcaaaaactgcaattacttttgtaccaacctaatatttcactctgtacttctatgagatccacttttttagctccgacatacaagtgagaacatgcaatatttgttttctgtgcttggcttatttcacttaatatggtgacctccagttccatccatgttgctgcaaatgaccagatttcattctttcttaatgaaaggtgaatagtattacattgtgtgtatatacaaattttctttatccaatcatccaatagtggacactcaggttgattctatatctttgcttttgtgaatagtgctgcaataaacatgtgagtgcaggtatccctttgatatgatttcctttcttatggataaatacacagcaatgggattgctggatagtatgatttttgagaaatctccatgttatttttcatagtggctatactaatttacattcccatcaacagtgtataagagctcctttttctctgcatcctcaccaacatctgtttttttttaattcttattaatagtccatctaactggggtaagatgatatctcattgtggttttgatttgcatttcgctgatgattagaaatactgagcattttaaaaatataactgttggccatttgtatgtcttctttagagaaatgtctatttatgtactttgcccatattttagtaggattattaagttttttttggctgttgaactgtttgagttccttgcatattctggatattagtttctatcagatgaataatttgcaaatattttatcctattcaacaggttgtctcttcactctattgatgatctcctttgctgtgcagaagatttttagtttaacatagtcccatctccattcttgtatttgttgcctgcacttttgagatcttagccataaaatctatgcctaggccaatatcctgtggtgtttcctctatgttttctcctagcagttttatagttttgggtcttatgtttaggactttaatccattttgaattgatatttttatatgatgagagatagctgtctagttttattcttctgcatatgaagatccagttttaccagcaccacgtattggagtggatatcctttccccaatgtgtgttcttggagcctttgttgaaaatcagttggctataaaaatgtgggtttatttctgggttctctattttttgtttttttgtttgtttttgtttttgagacaaagttttgctctgtcgcacaatcacgtttcactgcagcctcaacctcctgggcccaagcaatcctcctgccccaacctcccaagtagctgagattacagaagcagactacatgcctggctattttttttttttttttttagacctggggtcttgccatgttgcccagactgtttttgagctcctggcctcaagcaatcctcccaccttggcctcccaaaatgctgggattacaggtgtgagctaccatgcctaaccttgggttctctatttgttccattggcctgtgtctgtttttgtaccaataccatgctgttttgattactatagccttgtaatatattttgaagtcaggtagtgtgatacgtccagctttgcttttttttctcagtattgctttggccattagagctgtttttttgatctgtaacaattttagagttgtttttttctattctagtgaaaaataacattgatatcttaatagggattgcattgaatctgtaaattgatttgggttgcatggtcattttaacaatattaattcttccaatccatgagcatgaggtgactttccatttgttttgtgtcctctctaatttctttcaccagtattttgtagtttttcttatagagatctttcacatctttgattaaatttattcctggatttagtttattgtaaatgggatttattgtaactgggattgcctgcttgatttctttttcggctgtatcattactgatatgtaaagatgctactgattttttttatgttgactttgtatcttgcaactttactaaatttacttatcatatctaacagttttatgttatcagcaaagaggatcaatttgatttcctcctttccaatttggaagccttttctttcttttctttgcctgattgctctggctaagacttccagtactatgctgaatatgagtgatgaaagtgggcatccttgttttgttccagttctttgaggaaatgcttgcagtctttccccatttattatgatgttaattgagggtttgttatttatagactttattatgttcagatatgcttccggtatgcctagtttgttgagagtttttattatgaaggatcgttggactttatcaaatgttttttctgcatttattgaggttatcacatggtttttgtccttcattctggtggtgtgctgtgtcacatttattgatttgcatacattgaaccaccattgcatctctgggataaatcccacttgtattatatttttgaagtgctactggatttggtttgctagtattttgttgaagatttttgcatttatattcaccatgtatagtgatgtgtagttttctttttttgttgtgcccttgtctggtttgtgtatcagagtaatgctggccttgtaaaatgagttgggaagaattccctcctcttcaatttcttggaatattttgataacaattagtgttaattcttctgtgtaagtttggtagaatttggcagtgaagccatctggttctggacttttttttgttaagagactttttgttactgattcaatcttgttatttgttattagtcttctcaggttttctatttattcctgattcattgttggtaggttatatatgtccaggaattcatccatttcctctatgtttttcagtctgttgtataggtgttcataatagtatctgatggtattctgtgttcttgtggtatcagctgtaatgttgcctttttcatttctgattgtgtttatttgcgaattcttttcttggctgggttggttagcagtttattcattttatttatcttttagaaaaatcagcttatcattttgttgatcctttgtcttacttcttttgtctttatttcatttagttttgcccctatctttattatttcttttcttctgctgatttcgagtttggtttgttctcgcttttctagttcccctaagtatattattggtttgttaatttgttatttttttactttattgatataggcatttattgctataaacttccctcttagcactgcttttgctatatcccacaggttttggtatgttgtgtttccattttttgtttcaaaaatttcttttttaatttccttcttaattttttcattcacccaatggttgctgagagcatattaattttcatatatttgtacagtttccaaagttcctcttgttactgatttctagttttattccaccatggtctaagaagatgctgagtatgatttcaatttttaagaatttattgggacttgttttgtagcctaacttatggtcttttttggagaatgtctcatgtgctgatgagaagaacgtgtatctactgttgttgaataaaatgttctgttgatgttgaataggtccatttggtctaagttgcaatttaaatccaatgtttctttattgattcctgtctagatcatttgtctaatgctgataatggggtgttgaagtctaaaactattattatattggagtctatctctgcctttaggtctaataatatttaatttatatataccaatgttgggtgatatatatttagaatttttaaatcttcttgctgaattgatccctttattgtgttttaatgacctttttctatctatttttactgttttttgacttaaattctgttttatatgatattgatataagtatagctacttctgcttgtttttttgttttccatttgtatggaatgtctttttccatccctttacttttagtctatatatgtctttacaggtaaaatgagtttcttataggtagcatatagttgagtcatgttttaaaaaaatctattatatttagctagtctatacattttaagtggaaaatttaatttgttcacattcaaggttattattggtaagtgtggacttatccttgtcattttgttaattatcttctggttgttttctatctttttcctttcttttttcctttctttctttctcttttgttgtttatcattgtggtttggtgtttctctgtagtgataacatttgggttctttctcttccttatttgtgggtttgctttaccagtgagttttatactttcatgtgttttcatgatggtagatatcattcttttgtttccaggtatagaatgcccttgatcatttcttgtaggtctggtctagcagtgatgaattccctcagtttctgcttgtttgggaaagattttatttttctttcatttatgaaggacaactttgctgggtattgtattctgggttgacagttttttttttaatcactttgaatatatcattctattgtctcctgacctgtaatatttttgctatatgtatttttaaaaatccccagttagtctgatagaggttccctaatatgtgactaaacacttttctcttgctgtttttataatgctctttggttttgacttttaccttaatatgccttggagaataacttttttgacttatatctatttagggattataaacgtcccatatctatatgtctaaatctcttgctagacttgggaagttttcagctattattttgttaaataggttttctatggatttggtctcttcaccttctggaacacccaaaattcatgtatttagttgtgttgtgttcttatgtcacaggatttgttcattcttttttattctcttttcttcttttcaaaaaatctgactgggcaatttcaaaagacttgtcttcaggttctgagatttttgcttttgtttgatctattgttgaagctcttgtatgaatttttaaaatttcattcattgaattctttctttccaggacttctggtttgttcttttttattatatctatctctggtgaatttctcactcacatcctgaattgtttttctgatttctttcaattattttcagtgttatcaatcatagctcactatgaactcaagttcctactctcaagcctgcctcaacctgctaagtatttaggactatagcctgcagtgtgctgccattcctggctaacattttatttttatttttagcacagacaaggtttgctatgttgcctggattggtttcttgtgtttttacgttgataactgtacctccggtgtaacagtcacttcttccaatttttttttgaattgacttttacaagggaagggatttttcctgaagatacatctatgctgttggttgggtaggacactagctttgattctgggtgcatgcagtagtgtagtctccatatgatttattcagctgtaaacagcatcagctgtgtctgtgatttcctaagtggcttaggttgttgttgttagtggaggctatggtgaggttttgttgaggatgaggattacaggtaggccagtcatcagattccagtcgcggcagcagtagaccaagcatgcctggcctcgggttcccagttggcgtatgaagtcaccagtgttagtgggttgaaacaggccaatacttaggtctacagatggctgaagtgctgcagtggtagtggtgggtcagtcagtcgagtgggtccttggtccctggatagcatgtgtgatgtgggtgatggcagtagtaatggcaagacaatccttgggctctgaagtgacacacattggtgttagtgatatctacaaggagctgggtatgtcagtccctcattccctaggcagtatgtgcagtgggtgctgctgtggtggtagcagccctaggaggactgcacagatgccagtggtggtggacagggtgagacaagcccttagacagtgttctagggcactggagtggggggagtgccaggccaggtaggcctgtttccagggaccccaggaatgtaatcaggccctggctatggtgggcagagaggagtgacactcaggctcccagtagagagcttgggagtctgctacaacaggggtggtaggcagggaaagcctgccattagggtatgtccaagtatgctgcagtcctgctgttggagtagaggcagagtttctgacagtaactatagccacaggcaggcagttcttaggctgtgtgggaggagggatgctttaatccccagtggcagtggcagtggtatatcagctgtagtagcagcagggaaaactagttctcaggaaatgtgcaaatgcgtgatgggagccctgctgcttggtagatggagtcgtgaccagctacatgtgttttggcttctggtggcagcaatagtggctgtggctggtgatgagagggtctgtcctcagagtgtgattgcagtagccctgctgctgggggcagggtcattatatgtggtagctgtcccaggtaggtggttctctggccatagagagtatgtgctttggctttctttgtcctgggagagcctccctagggtgctgcaccaccgtttacctggcatacagggcactgtgtgtgctggagtgctggggaccctgccattctgctgagtctgactggtgttattgctgctacggctctctgggtggacacagaatggtgtcagtggggctccagggacgtgaaggtgcaggggctcttgggccccaaggcgggatgcaacctccagtgggtcctaagctctcaaaatggccctatggtgaatctgcttaggacttggtgggtgcgttggaccattatgaactcccactctagagcaatgcctttgtgtcatctccaggcaggtccctatgctattctgagagcctgtgatggggtctcccatggctagggtatcaggagtccatggtgggaatatggaaaggtgggtatctactgcttacccttttcctgaactagggagtctttatgagctcccagctgatcccagctgagctgactgcctcccttcctgctccttccatgcctcaggtgcttcctgttccttctctgttgaattccaatattctctcttagatgctctattcgaagtttgattatgcacttgctattttggttcttgtctgtggaggaggtaagtgtcagatgcctccagtcaggcttcttgaagttcctctcacataagtctttatgtccttcatgacaatcttactatcccaatgagtgaatgactatatgacaaaacaatcttattatatgtcgacatcacagtatcacagtggatactatggtaggcaccatgcccctattcaaaatcaaggcactcatttccccagatgccaggagtattggctgctaatggctcatagctaaacccctctccaagcactggccttggattaagactatatttcctcctgaagagagagtggggcagcctgtgtacaatgcaggaccaggactagggtgaaaaactggccttgagtgctaaatttaagcaggagccaaaaactcagtaatcaaacaatattttaatgtaatattttaaaaataaaaaatgcaaaggttctgtaattatcaaaatatcacaattttaaataaagatataatcaatatgactgatttttctctttgcttgaggctccaatatggctccccaaaacactctctattttaaagcattatttaaaaaatactaaccaatgcaaaagttcaccctgaacaaaatactgaaatttttaaataaaggctgacttttgcattaatttaggtttaaaaaataataatacattaaaatattatttatcttggctactgagctttttgacgccctctaaattttgtcctcaaggcaagcatctcactcttcttatgtagtcccaatcctggcagattgactcaggggaaaccaatgtctgtctcctttgccttaaagggaggccatgggaggccatcccatcaacacagtcccttggggatcagctgaagccttccttgtgacttcattgcagtccaatcctgcttttctccctcccttaccagcattattcctaagagtatcctgcaggtgagtctctgagtctctttcctctaagacctccccagagaagagaggtgaaaactgaagttcacagaaggtgaggaacttgcccaagctctcagagctcctatgagatgaaaacccaggtgagaccaggcacagtggctcatgagggtaatccgagaactgggaggctgagatgggaggactgttggagcccaggagttcaagatcagcctgggcaacatagtgagactctatctcttcaagcaataaaaaaattagctgggtgtggtgggtgcacgcctgtagtcccagctacttgtggggctgaggtatggggatcacttgagcctgggaggtcgaggctgcagtgagccatgatcacgccactgcaccccaccctgggtgacagagcaagaccctgtctaaaacaaacaaacaaacaaacaaaaaacaaatcccagtcaagttagtatgactttaaagccagtgcttctcattataacattctataggctggggccagaatttgtggctacagtctaataagtcaaaggtaaaacagagataccagcaatccctatgcactctcctaattgaatttcctaattgcagactagaaatcaggttctctgatttctaggaagtgggcctccgattatatcagaccctgtagtcagcagaataatgcccgcatccccactgaagatgtccacatcctaatccctaaaacctgtgaatgtgttaacttacatggcaaaaggaactttgcagatgtgattaagttagggatcttgagcatatgctgcattatccatgtaggcccaaatataatcacaagggtccttattagggagagagggaggcaggaaagttagagaaggaaacatgatgacagaagtagaggtcacagtgatgtgatcatgagacaaagaatgcaggcaggccttagaagccagaaaagtcaaggaacagagccttccctacagcttgcagaaggaagggagctctgttgccccttggtcttagctctaagacccattttgaacatctgacctccagaagtgtaagaaaataaatttgtgatgtttgaagcctcaaggtttgtggtaattttttatagcagcaataggaaagtaaaagacccctaaagcagtgtttcagccctggcattatggcatcacccatgtggctctgagatgtattggatccctaacagaaaacaggtaggaccaccagaacaatttaatgaagacttctcagttgtattatatttttaaaaatttaaaatgaacttgtatatgtggaaggattgatgatctgtactgactccagatggttatgttctcctgatgacagatggaagtccaggaggcggggccatctacaggaaagcaggagagaaatgattgatataggaagccagtacaatccaggaactctttatacaagcacaatttttacttttctgattctccggtagtattttttgaattatggaaggagatgaacattcctatttttttaatatggaactagctgtactgttgtttctctttccttgctgtgctagaagagtctggagtttaagctcttcttgtatttgagcaaaagttaatgtttttaaattctttttgttgattagacatttgggtctgatggatcactaaggtttattataaaaaagtttgaagttcaaggatatttcttcttttttacattagttgtaaggaaaaggacaaaatgccttggagagaagccagaacaagagaatttggagcatcaacaaaatatgttgaacataaacaagagagtagagtttcactctaggcaagaaagtggttctcccagggggatgaactagaaaaagggagaggaaagtatcatgtgtatatgagtaggaagatgaaggaaacagggaagggggaggtagttatagttaagcagatcggatcttaagcaactttgccaatgatattcttaccccaagtgtatgccagcaagatatggttctactgctggtgacctcatagaagcagagtcatcactggagaaagacatagctctcatcctgatgggcatctcctgcccctgaggcctcagttagctgcacttgccttctgcatctcctggggatttcactccatcagttagcatcttgtttactgccttccctaaagaagtgatatgtattaatattagtctgttataacatcgctataaagataccaaagactgggtaatttatagtgaaaagaggtttaattcactgaaagttctacatggccagggggccttcaaaatttacaataatggtggaaggcaaagggtaagcaagctacctccttcacaaggcagcaggagagacagcaagaaagcaggggaaatgccagacacttatcaaacaaccagatattgtgagaactccctcactatcacaagaacagcctgggagaaaccaccccatgattcaatcacctcccaacaggtccctcccttgatatgtggggattataatttgagatgagatttgggtggggacacagagccaaaccatatcatgatgcctatccatttctttgaattttgtttgattcctgactgacttattcttacctcacaatgccccaggatatatgtgagcccaagaaaatgggattaaagtcagagagacttagtagcgtggcctaatgaaaaatccttggggctaactggagccaaactgatttgataccttcccagcatctctccatcttttacatgagctgggaccatggttaatggctctttttatataataatttaaaaatgtgtaaatataagggccacctagcacataaagaaggaatataaaggtcaagggtcttgttgtttatcaacatggtctttgagaattgcttatactcaattttgatgagcctggctctttatggctccttcttccgtgatttggaaaagtgcaagcctgggcagctgtcaactcattgatactctcagcagcacagttccgactgaactcttagtttagtcatggtgatatctagtggttgtaccactagggtggtacagcccttggtactgtcctggtttgggttgcttggacatttggagaaataaaacagatgggagaattatgattttgaacaaataatttaccatgttgcaaatttctttatcagtgaaagtccagtaattttctacattgtttaactaaaagttgtgggtttttaaatgtaggtgttcaactaagctagcacttgagtgaattaaaaaaaaaattggactaaatactgtggagggagaagtgcaaaaggatcagataacatgttgtagtggagccttcaggctgtctgcccagcaacctttttatccatagatgtgggcctgggtaacctgtgtcacctggtggcctccttcctggccatattggtggtgggagttggggactaagaaactacacatcattctctgcatgtggccaaacttacaacatgggagtagtgaaacgtctgtgagaagtgagaactagtgtattagcccattttcatgctgctaataaagatacccaagattggataatttataaagaaaaagaggtttcatggactcacagttccacatggctggggaggcctcaaaatcatggtggaagctaaggaggagcaagtcatgtcttacatggatggcagcaggcaaacagagcttgcacagggaaactcccccttataaaaccatcagatcttgtaagaggtattcactatcatgagaacagcatggaaaacacctgcccccatgattcaattacctcccatggggtccctcccacaacacgtgggaattcaagatgatatttgggtggggacacagccaaaccatatcactctgccccttgcccctcctaaatctcatgtccttacatgtcaaaaccaatcatgccttcccaacagtcccccaaagtcttaactcatttcagcactaactcttttaaaagtctacagtccaaagtctcacctgagacaaggcaagtcccttctgcctatgagcctgtaaaattgagagcaagttacttgcttgctagatacaatggagatacaggcattgggtaaatacagccattccaaatgggagaaattgggtaaaacgaaggagctacaggccccatgcaagtccaaaatccagcagggcagttaaatcttaaagctccaaaataatctgctttgactccttatctcacatccaggttatgctgatgcaagaaatgggttcccatggtcttgggcagctctgccagtgtggctttgcagggtacagcctcctttctggctgctttcatgggctggcaacgagtgcctgtgactttttcaggtgcacagtgcaagctgtcagtggatcttccattctggggtctggaagatagagacccttttctcacagctccactaggcagcaccctagtggggactctgtgtgggggcttctacctcacatttgccttccacactaccctagcagaggttctccgtgaggtttgtccctgaagcaaaacttcttcctggacatccaggcatttccatacatcctctgaaatctaggtggaggttcccaaatcccaattcttgacttctgtgccctcacaggctcaacaccacgtgaaagctgccaaggcttggagcttgcaccctctgaagccacaacctgagctctagcttggccccttgtagtcatggctggagtggctgggacacagggcgctaagtccttagactgcacacagcagagggacactgggcccagccaatgaaaccatttttccctcctaggcttccaggcctgtgatgggaggggctaccttgaagactactgacattcgctggagacattttccccattgtcttggcaatgattcacattcagctcctcgttacttatgcaaacttctgcagccagcttaaatttctcctcagaaaatggaattttcttccctatcaccttgtcaggctgcaaatttctgaacttttatgctctgatttctttataaaactgaatgcctttaacagcacccaagtcacctcttgaatgctttgctgcttagaaatttcttccaccagattccctaaatcatctctctcaagttcaaagttccacaaatctctagggtggggcaaaatgctgccagccactttgctaaaacataacaagagtcacctttgctacagttcccaacaagttcctcatctccatttgagaccaccttagcctggactttattgtccatattgctatctgcattttgggcaaagccattcaacaagtctctagggcattccaaactttcccacattgttctggcttcttttgagccctccaaactgttccaacctctgtctgttacccagttccaaagttgcttccctgttttcgggtatcttttcagcagcatcccactctattggttccaatttactgtattagtctgtattcctgctgctgctaaagacatacctgagactgggaagaaaaagaggtgatatggtttgggtatgtccccacccaaatctcatcttgaattcccacgtgttgtaggaggaactcagtgggaggtaattgaatcatgggggcatgtgctatttttctgatagcaaataagtctcataatatctgagtgctgttcttgtgatagcaaataagtatcataatatctgatggtattataaggaggaatttcctgcacaagctctctctttttgtctgctgtcatccatgtaggatttgacttgctcctccttggcttccaccatgattgtgaggcctccccaggcaagtagaactgtaagtcccactaaacttcttttttttctgtaaattgtccagtctcaggtatatgtcttttatcatcagcatgaaaatagactaatacaagaggtttaacaaactcatagttccacatggctggggaggcctcataatcatggtggaagcaaaagctactacttacatggcagtggcaagagagaatgagagccaataagtttcacaagatctactggagaagaccaggtctgcccgatatgagggctttccctctgcctggcacagtgcctggcatagaataggtcttcagtgaatatctggatggatagttgagtgaacagcaacatgcagaaagtatcagaggaaaggcatagagtcctgcccacattccagtccctggttccagttccttcccacctttcagctccagtgccaacttgaagagttacatataactcaggccatcctaagttggtttctgctacttgcaaattgtagagcaatcactgataataatggtctctagcttgggggaacttggagtatacttttagacaacctgaaaaaaaattatgtatttgtgtaactgattccttcctctttacatgtgtgtatttatatatgaatgtgtgtgtaggtacatgtatataattatatgatattatttttggatatatacatatgtatataaaaatgcatatataaaaatgaattgggcaatttaatcaatgttcctgagctccctttttacctctaaaatgaaaggatgagattcaatgatctaaaattttaaaagtacacgctttccaggaattatgtaattgctttgttagaaagtcaccagaaggtatactgttgctagaaaagaatgcccagggaaggcactttgggaattcacgtacatgctatgttttgtcattgctggaaatagtttggcagcgcctccaggaagtacattcacaggtattcacatattctccatggaggcagatgtccagtctaatgactgtgatgactgagggtgctggtaatgacagttcagacagaaaagcaaaatttagttaagaaacagcagtaagagttttcactgtgaactggccatgaagacagacccacaaggagtatcattcactgtcactatggatagaacattggtgaggatgacataccaaacctttctgaagcatcagaaaggtagataacctgcagttgcagtccccaaacttggctgccctctttttggctgggacctcagtactcttctcacatcaagcatgggcatgtaccaggtgttcaattagtactgagtggtcagttaagccaaactgattataacagtcatcagtgtttgaatcaggtgctttatgtatattttcttacttcacacagttaacaatactctttttagtttctttgtaaaaattaggaaagtgagacctagacaccttatggaacttgccccaaatcacactgttaaatggcacaggaggtcaacccaggttgtttgactccaaagcccatgtgctatcctacctctctcttctcagccataattagaggcaaatgagaatagcacaaagcatttttccttatatgtattttaacttacaacaaccctccataaactattatccattggaaccacaatattcttgtgaataacatcatctgcctggaaaataaggtaataggattataaatctttcaaaaaaatgtacctaagtattttcacaatgtggaaaatacatgtggtactctgtattttcagagacatctgaaagggcagtgcatcttctctgcactgttcgcatgctctcttagctgttcgtgtgggtttcactggcatgcatcattgctcccccttctcctgtatgcctaaggtagggcacttctgccacccactgaagtttggttctaaaaaggtaacagcttaaagggaatagcagaggggttagttatttttttcaaatgagtgtggagaaaaagcaaccgagcaggctcttcccagatgcctgtttctagtcagcaggctgcttgaatcccctggttgaacacatttcagtcatcctgtgcctaaggagaaaaacaccactcctggctctcgtcgctatggcaactgatgctcagcaggcagttgcagtttcatttaacaaaactggcttttagaacttgaggggaaactatgctttcatagaagagaaaagggaagatgagtggtttaattaatgtgtctcaatttaacatgaagatacaggtcacttccactgtttgaccatacagcatctagctccgctttatatctgtatcagatctaaagcttaaaaggatgggatatttctctcatcatatgtgaagtgtacagtgggcagaggaggagaagcaggggttgtgttagaccctttgcgaaaggtttttcactttataaaaatcatctcggcttgagagtgtatagaagaattgctttctcttctctcatccacaaaggaggcctgagagatgggttgctaggcaacctcacaccgaagacaggggcgctgtggaattaacatagctgacctccccatcagctctgcagctctgctattcaaaacgattttatgagactgtaggactcaagaaaatagaaataaaatataaatacaaaaataaagaatagaggatataaatctaactttttcaagtgaagattcaatgagaaagggtagcagttggaaacggcgggttgaggggaaaaaacagtattagttgctataaaccagaaacttgtattttgaataatataggaagaaaattttcctatttctttagaaatgtttatggctgacagttaacctatcacagtaaaagtgctgaaaatacttgaggtcaaacagaaaaatcagtttataataatgtagatctacaacatacttttaacaaaaagctcaactctcaatccttaccatgtgatggtctgtttaagctccagagtcccttactctccttcctgccactatatcatcgatatggttggcgtgggaagggatggcatttattctgcaagtagatgaatatttggaaggaaattgcaaagctgatccatgaaacagagcacacactcttatcagcaataaataatttaggtgttttttttttttttttttttttttttaagacaagttttgctcttgtcgcccaggctggagagcaatggcgcgatcttggctcattgcaacctccacctcccggattcaagcaatgattctcctgcctcagcctcctgagtagctgggattacaggtgcccaccatcacaccaagctaatttttgtatttttagtagagatggggttttgccatgttggccagtctgctctcaaactcctgacctcagatgatccacctgcctcggcctcccaaagtgctgggattacaggtgtgaaccattgtgcctggcctagtttgatttttaaaatacgtcatactactggaaaatggttctggtaacattttaggatagtttgttgaatttatcaacaataaattaaaaatcgaccaaagttggtggcattgtgggaggtgggagactgaaaacaaattctgaactggtttttgtagattttgtagacttgtttttgttataaacgtttgggtgaagcaattctgaaaccattttaggtagattataaggttgaagaaatggacaaataggttgaagttgttaggatccaggaccacactctggaaaagggtcatacaaataagaactagatgtcagtgtatgtgagactgtgtgtatgtacagtattcgtgcaaacacctgtatgtctatatgtgtgtctatgagtatatgtctgtatatgcatatgtatgtaggcatgcatatgttttccatcttctgaaaggatctagaagcaattacaccctagtagcaacgagcagacttagcacttggatcctcatctctaacaccattcccaataaaaggaaccagggctcctcagagaaatgtgtgattccaaggttgaagcagggaaatgagaagttgagcctcagacaccttgttatgatagaaagtaagaaagtgctcaaaaaaaagaaaaatgaacaatgagagcatgtcacaaggacacaggaaccagcctgaagaggcttctgctggacaaatctgaaataatttgagcaccaaaataattaaagacattaatgaatgatgaaatattgaaaaatagaatttcacaagactgtatgatgttaaatatttttaacaacaaaaagctcaaatctgaatcctcgccatgtgctagtttgtttaagctccagagtcccctactctccttctatattaaacaatggataaaattattttatccaggaggaaaaaaaataaagctcaactctcagtcctcactatgtgatagtttgtttaagctccagagtcccctactctcctatattaaataatggataaaaatgaaaagcaaaaacaataaataagcaaaggcggggctcctgcttatggtaaaacgctaagtactaactgctgggtacatgtggagcctttattaccctcacagtaaagatgggactaggcaagaatcatgatcaatccagtggaaagttttgaagaggagcacgatatttgatctacgagtgtctcctcacagattgcttattagttgcaagaaaaaatataactatgtagtggagaaatttgaaggagtaatcaaaattaattcacaagtgagggcagataaatatgtgtgcttccatatttgataccctgaggacatactacttatatagcattatggccagggatgtttagctcaaattgaatcatgatgaaatatcagacaaaccctaaatgaagaacattctactacaaaaaaaagagggtgagggacattttcttcaaaaaatgtctatattgtaaaagagagaaaggctgtggatatgctccagattaagcaacaataaagagacaagacaagtaaatacgatatctgattccagagtggatcctgactggaggaaaaaaaggacttcattggatcaattgatggtaaatgatgtggattaaagtatggaatccatgttaaatttactgaagttgataactacagtttgattatataggagtgtatccatgttcttaggaaatacagaccactgaagtacttaggggtacagggatgtgtacgatgcttgtgactttcagaatcttcagaaaaaaaatcatatgtatatatgtgtgtatacatacgtgtcagtgtaaatgtatacataaaattcgtatactcacacagaaagcacaaatgataaagcaaatggtttaaaatattaggaatattttaatgtttaccttaatatatatggtatttgcaatattatttatgcaactttctgtacatttaatttttttccaaataaaaaattaaaaagttgtttcctttttgtagaaacaaaatcattcttattgaaacttgaataatgaatattgggcattttaaaaaatctacaaaaacaaccacccagcacatacattttataaaaggcagtagattcatgtgtttaacacaagtaagtgacatcaggatctagacatgtcgtttgtcccgtttcctcaccttgactcttcacatggtacgtattcaatcattttaactttgcccttgcgatttctcaatatcctgcacttgcacccacccagagtccccctcaatctatcctctgcaatttgtaacttaagtcaatgtgaaaaattggacaaaaaaattcttcaggaaactatgtaagggaggagtttttatgtatttactagagcaacttcacatattaaacttaaactgtatgaaaagagcatttttgtaactgcttagcgttttagtgcattctttttcctcaaagttcttaagcttactgtgtttttcaaagaaagtttaatctgtaactgtgaaaaaggacctattgccctgacccgaaataagtgaggatactactgaacattttgcagctttgtcctctgtgtttcatgtggttttttaaggttcttacatcatttacccattaaaaataaaactaggctgcttttggtgaaaatggaaatagtaattaccttcttaaaatacccccttaaaaaaaaaacaggatttcttttacattgccaaaagaatttgtttgaaggaagataaatgtaacatacatactatttgaaagcagcctggtttaagggttgccatcgagtctcatgttataccactcggaagtaagacatttagaacctgctcattactccgcatccctcatttatgggatcagattgcttttatgggcattgtgccagattcattgatgtgcacttaaggcagattgcagagtgaaacgtttttctagaaaacatctggttcttaagaggagcattagaaggagggtagcacatttttgatcataactgggatttatcatgttacagtaactcccctctaatctggcaggcagaattccaacaaccacaaccaggaacctggaaataagtgaaaaatacctcagagtccaaagaaaacagaggtccaagatcctgtgcatatgaaggagtggtattgcccttagctcaaagactattttattcattataaaactactggagccaattagcataagggctcctgaagccgcctttatatcaagtgagtctttctgcagttcattcgttccttcactccccttgcaaaaattgtgcaccccctggatgccaccatttttctactcaggttttcccctcctctctttcttgtaccttcaatatttactggcttttttttttctccatagatgcccaagtagctcttaccttaaaagacagacttctcacacccttatggacacatcactcttcaccctcagccttatttctaaaaacttttctatactgactctagttcctctccttccattcgcagggcttccaatagcctatgagaaagttgtattcaaattagaaaagggagtcctcctgcatggagatgcagttgcagagtggtaagacttggaggatttctgcctccatctcctgtgcccttggctgggtcactctgtgcagtgcacacactgcacgaccacacgtggaggctctgcaggatttcagatatttccactggtttttaatttattatatttggtagaatcatcattaaaactctgttaatggaataatggactaaaattacagaggactgggtttgctctcaatcctttatgtaattgcaggactatgctcttacacatcccctctggaactcttacgttctagtaccacttctgttaccactcctactactactttctggcttttatttccatctttcacttcctgaatctctatcgctggccatcgaagtaatatagattgcattttgcattaacaattaatagtaaagtgtggtattgagagttgaaatgtcagcttttgtttagcttcttctcttcgtctgtgttcagaaaaataactttaaacagcaaaaagcaagtttgagaaggctattctctaaaaaacaacaaaaaactttttttattgtagaatatatgttaattccagttaacttttacaatggtaaataaatatttcatcactcagatataactatgttaacaactgggtttcatctagttttgtgtattcttatatgcatctatagttttggcaaatggatatattattatttgaacagttacattttcctctttattcacttattttgtgagcattttagcagttaaaatctttcaaaaattttttttttcttttttttttttttttttagacggaatctcactgttgcccaggctggagtgcagtggcgtgatctcggttcactgcaacctccacctgccaggttcaagcaattctcctgcctcagcctcccgagtagctggcactacaggtgcacaccaccatgtccagctaattttttgtattttagtagagacgaggatccccgtgttgcccaggctggttgcgaactcctgagctcaggcaatctgcctgcctcggcctcccaaagtgttgggattataggcatgagccaaaaaaattaaatacataaataaatccttgaaatagttttcaattactacctactactatattattggtcaaatcttacatatgtgacaacctcatgttggatgttttgataaccaaaagcagcaaaaaattcagttacaatttttaaaattggaaacctttgagaaatttcggaatatttcctgtgataaatttctctacgtgggatcacttggttaaacgagagactcttattttgtgctgtttttagagaacagccttctcgaacttgctttttgctgtttataagttattcccttcaggaaggctgtgctacacttcgatgagcagcggtctgaatgcggtggtttccttgcacctttgccaaccttgcttctaaaaaaatctgtcagcatgaacgctgttgtatgatcctattttaaagctattcacttgtcatctccagtcgcaaactaggatagctcctgtcagattcttaattggtcttttggtttccatagtgattccattatctacttctactctagtgcaaagttcaacttgcttcctcagctgtccatgcataaaagccttccagatttgctctaggttcttgacttctggggaagaaagatatttcctcttggacccagttcaccatactagctgaattaaggtcaaaagtacattaaacttacaactgtgtccttaccatgacggggggcaggtgtccagatcccagatctacagaaaattctttcatttctgttgtgtccccctgcttccatcctgagtgtacgtccccaaactttcatttaacatgtcatgttcattagttccttcaaatactagttcagagcagtctggaatcaagactgcctagtttgagctccaactgtcacagatcttgggcttgtcacataaggcaatcaaatccttaaagaagaaaaaacatcagaggtagtaaatgctgcatagagtttaaaaaggataatatgatacagaatcacaggatggctacttgagattgtgggcctggacatgaacacggcctctttgaggaggtggtgataaagtgatacctgatggaaaggagcaaacctggagaaggaagctcagagacaggaagcgggggtgaagggagggacaggaggaagagaattctccactgaggagagtagggcaaaagcaagctccaggtggataaaatgagatgctgcatgtggagtctagcataatggttggtgggtagagagagaggaaaagagggaagtagttgaacaaaaattagaagggaaggaaggagggaaggtgtgaatgaatgagaatctcaaatcctgtagggctgagctctctaggggactttactcatccttttaatcttgctttgaactgcattttctcttctcagttgcaattactactttgccctgttctgcttataagaggagctactattaagagcctagtgagtcagattcattataggttttatataagttccctttaatccttacaacctgaggcaggttattatccttatatgcttgtttatgggtgagaaaactgaggctgagagtgtgtaacttggagaaagatgaaacatctaggtaatggtagagccaaaacttaaatccaggctggtctgatttcagatccatgctcttgactgctacactatagtgctcctcaattagactgctctttaatagtttctacatttgtaacagctgttcattccactcagtccatcttgttcttcattatttagctatctctgtgatacaccagtttcttctgctagccagatgtagaaaagatcacttcttcttacagaaacattatctcttagttatagaaggcatcttaatataataaataaggcagaggctttgaagttgactgggccagtatggaattcaggttctgacacttttctctgtgaccctgggcaaatcatttagtccaggtctcacctttcttatctgaaaagtgggaatattatttctcttaatagctgactgaaaattaaaagacataaagtaaggaaagtccctaaaatagcatctaacaaatggcaggtgcaaaataaatggctgcttaagaaacaaaaacaaaaccttcctctcctcttacagataggaaaactgatttggaaatgtcttgctgagagaacagatgctctatttctctatccaatttccatgattccagcatcccatgacacaagttcactggaactactaaaggcattctgttaatgtgatttctgcctgagtcagctccggctgcaataataaaatatcataaactggtgggcttatcaacaaaagaaatctgtttctcacagttctggaggctggaagtctgagatcacggttccagcaccaccaggttctggtgaggaccctcttttgggttgcaaatagttgacttcttattttgtcctcacatggtagaaagatagctagagaactctctgggatcctctttttaagggcactaatcgcactcgcaagggcttcagccttatgacctaattatttcctaaagcttcacttcccaatactatcacattaaagactaggatgtcaacatacgaagtttggggtacacaaacattcagtccatagcattgtccttaaaaatgtccactcaggctgaaagatatttctccacctgaattaaagaaaaagaggtaatgtttcacgattccagatttgtaaaacagggataataatgccggcattttaggtttgtgaagatcaaatgtaaggaatatgaaagtattttaacatatatgaagtgacttataaattctattattaaacattctatgaaatgccataaataaaagctaggtgacaaggcggccagattacttgaggccagaagttcgagaccagcctagccaacatggcgaaaccccatctctactgcagatacaaaaattagccaggcgtggtggcgtgtgcctttagtcccagctactcaagaagctgacgcaggagaattgcttgaacccaggaggtagaggttgcagtgggccaagatcgcaccactgcactccagcctgggctacagagtaagactctgtctcaaagaacaacaacaacaaaaaaccccacaaaaaactgttttgctaagtgaaaagaagaataattggaattttataacgtaattgaaattaaagggattttgaaaaatgggagaaatgatcagaaacaagagaatggagttcaaaacaaacacaggacatttaataaaaagcagcaaatgacttataaatactgtttattgtaaatgcaaataaaattgaggactgtgtttactacaattttaaggaaaattgaaaaagatgtagatgagaaattaaaaataatgctaaggattaagtttagattaggttaaatttagtgtaagagagtgaaagcttctatgccagggtgctgttaaacagagctgggtaaaccgttgccttcacatggtgtgctttgtgactccctgctgaccaaaagtatttggtcaccctttaccatcaaatgttacagtgtctgaaattatacctgcagaccaagtcttctaggctaaggttaaatatccctaataagggacctatttaaattgaggtttcaggacctgattatttcttaagaccacaatggccttgaaagcaggaagaatgagctcaagaaaggaaagggaaacacacactctacccttttctaaaaaagatttttcaatgaaagttacattttctgtactataccaccacccattaacattacagaatgcagggggagcttaccctgatttgcaaaacttaccacatcttttgagttccaagaggaatataaatcatctatttataaaacctttattaaaatatatatttaaaatatatatattgtctttttcatgagttatttacagggagatttattccaatttttgaaacaacacagaatacaacaaaaacaggctgggtgcggtggctcatgcctgtaatcccagcactttgggaggccgaggcaggtggatcacaaggtcaagagatcaagcccctcctggctaacacggtgaaatcccatctctactaaaaatacaaaaaattagccgggtgtgatggcacatgcctttagtcccagctactcgggaggctgaagcaggagaatcgcgtaaacccaggaggcggaggttgcagtgagccaagatcgtgccactgcactccagcctgggcggcagatcaaggctctgtctttaaaaataaataaataaataaaagaatataacaaaaacactttaaaagagaacaatgcattttaaatatatttcctgaaataatattccttagaaaagatacagggtatttaattacctagattttaacaaaatattctttatagaaataattatagtctttaccacagagtcaccaaatctgtacccaatcaaaacagagtcaaatagaccagctctcattcaactccattaggaaacaccaatttcacatagtacttctcttgatgtacagcagcaacctctgctggagaaaaaagggtatacttctaataacaaagcactgagctcaaacctgttttgaacaggaagaactgaaagttagatttctttcatttcctgttaaaccaacacctaagttaaaattattttcaaggtcttaaagacgcacgggccttatcaagtatatcctttctgatttttggataagttggatgtgcttcaagaacctgcaaaacaaataaagaacccataaaaacttgtaactaataatcaaaaactacggagttacaaaacttataagaaatgagcattacagttaagatttccttgtactaatactacaacagctataacactttttaatggtggcattttaaatgtaacatgatgactcctttatattaatggtagttagatgagaacaatagaatgtaaatatcaaatgcagaaaatataacaaacaactgcttacctaatagatgaattgtataaaacaattatgtatcaatgatttaaaatatttttgtaatttagcttttcattcataatatctgataaacccttagagagtgacttttatacagcagcacacattagctttacctgaaatgatcttgagacatacgtatttctagttctactgagtctaagagtggggagatgctagtttttttttttaactccaaaaatgatcctaatatatagccttacattaacacacaaccctaacctgactgaaatactgctttacagagactcagtaatcaacagcaattactaaggccaagtatttactgtaatgatgctaacagattgctgtgtgggataaggggcattacaaaattcttttctaatgaacttttcttggaggtccttacaatgtttaatagaatgtcttatatggaatatcaatgggacaatgtatatataaagagactctacaaattctaaaactgtaatttaaatatttgtcattttagtaggtgatcatttactaggggatgaattacagaatgcaattgaatgacttctaatagaattcctttttatctctaattgatcagtctgaattctctaataaccagattcagacacattcacaagaacttctaatcagaataatgatctggagaatctatactgtcttcaaatatcttctaacttaaagactacattttatttaacatgtttctcccactggtctttgtctttttttttttttaaagtaaaagtctcttttactccacctctttaatcctactcctttccatacatgtaaatattttatggtttattgtttaatatgtactcttcagtggtctttgtctttaaattgacataaacattttattatttgatctcaaagtaaaaacatgttttttatttaggtgaacatcattttctaaatttcgaacactgataatctccctaaacatactgataaatcatttaactaaaataatgtatcctctatttctattcacatacatctggagatttaaaaaagtaggaaattgtgcatctgaaaaattttaagaaatctaaatttaagtgtttacctggtgacatatgtcaattgaatccacatatctttttgcttttaagtaattaaatgccagtttgtatcctgttaagacaaaaaccataaaacagaatgatggagtacactgctactattacttttccttgcctcctcctctctttgcttactcactagagaatggtaagggaggctggtgaatgaacaaccaaactacgctatacagagaagttgtgtgataatagaagacagagtgacacaaaagaagtgtaagaagaaaagaaagtggagttggaaaaaaggaccacagtgaatacattgataggttagaaagctgccatcccacaagtgtggtttctataacttactagaaaagtctcatttatttcaggttatagtaaaaactcatcatagggcagtaaatgacaacacagccattcatttatacagtacagatttatttagcacttacacaggcaaactgatgcctacagttatgaggtttgcattctattaggagaaaaagtacattttaaaataattgcatgagtaaataatttcaaaactgagataaatgttatgaaagaaagatccaggccaagtgagttaccataaagaacctgaagggtatcaagagatgtctgaaatctgaagaatgaggcataaactaggctagggtgggaatcaaggacactctcagacagaggaaactgcatggattaaggccagtggtaggacacacagggagttaatgaacttggagtatggtgagaagacagagcacataggagagcgacacagaggaaggcagattagtcatcaatgactggtaagaattatcacaattactgatagtgaaatgccacacttctactatcaacaattagaagaatatttaacacattcctcttaatggatgttgttctcttgtaacatgctataaaaatgagaaaactaagaagacaagaaaagtaacagcagctgtgcacgcagtaaacaagatataatgcaatgtaaaataatgtgtaataaaaaatatctcactctacctcttaaaaatatgaaataagaagtgtaaatagtgctcttcagctctaataaaagtaccaaaacaaatgtttaaaattttaaatgtttgaaaagaattactggctaacattatcagatggtagtaaaaagaaagaaatagaaatgatctaaaattcacactattttatatatagtcaggcactgcatgatgatgtttcattaacaacagaccacatacatgatggtggtcccaaagatttttatactgtatttttgctgtaccttttctatgtttacatacacacattgcttatagcattcatgacagtaacatgctgtacaggtatgtagcctaggagcaataggctataccagatagcccaggtgtgtagtaggatctaccacctaggtttgtgtaagtatactctaagatgttcacacaatgatgaaattgtctaatgatgcatatctcagaagatttccattgttaagcgacacatgactgcatatatatatgtgtgtatgtttatatatgtgtgtgtatatatatgtatgtctatataggtgtgtatatatatatctctacacacacacacatgcacacaggcacacatgggcagggcctatggcagaatctcacatctcagattttagacaaaaataagaagtttcagagaggtaaacttaatgtcattaccaacaaattctaaaatgaactaaaagggtttgtgacattcaaaaagtaaagcaatttttaagatgtcatgccaaacatacttacatgggaactagtcaagatttcagttttggtttgtggtttcttgactagctttgggatcttacgcaagtggcttgagctgtcattttcaggtttcctcatcgctaaaacaggaataacaactcctccctctaactcttagtataattttaaaaatcatataaaatacttgtgaaatggtttttaaaaccttagaataccacaaaatattagcattttttaatgtaagcattcactatattataatcacagaattttaacactggaagaaacttgatacatgacctggtacaaaaatttcagaggaaataaagacctaagaaggggaaagaaaatgtgcactgcagctgcactacacctgccaaacttattagaactcaactatatgcaatcaggagagacagcgagagaatgcaaacattctacacagtctaatgactgtcctataacctgagaataggtatgaagggtgaaacatgagtagtttcttctctcattggatctcagttgttcctagtgtgtttctttttttcctcgtatatatttaagatatacaaaatgatgtcggtgtgtagatgtgggtgtgtagatatatgtgtgtgtgtgtatatatatttatttataaatgattactgcagtcaagcaaattatccattcatcattcatcctggtgcctcttatagtgacaatattcaaccctgaattctatggaaagagcatgagcacgatttttttttttttttttttgagacagagtctcactccgtcaaccaggctgcagtgcagtggtgtgatctcggctcactgcaacctccacctctcgggttcaagcaattctcctgcctcagcctcctgagttgctgggattacaggcgcccgccaccatgcccggctaatttttgtatttttagtagagacggagtttcaccatgttggccaggctagtttcgaactcctgacctcaggtgatttgcccacctcggcctcccaaagtgttgggattacaggtgtgagccactgcgcctggccatgagcatgattttaagggttttctgacaactgaaaaagtgaaatacattgtttatttggccaggcacattgagggtgttagatgcaatgacaatcttaaggatgaaattgaggaattaatggagagccttagaaagaaatgattaccaaagcaaagctagaggaactgataaaataatctataaaatacaatgatgacacaatgaaagaactagtcatttggaatctctttatttgctgaggtcttccaaggaatggaatatataaataatttaacttctatgtgcattccttctatggaataaagtgtcaaaattaatattttaaggatatttaaggacttttcattttaccagatgactttattctgaaagatatatcacaccttagaataaaaaatactataaaaatcattagtttttgtgctttgcacaagtctagtatagtatgagaacagactccaggaaactaacagatgagggaagacctgagctaacagcagttagtatgaggttgactcatttgactgcaaatcaaaatcgaattcacacggtgacatggctgctgaaaagactgatgccatcttaggctgaattaacaactacaaattgcctaatcaaaagaaaaaaatagcttaattatacttataagaagccaaatcatatttgagaggttgttcatttatggtacaacaggtcagaggggcatggaaaaataaaacagcactttccaaacttacatggccatggcatctaccaccttcacacttcattctttttaattaaaaaaaaaataattattaaaatctccccaactgttccaaagcacagtttgggaaacactattttagagcttccaggagacagcaacaaggaagatgagagactcggaatccaatcttaggaagaatggacaagtaactgcagatggcttgaagacaagtcctaggacacaggactgaagattgcaatttaaagggtcatgatctgtaagagggaggcattctgtaagttgctccggaaaacagacttgggcagtttcaaggaggcatatttcaacccaatacaaagaaagagtacacaaacatgaggatgagctccctcgtatgaggagagaggttggtcatgacatatattctgatgccacctctgttagggacactgtagactagcattacccaaactaacagcctgcaacatccagcctgggactggatgatgtttctagatgctcaggagaaaaaaaaaatgtcccatggtcaaataattgtgggaaacatggcccctctgtgatatccatcgcaatatacgttagtgtttaaaggctttgagaagtaaagaaacctgtgtaattcaatttaatgcaatattttcctaacttacttggcaatggaaacatctttttccatggcattcccaatttcaaaatagcaccttcttttagaaggaagagaagggggcagaattagactagatgtacactaagtgactgaggacaagtttggaactcaggaaactgaactattagtagctaataatatattatgaatataaaatttattctcctttcagaaaggttgacaatgaaaattgactcaatgtttattttgttttgaaaaaaatcaaatgcatttaaatgaaaattaataaatacaacataatttttctgtgaaaaatctaggtgattgccaaactcacctactgccggatttgtccgattgctatatttccatgccatctcatagttcaaggcagcatctgtatatgcttgctctttttccataatgtatcccatatattcataagctttgcagcaagactgaagaaaaatgggagacatcaatagattaaacttgatatcactaagattttatgggatgtttgtgactatagaggtcaatcatatcaacccatttaaatgacaaatcaaacaatggttttcaaccttggctaggcaatcaaattttttactgaacttaataaatgattctgatggcaagtctccatcacatatctgcagaatcaggattttctttacagaatcagaaatacacaatagggcacttgtgttttacacaagcacaggtacactattatgagtgatttaaacacatacaaatacagagataagagcataatgaactccatgaacccttatcttcaataattattttttgactaatactgtttcacctctatctcacaaacctacccttctgtattaccagaaaaaatcctcagatattgtatcaactaagtctaaatgtgttagtgtgcatctgtaaaagaaaaagacgttatttaaacagaaccacaattttatcacacctaaaatgttaatgactccttaatagcaccaaatatccagtactgtctaaattttaattgtctcaatataatttgtttttgttagattgaggactgaaataaggaccaaacattgtaactggtcaatgttttgatctagtctcttgatccagaggtttcccttctggtatgtctgtctgtctctctgtgtctcttttcttgaaattaaatgtaatagaaacaagaatatttatccccgagtttctcacaacgcaggttaattgactgcatccttgtggtgtttatataatatattcctatgtcactgacgttttctggaagttgtaattagatgtagaggtttggattcaattttgattctggaggagagaggtgaatctacttcaaacatcagtgctatgataagccacactgaggcataaaaacatggatgcatgtttttgtatatttcttaattgtaatttttttccagaatatgagtttaaaaatattgaaaaatctgaaagtatatattaaaaatcactacatttaagactgaacattttatttatacctaaacttaatttcttatcattttacttttctcactttaatggaagaaatctcaccagtaatattttcattaaaaccattaccaattacccattttttaaaaaacataaaaatatgaatataggaatgcacatattcccttttgattcaggctccaataaagctcagcacagctgcattaaattattatttatcttgattactaagtgtttcacttgtctcatcccaaccctagccctgccatagatgtctgttcttctgttgggaggcacagaatgtctgattctccctctttttgtgatgttacatccatatataaatttatcagggttgaaaaatggggatagcctatcagtctttcttcattaattagctggaaaatgtctatgatgagaaacgtctcattgactatttggttaaccaattctgtacagaaaaggcaggatatttatttgcaagctttagaaatagcagtcagttcactagcatactgcagtggttaccaattaggttttttgtttgttttgttttttctattttggatcttcgagaagtcatggatttaaacagattttatgtatttcaatatattgcagttatcattcttatcaatacttaaagcatcccaacttcggctactagaggtgtctttaagttggcccctagatctttcacacaaactctaatcatcatggatagcttccttcatcatctggtatggcaagacagtctagtgtcgtcttgtacatttcctgccccagatatggatgacttccattttttaaattatgtaattcaagtttcctaagctttagttcttaaatatcatgctttcaatatcaacatattcaaccagcagggctgaatgaagcttctaaagcagccatcatgttcaaccatgcaatgtattgttatcagcgttctggcaaactgaaattgtatgtgcactgaaattctcatgcaatcttggttaatcctagactagatatagaagggtaaactattcagcagtttagattttcaaagcctattaatgagcattcggcttttcaaagccaatttaacataaaatttatgtagctaatcgtctagaatagtgcataaattgacaaatgcttggatctttcaggttcttaagttcctaggaaagtatcttaatagtactagataatcacaattcctctttaaaaaataaacggtccatttgtaatctaattcgctcaatgagaataaaacagatttactgtgattaagattttgaagtaattgatatgaatatatgaagataaatatcatttctaagttgtgtgcaattatttctcaacaaaaaaataaatcttaactttaaagaactgttataatgacatcttttgtaattaaacatcaaaatgttagtaaaaagccttaaattctaaggactttataatattcaattttatacctaaatataaggaatttttattaaacaaatgaaattaaaagctgaaaagattttctcccacaaaatatattatgcataatagattctaataatgagaaaatgacatgcagctgcagtaaattcatcaagagtatttcttaatgggagggacagacgtccgcaattaatgttcttctgcaattttcattagttctgggatgagatggataatcacaggcaatcgtttgacattccaaaaacactttccgttaagtagggcatcactacagctgaaacttgaaattgcataaatctttcttttttttaaactttaaaggacaaatggcttttttcttattattaatgcttgtttcctgattgtggtaagaataaacatttaattttcaaaaatcacacaggaatccttggaaatggactaacactcaacaatatctatatggaaagcttatgcaacaaaggtcaataattattttttactcttcaatcacctactctattatgacgcaggcaccgttttaacaggtcttctgccatgtcatattttgctgattgaatgtaaatatcagcaagtagcagccaactcttctcaaactcttcagcatcaatagcattccaattcattttcgcaatacgcttcagctggtttctggctcgtggagtctgtttcaagatcatataagccgttgccattcccaagagcgctgggatatgctccttctataagaaaacaaaattttagaccataagatgcataaacataaatgccccaaaaacatacagaaagcagaaaatgctacataagaactagtttgtggattctatttctagctccattacagataactgtgattacaggtcattatttaacacatcaagtaccctcaagctactatgaagaaaacttggtcaagcactgtgtggtcaagataattgaagataatgacaactattcagatgccatatgcacacaattccaagaattagtgagactttatctttaatgggattcaaacagtcatgttttagttttgtatagaaacagaaaaaataaaactctatttcagtaaaatccttattgagcagtttgtatttcagatttaacatttaggctccttagttctttcacctgtcaaagacgagtaacaataatttacctgcagatgatggtccttacccattatgacttctattgctttttttccccctcccttctccttttatccaaaaacctcttctcccaataaagtttgaataacgaaatgttaaaaataaggcatataattaattcaccacttggaaagtatatgaaataaactcatgccttaaaatatgcttttagatttggagtctgcagcttcctaaaacaatctatatgatattcttttggatagagtttgaagtcagagaatgtcactctgtgaaaccaataggttaatgagaactcataaaatggaggccattagtgatctatccagacaactaactttcataagcaataatgtgtatgttcctgattaaggtaggatgcttcctaaatttcagcagagggattatgatgcatttataaagaaagaagcctcagcttaacatacaaataaaggggccaggagggcagctcatgtctgtaatcaaagcacttcgggaggctgaggctagtgcatagcgagacctcgcctcaactgaaaatacaaaagaaaaactagctgagtgtggtggccagcccctgtagtcccagctactcaggaggctgaagtgggaggatctcttgagcctgggggttcaaggccacagtgagttatgatcgtgccactgcactccagcatggaagacagaatgagacactgtctcaaaataaaaacaaaaacaaagggtaagaaattgtgactgaggaacggtgataccattactataataaaagtatactataagatagcaaatttgggtaactcataaggaatactgcaaaaggagagtggtaaaatgttcaatgtccaactgatctttggaagtaagaaataactctggaatagagaagggcaatacatcagggttttataaaaacagcttttagaaatataaaaacttccttgcctcaaattctgtatctatcaataagcttccaagatataatctgttcctctaggtaaggggtggcaaaatggtttgagtgtcaaatccaaccaactggttgtaggttatgaagaagtgtgggatgttaccaattactgagcctcaccctctccccacctcagcccacctcaggtgggccaggagaggagagaagatagaggcctgctatgtatttgtcagccaggtcctagcacagcctaagaggaggagggtcctatgaaaaggtcccacattccctctacactacacaattaaaaataacctctcttacactttgagtttgattagaacgtatcggttcttcacaacttgattactcctgagtgaactgaagaacagtttctaaaagcaaacctgagttctaatccctgcattaggtctttttttctggtgcagacatcctaagacctacagccaacttctctgtctctcaataactctaaattgcagtaactttagattgcaaaggacaagacttggatgtggacaatacagctgttattataaacatctcatctttatggttcaaggtgatgcaatgaaagcaagtggaaacacttcagcttgggcttaatgtatcttccagcatttcttccatgatttcttgtcacatacctcttttttggtccctctgaatgacaaataggattgtgaacataccctatgtttttctgcctccctgactttgttcacattttcctcttcctctgaaacacattgtcttcatttctgcctgttaaaatgcaatttatcttggttcttcaatcatacctgtttcttaaatcctattttttcttaaatcataccttctttacaaaagggtctcccaactctccttatactgtctcctacagcatttttatttgcaattctagtatggaatgtaacacattttgctttgtattaagtcatcatagtcagtatgcttgtcttgtcttccataggctatgagaaacttgaaaaacgggaccatacattatttatctttgtgtttcccactatgcttagcactcgctggctgcttaatgaatattcattatattgaatacatgcagcctaggagttaaaagaaaaaaaagtgagaaaatttgatgcttatgaaacttcagctcatatatcattgtcttttgaataatatggttagtaaacagatctgaagatagtattttactaaccacatatgtaaggatgattaaaaaaaataacacagtcttatcaacagaaagcaggcatagtccttctaggaaatagctgtaatatcattcactgcttttggctttttttctctcttaaacttcacagtagggataacggatttagtcaaaataaactttctcattgttatgagatagaatagcacatcacagcattcagtagctatggcacctgacatgagaagcgcttcctcatgttcctagagattctcttagatgtacatgattgccctacttctgctctgccttcattcagcagctgtcatccatctgctccacaaagccaattcaacagagcatgacccctgagcacattacttcaatgtctgcagaagggccttgctttggagggttgctgctgccatgctgtcctgctgttttattccaagcgcaataataaagctgccatctaggatacttgtacccaagccacaacaagagttgcaggtctcccaaacccctgacatctcaatctcctccagggccctaaaaggtgaggggaaagagatcactgtccagggctttgggtagtttattgctgccactgtgactactgaatcacaagaaatcacagcaaaattctgtatgttctctgagacacataaaatgagtttccagtggcctacagcatcattgaatggaagaacaaacatgaaattcaatgagtatgcttagaagtaactattaccaactgctgatgggagggtatctagaattcctttcttaatatcaagcaattgaagaaataaagtgctgtgtgagggaaggaaaacagtatctagagagtaagaaaaaaggtggaggaggccgagataggcggatcacctgagtcaggagtttgagaccagcctggcgacatggcaaaaccccttctctactaaaaatacaaaaaatagccaggcatggtggcaggcgcttataatcccacatacttgggaggctgaggcaggagaattgcccgaacctgggaggcggaggttgcagtgagctgagatcgcgccattgcactccagcctgggcgacaagagcaaaactccgactcaaaaaaaaaggaaaaaaggtggattcgagcacagtgaaaagagaagaaagcctctgattttataaaataatactatgaaaataacaaatatgaaaagattgcaggaggttatttcagtgttgctaaagaatatcattatttgtatgactaaattataagctatcagtattgatctcatgtagctatatagctggaaaaattccaagttcatgtaagtgaagaagtaagatatcagggcagccaggtgtttatttccacttagtaagttaatcttggctacatctacaacacagaaattctccaggggataaagtggctcccttgagaattaacttatatacttttgaagaattcagtttctgtagaatttaacattccagtagagagaaatatatcaacaacacaacaaaacagtaacatcgtctcttccgccaagaaggggacattgtgtatgcccaactatatacctaatttttaataaaagttaagtaattaagtcaatcttcagaaaataaacaactaatcaaaatatatgtttctatactaccaaataaagataccacatgaagctgaaaaaggaaatccactaacctcagatgctgctatttcagtgaaggtatttaatgcttgttcaacattagatttctgtttggtagccattaagcaatagttttccattatgcgaagctgtacgtgaccctgaacagtctgaggttttagttccttaagaagtttttctgctgttcttactgccagttgcacagattcttgcttctcagttgaattactgtatataattaaaaataaatcacttctgtctcttactcatgatacaattcattgagattagaatcagcttttgtacacaaaagctctgggcactcttttatactctttttgtcactcatttaaaagtaatcttttgtaaagaatgtcactcattctcttctaatacaaagtgaagcacagttacaatgcattttaaacaaaattaatatggactcaataaaacaccattaagcattaatttcctctagaatgaagacaaaagttggataatatctacatgttgtaaatgtgtgcattccagcaaatataaaactataagtagaatcagaaaattaacatatatctattcaaaaagtgaaaggaaaggaaaaaagtgacaaatactgtattatttcattctatgtttaatccattttacacacaggaaaactgaggcttgaacaggtaaagtaattttctaaaggtcacacagctagtaagtggtaaacctaggacctgaatctaagcttatcagacatataaaatctactctgttctcttcaccacattgcctatcagactctcagaaattatatatgtgtcaaacagtaatttcaagtgcaatttgaatatttaatagcaattttcttattttatacacacaaacccatgcacataaatatacataaatcaattaataaaaggaaattaaacactcaaagtccaatcactaaagccactggtcttcttctcaggccttaggcttatcttgcctaaacatgtcacgctgttgactaccacttcaaagttcttctcccttggcttctgtaacactacacagctttagttctcttttcaccatgctgattgcccttttctgaccttccttcctcctccagaccccttaaatgttagcaagcttaacatttagttctcagatttttgttacttcattctaccactcacaaagagaccattcatggagttccaactatgcactctgcagatgtctcccaaatctctatccctagctgtgacctctctttctgagttttagttttgtattttgaattgcctgaagaagatttccacttgaatagcttatagttccataacagtaatgttacctcaaccttcctaaaacaaccataaacatgccacttccctgctctaactggtctcggtaatccaagcgttaaaatctgttgttgaaatctcttggcaatctaccactaattttctccagctcctccatgcatcttctcctgaatactatgcactgctatgattcctaataaactctgacaatacttaatatctatttaaatccatttatatttagttgcagattgaaaggtttcaggtattgtcttgcctcttaattaaacactcctgaagacagaaactacctcttatattccctttatgtcctaatacattccccacaagccttgcctgagtcagaagagaggacaagctactaatgcaggttgataaataaccattgactagcagtataccacactaacagcagtcaggactcagtctaaatcttgcctccatcattactatcacattaaacaagttgactcagcttattctgcaatactgttatagaaaacaaatgagatagtgtgtagaaagtatagaggacagggtctggaaaataactaccatttgttaagtagttactattattgtgtggataatttttgctacagttgtcaaattctacaattaggggagtgtcttcatagcatgtctattattatttaggaaacctaaaagcatttcatgcctgtttcacagaatagttacattagcaataactattctattgaataactattcaatttgctaaaataactattctctgaaacaggcaatgaaatgcctatttatttaatttattcatctgacctttcattattgctatcctaaatttagttcttttgtatagtatccctgtttattatctccaacaagtgttttttaaaaaaggataatatgtcaaataactcaccccaggtctccatccaggttttcaaatacttcacctccaacagtttcattatctggattcaaacagatctctatcatattataaagggcattttggccccagtcacgatctttccgagctttattaaaatgtcgaagggcatcatttggttctccagtgtaccttgttagatgtttaaaagaattatttatttcaatcactgactacaaaatttatattagtttataatctgtctggtaaataaaactgttgaattattttgaaatgtacatttttttttactacaaagaaaagcttattctacttgatttacaatgagaaaaaaaaatcatgtagcatttatttgtaaatagatttaccaaagatacagtcctttacaatactgaaatcctggttccaattttgctctggagttacgtttctcagccattgagaaaaatcttgggacatcctcgagttttccacatcttcttaggagatcaatcaaacgagataatgtcatataattatctagaaacaaataatacttcagatatgggcaccattttatactgtttcttttgttggttataattctacttcattagagtataatttacttcatataaagtacattttaaatataaataaaaaatgcctcagggtataattccctatagaggctgtatggccaactagatgatctactaaataatacagtttgggctaggctggtcacagtgtctacataggcaaatctagaaaaatgcatatttcttgtagcttttctattgtttgggggaccaaaaccttagagaaacagcccctacctaggtaatctagactttcaactgtgaagttcaggaataccgatttaattgcacaggacaagttcactgtcggtctctgagaacccctctcctacatactgttgctaggaagggtgtgggaacagtacaattgacaaataatgtatgggatggacaataagaaatttttctccagtctctctttgatatgtacatgtagctaacataccatatgctagcttaccatactagaaccttagcatattagtccccatattttaatcctgtttcaccttcttctaaaaaaaattcattcattcattcattcattcattcattcattcattcattcctttgatctcaggtataatttcctggcaggttcctagaaagccttcttccaattctatctagttctctcttatcagtaacaaactaagctttgagaataatttaataaatcttttttaggattgcaaaaataatgtatagacactacagaaaataaggaaaatatatataaaaagtatgaagaaaaaaaaaatcaccatatttccagctaaagattagcacattttggtgtgctttctttcatatatttgaaaaccaacctatatataaatgtaagcaaagatatttctttgtttacattcatacaaaatagatgtttatttaaatatatacaaaactggagtcacattggggttttgattttgatcggttttgattggttttaatgttgattttgatgaacattaaacagttaacatttcccaactgtcattaaacaatcttctaaaacgtgatttttaatggttgcataagggcctacttactgatgattcacattatttatttctttatagtggtgtcttttagatgtttgtgtgctcaagtttcagttagtacaggactagggatttgtaggggacttgtaaaaacccttaaataagctattctgaacatgttcttaggttgaatttctacaattaaaacacacaaacaaaaaagcttgttttaaagctatttatccttgactctattttgctatttgaaaagagatgacaccatgtaattcagcaactttcctgagtatatacccaaaagattaaaagcagagactcaaacaggtattcgtacaccaacattcatagcagcaaccttcacaatacacagaaaaagtggaaagagcccacatgtccattgtgtttgaatagataatcaaaatgtagtatgtacatataaaggaatattgtatattgtatgtctgccataaaaaaagaaaattttgacatacactacaacatggatgaactgtgaagacattataccaagtgaaatatgccagacacaaaaggaaaaatgctgtgtgatacagcttacagaggtgcctagaataaattcatcaacatagaaagtagaatgatggttgccaggggctccgggaagaggaatgaggaacgaggaactggtgtacagacttcagtttggaatggcaaaaacgcaaaacgttgatggataacggtgatgacttacacaacaatgcgaatgcatttaatgccactgaacagtacacttaaaaatggttaagatgatgaattttgtgttatatatgtttcaccacaatacaaaatattctttaaaaaagacttttggaaatactgtatctacttaattacaggatgtcaaactaatacaggctgatagtatcatttgtccccttgacacacaatcttgggtccagagattttgttcaccacaccttttagcatcactaaaaagggcacaataagaatatggtttcagaaaaagacaattcaaatattggtcttgtcctttagctatgtgaattcaatcaaattactcaaattctttgagtccaatatacttattttcttaaaataggattataatattgactgtaggagtgctacagaaataaaggcatgaaaaatatttataaattacaaatgttattaataatatttatacttccaaaaatgttgacaagaaatagagtaactaccccataataaagccacagcatctggaagctatattggattaagcaagaactaaaggttaaaatttcggattaaattttttttgcatgatactgctagtattatcaacattgggaaggcaatttcttgaatatttcttatatactattgaaatgtattcattattagttcaagttataattaccagtgacagattaaattacattcacttgtctttggttaaccatgacatttgacagaaggcaaatttctgcacttaagaaatgtattaaaaactaaaatgtatattaccttctaaaaaacttagctggtccatctttattgatgaatagtaggaagatatcaaaatagttatagggtgatgagatgtggcaagcatgcagtgctatggtatggtattacaaagcacaggattcttaactttgcctggaggagttgggaaatttcacataggagttgacctttgagcagcctcaaggataggaggaagatcttactagacggacaaaggcattccaagtagcagaaggcatgcgccaagagggaagcagagaacagtgtggggagtgttggtaactttgatattattaaagcggaggaagaaggataagaaatataaatggccaaataatttgcggccatattattattaaaataatgctatgattttagactttatcctgaagcactaacttaaattttaagcaaagggtaggttttgatttttagaactgatatgctagtcctatgatgacctggagcagccagaacctagaagctggaagatgagttgggaatctgcactagttcagatgagaggtgataagggtcttcattagagcagtgggttaggatacgacagactggatgtgttagctagctatcaagcaaacagagctgaggagacatgttaaccaattagtatgaaggaaggggaaagctcaaggcgatctggagattctgagagagaaaaggggcaatctgtcgtgagagcagtaattagatctagaagaggaatttttcaactacttaaattaggtcaaatttgtatggtacatttctgaaataagctaaaatagagccttaatctaaagtacaagatgagttactgaggataaccaataatgtacacataaaatgaacggagatgcatgttttagagtaattccaacaaaatagatctgtggataagtatgtaaggtactagtaagaataaagcatacaacacaagattaaaaactcttaagattaaaaatatcacatagacaataaaaatttacttaaaattttgtggttgtttttgagaccaagtctcactctgtcaccgaggctggagtgcagtggtgtgatcttggctcacggcaacctccacctcccaggttcaagcgattctcctgctgtgtttttaattgacttggtgttttacagtcattcactgatccattcaaccaataaacatctatgttgccacatccatgtgtgtggcattttgtctgatattgggaatatggtgtgatccctgaactcgaggagtctacagtgtaataaagaacacaaatatgcacataaatatttttagtaaaatactataagtaataaagacgtatggacaaagtaaccgaggattagggttaccaactcatcccagtttgcctgtgactttctgttagcatgggaagtcctgcatccaggaaaaccctttgctccgaggcaaatctaggatggttggtcatgctacccagcaccacataagacattttttaatgtaggtggtggtagtgggatgcagatttacttttttattttcccccaagagggatatattttagattatgtgtttggaaagagaaaagggataaggaagctaaagttcattttaggcaaaaggaaaaaacccaagcaaagacttggaagcatggttgtatgtcatttggtgttgctggagtacaagatccttatattgcatttataaaaaattgcttttatatttgtttacaaacagtccaaagcagccagtctactaagccaatttttttgggaaaaaggctgctgccaagcaacagaaacttacgtgaaacaaaacccacaagacacatgaagacttcttcaaatcttagaaaactataatgtgtgagattcttcaaatcttagaaaactataatacttttaatgacttaaaatattcacagtggaagaagtctgttttttaaagaaataaagttagatcattgtctcaaagggaaagactgtgaaatgggaacagcttgagatagaatgaatatattatgtatattacttttaaatggtagtttagagaagaggaataagagaaaacagtgtggaacacaaggtagaaatggcagggaaaaaaacgatacaggcctgaagaaaataaaagtaggtttgggcaatgtgggtggcaagatgagcccatattttggacccagagtgagtggaagaggtgagatggtcaagtagttcacagcattcttttaaataacatctgagtatactctggaatagacagggcaaaaaacaaatgaaattgcctgtggtagtccccatattaaataaatttaatttatttaattaaaaaactcaaagagtaaaaataataaagagaaagtgttgatattactgtaaaaaacagaccatattttctcctttcaatttttgtgctcgctggggatattttatttttaaatacaaactgatgttctctaaattcaaacatctttttattaaaagcgttactagaggtagcctgcagagcatatctagttctttgagttgccctgcttgaaggattgccacctctgtgtctctgaggctctgagcacagatgcctagggcatcagcctgagatgaaggtggtggggtttagaagaactgaaacacagctctaggacttcctctgccatttcaaactctttttagtaacacaggtagtaacatacagtcatgtattagtcaaacagttcccacctctttctttttctctttcctctcctccctccatccctgcttccctttcttccttttctccctcactcttctttccatctagtatttgttgagtactaactaggccagatattcttctaaattctggaaacacagcagtgaaggacaacgtttctggtcacttgatgcttccattctatgatttgtagttttttgcttttgtttcacaagggctacacaaaacccaaaaatcctaaagccaaaccccaaaaactcaactgaacagaaaacaggataaagggacagagagcaagaagtggtgctacttgatgtaggccagtgagggaggggcattctaaggaagaagcagcaccagagcaaaggcacaaaagaaaatgaggcagcagccagatagacctgtgggagcagcatattccgggaagtagaaacagcaaacaaaaaggctcaaggctgtaattggcttgggcttttgcctacctagtttctgttgtccctttcttctttactatcagaattctgattttattctacagggtattagattcagctaaaagataacatttcccaccttcttttgcagccacggaggtgatactactaagggtttttttgtttgtttgtttgttttgtttttaataaaacgatgatttgctggttgggaagcccttttgcccagctctgcacccaccttccccacctgggccctggaacatcaatgcccagcactgcggtggtcatcttgaaccatgaggtgatgctcaggcaagtcagggtaacaacgtagaacaaaaagagagaaggctctggtttcctgatgatactgtggaaccgccacaccagtccctacacagtgtacttttcatttcttttacagagagaaaactaaaaaccgtgatttttagcctagaattttcaggggtatctctgccattttcaatgaaagtatttctaaattcttcataggctagggatggaaacacagatgagttatgacgacgctgcaataatctatgtggaagatggcaatgccttagaccagggtggcactaacagaggtggtaaaaagtgatggcattctaggtatactttgaatgtagcactaacaaggatttgctgatagactggaggtgatatatgagagaaagatgagacaaaggttaactgtgaggtctgggccggcacaacagtgagcagtgatgccagtcactgaggtgagaggtgggggtggagcaaacttagaggcgagggaaagttcaggtgttctattttggacatgttaagcttgagttactcctagacatctgagtgggaatgcaaagaggcagaggtgtacatgagtaagggctgcagataaatgtttaggacacatctgcacatacatgggatataaagccacgcacctggacaaagtcacctagggggtgaatatataaaaagaaagggagttcaggaactgaagctacgagtgttctaatatttaaacgtcatacagagaagagaactccaaaaaaggaaactcaaacagcaggcaatggggcaaaagaagaactgagtgagtttaggatctcagagacaaatgaagaaagtctttcattgtggaagggaataaactgtgccaaatatgatgacaggtcaagtcggcagagaactgagaactgaatctgacctggcagtatgggggtcaccgaccacattgcagaagtgacttccctagggtgcagcagtggatgagacaaagtgaacacagcatgtttgaaaatccttcacagaaaatttgttgtcgagaagaactgaggaagggcatagtaattgggaggggatgagagttaagagttgatttttattgactgatttatttacagcaggaagatgtcacagcacagttccatgctgattagaaaaaaaatgataattcaagagagagaactgtaagagtgaagcccttttttaggtgagaagctggccacaggcgggatcacaggcctggggaggacaaaggctgaggggtgggtaaatttggtgacaaagaatggagaagttctcttccaggtacaaatattctcttagtgaagtaggtggcaaggcttttaactgtgggcaagaaatggggcaagggtgatggaggtttgaggagacaggagaaagtgggaaaagtagttcgaatcaatgaattcatttttggaatacagtaggattaccaggtttgtgctcataatttaaagtgagaccagtcaacagtgttgcaatttccttatagccatttcagctactcaagcccatgtgtggaataaacagacagtctgattcaactagggacggagtttgcccgagggcataaccactaaacagaagaaaaaaggagaaagggaggggtgactgcactcaaaaaatacaataagtaggtatttacctggcttacgttctaaaagctgctgtaaatgaaacactgcttgttcatagtcttgttttctgaacatgagatcagccatcatctataaagataaaagttggttctaaaaatattgccatgtattttacacaacatgttcttccaatcaagatttagcactagaaaaatatagatgataaacatgaggagggggcagcattttataaaaaggaggcatttaagattcaagcccaccttgtgcagaataacttgcagatcagtgtaacagaagataatcaaggatgtgaaacagattgctctgcttgcaaaattgtatttttagcaaaaaatatgtttctagcaattgttttaaaaacagaaatttgaaaggaattgcacactctatgtgctgttgtagaaaagatactcactggacctgactaaaataataatgagacgattcaaaaatgaaacaaaatttaaatcataactattttgaaaaattaaaaatgagcaagacctactgacatttttcttattatgtgtttaaaaatgcagatttcatatatttctttttaaccacaataaccttaaataaacctcacaaaatgtcatctgtgtagctgtctgcaaagctaacaaatattttagcccacgtaaaaataagaaaaaataaaaaactctattcaaaacagactgtcttagactgataatatgaagttgttttttttcccctgtaactccaaaaattccacccaaactcttaaatttgtccagcattcctaagtacttaaaagttagttcttagcaaattatagtgttaccacatgaactccacctgaccaagcatccccttaggcataaataaaaaataactagacccaaaagggcatgtaaaagcctgacctaggtttatctttcttataaataaaatcctaatgattctgggtctttattggtaaaatgtagtaatgttagaaaaatgttatttcttccaaaagccaacgtgagccatgcctcatcatctagtagtagttccatggggtaaaatttaaaacttataaaacacaagtgcttttattgtactgaagttccttggactgaccatggtagcagcttcgttatcctggtcactctgaagcagtagagcacactgccgcaggcaggaatcagggtcatcttgtgccaggtataatcgtgccagttccaacataatctgtagagcaaagggctagattcatcagacactgtatagaataaaaagtcaatgaggaaaatacgtgggtacagattaaactttagttgaccaaaagtcattgcaataaaatgccaagtataatagacaaaaaaaaaaaaaaaacaacagtatgtatacccatctctattttctcttacactagaaaaaaaaaaaacagagaaacaggtagtaactcacttcaaaagtagagagacataatgcattgtgaaaagaacactggtcttaaaaccatgagactggattatagtcccataacggggccaagtcaggtcccttctacctcccttaacctgctttctcatttgtaaaataaaaagcttcaagcagataatctctaaggtatgcctcagatttaaaagtaggattccaactcctttagccaccactgaaaaaggtatctgtttggttatgccttgctaaaggttgtttttgccgtttatctgaaaaaattatattaataaaaatgttcaaactagttattaaattctagaggatagttgtcttttgtacatgatcacttacttaagtgtttagccattaattattttcagaaattaataatctctccaaatcctctcagatcttgacagagtaaaaactttttatataatcagtcatgtatgtaaatgtgctacaccaaaattatctttacatttattctcccactgtgctatatgaggtcatagattgagcctagccatttttgcatccttagtactaaacaccaattgaaatacagagtgtacaacagctgtttagtaaaaggaactgaattatctaaatccaggtatttgtgattgagaaattattttaaattattttaaaattaatttttgataaactaaattgatacaataaatttgaaaattatttaaattattttgataattaaaaacataaatattaaaacaatttgcaggttgctttatattacgtgttccattatagtttttaaataattgtaatgttcttttttcttttctttttttttttttttgagacagggtattgctttgttacccaggctgtagtacagtggcatcatcatggttaactgcagccttgaccttctgggctcaggtgatcctcctgcctcagcaccccaaggagctgggactacaggtatatgccaccatgcctggctaattttagtattttttagtagactggggtttacccatgctgcctaggctggtcttgaacttctggactcaagtgatctgcctgccttggcctctcaaagtgctgggattacaggcatgagccattgcatccagccttaaactctaatattcttaatgtaaggcatcatgtaagattttgaaagtttttgaggaataatattaatcttttaacttgtatttttgttacatttcttttaaaatcttgtttctatttttttattttattttttgagatggagtcccgctctgttgcccaggctggagtgcagtggcgcgatcttgggtcactgcaacctctccgcctcccaggttcaagcgattctcctgccttagcctcccaagtagctgggattacaggaggcgccccccaccacgctggctaatttttgtattttcagtaaagacaaggtttccccatgttggtcaggctggtctcaaactcctgacctcagatgatccacatgccttggcctcccaaagggctgggattataggcatcagccactgcaccctgcctacatcttcttttaaaataagctggtaaaaattttacatctgaggaaattagaagacatctggaataaaaggtatttaaaattttataaaggtactgaccttattatctgtttcgcagtgaaccagagcctctctataaaacttaattgctttttcatagtctcgctgagcaacagaatgttttgcaatctctgcacaaatttcagctgctaaatgtttctgtgcaggaactgcatctggctgttccatctgaacacgttttagtacccgagcttgtaattctcgagcctagaaaaaatcagtataaaagggaataaaaaaaaaaaaggaaattaaattctccgtaactcacacacagcataattttacagatttatttaaacattatgaacccttgatctaacaaagtctgatccaaagaaaatgtcttattgagatctcaagcatgcacttatttgcaaatgagccagcacacatatatctttccaacaaaacacttatggaattactgagtcttttcccactgttacaacatgtgtataggaagttcactaaggaggaaatacaaccgtgaaacaaatacaaagaggtggggccttcctcagagtaagaatgtagagtagattgttatattggaagaatatcagcctttccacccatccatctggtttctggaacattgagatcttcctttaataaatggtaagaactcacacgttttaggtcttcaaaaataaaatttatgttttagctacacataatgattcactagtgaatgcattcatttaacaaatagtaaatgcctaccacatgcaatatattatgctacacacaaggcacccttctggggagtcttgtcaaaatgttagctaacaattgctttgaaacaggttttcttttttttttctcaagccagaggtttagacagtcataacagcattcttttgcaaatgaaagaaaaatataagtatatagcatgtggttaacattaatactgtctcatgaaatttttattttggttatattaatatgtgtttcagtatgtcagtatatgtacctttatgtgttttagattatacacatgcatacatctgttcatgtttttgcatagctatacacatatatacacattcatgcatgtgctcctagtaaaaaacctgaaaacaattggtttagatagaatgatctctgtcttgcaggaaggcatccttgcatccctgaattcttgtacctctacacatcaagatgttgtcctctgacatcacttagccattaggaaagtagaaagcagggaaagaccctggggcccatccctagcacctcaggggtaagggtaccatcccaaggacacaagtttccaggcagcagcctccaagaattttgttagagatgtcccatcacttatggccctacactgttttacatctggactctggattgcaagtgtaaggaagaaagtgaaaatgaaagagaaagtggaacaaatattggcaacagagcccccagaggacagttgtcccttttccaacaagttaagtggaaaatgctgttgccatgggagtacataatagaaaatctaactcagtcttggaagtcaggtaagaattaaagaatggttagtagttacaccctggtgagttggggaaaaacagatgggatgaagagatggaatggctcataggcattaggaatcacatgtgaaggaaagagaatgagggatacactgcctgatcaaataattagaagaaaaaatggctggaaagatatagagaatatacaacaggtaagcctgttaaataatctacattttatcctagagcccatgggaagctactatgccatgtttataggcattggcatgacaggatcaggttgcctttgggaaccatcaccctggtgtcactgtgaagaactgactagagggaaatgagactgggatcaatcaggaggctacttcaggaccgtaagcaagaaataacgatggagtcagctaaaagatgacagagagggctacggaaatgcggagttattggaaaagtctgaaatgtttagaaagcaaaattcctaagacttgagatttccctaaatttaccatttccgtcattgccaaaaatgtttagcaactttgcaaaaacactatgacagaacccctaagttacataatgtggagaattaagctcaataaatggttgctgaataaatgaacagaaaatatcaaaaactttgactccacttataggtttctgtttgaattgcatcttaagatttgtctctttgtcattcagaatatacagcatgtcattagtgggaagaatgttataattcttcaaaccttattaaagatgaataatccctgggatctaacatataaactcaaaattgattatagtttggggtgctggcattgtctagccatggcatgctgttttttgatgttgcttcatatgtctgcttttataacacagaggctcatgggaccatggtgactgggactaatgatattcataaaggagtgaactaagctaaatttatttctaaaatgttttaaaagtcacctttaccaaagattacactttccttgtagcttctggtaactaacctatggctgggtgcaattctctatcatgtgattcagaaaataagagctaaaatgtaccaataattaaggataagatattaatattgtttaagattacatattttaatgatatcataaacttagatagatatcacagaaatctaataatccaagctcaattcattcacaattagaacaaaaaaattttgggactgtctactgaaacttgggtatgcacgcacatgcatgcacacacacgtgcacacacacatacacacacccctgtcagttaaatctcaaaaccaaaacactacaaattaattgcagaatgcagaactcttctgggtacacaggaatctagtcaaaaggtgactagtatagtatcctggaaagcacaaagggttaggactgaggcatctgcattccacttcaaactcttctagtaaccagctgtataatcttggacaaacactctctgtgggaaaataagcacagtaatacataaactgtttgcttacctcacagacctgttgcttccaacatatcacaggggcttacagacacagaataaacagaatgagataaaaataatgggggtcctttttaaaaaatataaagtattaagaaggtaagtgatgatttcacttttatatccagaaactagacaactgcaaaacaaaccaatattatggatcctatctggggaacagtaaagtgcctccagggaacttgggaagtaagatcatccctctcagaagtaagctgcaaaatcaacacataatagatagggcagataggcaaaatcgcttaaatgagagggagaacctagaagatttctctaaaaatcttccagtgtctgatactgaaataaaatatatcacattgtgttccctataaacaaagtttcaaacaactaatttaaaatgcatgacaacaataatagaaaaggcaaagatagaataatagaatttggataagaagaaatgtgtgttgtagctaacaccgaaaaataataaaaggaggtataaataacacaatagaggggaaagtggaataagaataatttaactcagataaaagtcaagaaaatttagaaaaaaacagattgtaagatggcaaatccaaatgcaaatataattcataactatattaaatgttaaaaaaactataatagatttagattgtcaagaaaaaaattgtatgctgacagatcttaaacataaggacacgtaaaattgaaagtaaaagaatgcaggagatataccatgcaagtactaaaaggaaactggagttagctataataacacaagacaaaggagattttaaagcaagaagcattactagaaatgaagaaggccattttattattttaaataacttaattcaccaggaagatattgtaattctaaatctggatcattcaataatgtatcttctaaataaatgaagcaaaaatacatagaactaaatggaaaaaaaagaaatccacaattacactgaaagactttaacacccctctcatacaaatagaccaaaaccaagcaaacaaataacgaccaaacactaagaacagggaagatgtacagaaatcagtcaacaaacctgacctaattgacatacggttgaactaagtatttattaggttggtgcaaaagtaattgtggttacagtaatgttagaaacacattatttcaagtccacatggaacctttaccaaaactgattataatgtaggatgtaaagcaagcttcaacaaattgcaaaggattgaatcattcaaagtatgtcttggcacagcagaagtgtactagaagtcagtatcaaaaagataacaagcaaatcagaactccataaaaattcaatgttacacttttaaataacccaccggtccaagaagcaatcaaagtgaaaatgaggaaatgttttacactaaataataataaacttgtggaatgctgataaaccagtgttgagagagaaatttactgcttcaaatgaataggaaaataacaaaagctcgaaatccattacctaacatactatttcaagaggctaaaaaaaaaaaaaaaaaaaaaaaaaaattagtaaaccaaacccaaagagtgtagaagaaattaattatgaggttaaaacatttaatgaagccagaaaaggcaaaagttgaccctttgaaaatattaataagataacccctagcataactgattattaaagaagaaaaaattactaatatcaggtttgtaaaagggacctttttcactgcatttgtagacattcaaaagaaaagatataataaacaagtttatgttaataaatttaacaataaactgagtacttaaaaaattccaaattgatataagaaacaatttgaaaatgatcagtctgaaatctattaaaaactttccttcaaagaggtctcaaggcctgcaacaatgaattattccaaacatcaaagaattagcagccgggtgcggtggctcacgcctgtaatcccagcacgttggaaggccgtggcagggggaatcacctgaggtcaggagtttgagaccagcctgaccaacatggtgaaaccctgtctctgctaaaaatactaaaaatacaaaaattagctgggcatggtggtgagcatctgtaatcccagcaactcaggaggctgagacaacagaatcgcttcaacctgggaggcagaggttgcagtgagctgagatcatgccattacactccagcctgggcaacaagagcaaaactccgtctcaaaaaaaaaaaaaaaaaaaaaagaaaaaaagaattagcatcaatttgttgaacacagatgcagaaatcctgaacaaaatattataaaacatctttaaattccagcaatatctttttaaaaattatatcaaagtgacatttatttcagagatataaggtgttttaacatttgaaaataagtcaatttaatataccacatttgaaaaggaaaacaggaggaaagacatatgatcatcttgatagatgcagatagtatatttgataataattcaagtcacttataaagaagttgttagcaaatcagaaactgaatcatcattaaaaaaacatcaaccacttgggaacatacctaaggaaatctgtgtaaaacctctacactgagaaccacaaaatattaagagaaaaaagaagatctaaataaatggaggaagaaagcactaagttcaaatcctgatgacactattcatatgacttcacacaagttaatcaagtctcctcagctataaaatgggattaaaaaattccaaccttcccaaattgttataatagtagtaatagtatatttaaaatgtataattcataagcattcaataagtattttgattttgacatattttctgtagctgtttggccaaaagagattgctttcctcttatacatggcatatttccttctgcatccatctcctacctcatgaccacactcacagacaaatgtgtttacctgttgtaatgcagtgatcgcatcaccaagtttttccattttactataaacttttgctagaagaacttgacaacgtccatcctccatgagagctgacagttcatttactatgaaagaatggaatgtaatgcaaaaaattattcatcttaaataaatgtttatatttttccagaatttttaaaactggtctctagaaaaaatgattttgaaaaatagtgaatacggttaaaattttctcaatcagttgcctgaagaatggccaaattaaaaaaaaaaagaaaagatttaggataaaaactggctggatgaaaagttaaagaacgggttaacaactagaggcttttcttagacatatattaggagataacaatttaacaccacaataatttccatttttattcttaagtgtataaaaatttgtttactgaagtcattagaagatagagtagttgctatatgcaattaagaagataactgctcttttaaaaatcatagatatttgataagcaataaagtacagttgttaagagcactgactttgatgttgaatggtctggtttcaaatctaggctttaccacttactagccctctaattttgagcaaggtacttaaccattctgcagttccctctcatctgtaaaataggaaaaatgatagtaactacctcacagggtggatgcaagattttaatagctaataagttactaaataagttaaaatatgcaaagtagtgaaaacaaactctggtacgtggtaagttctatataaatatttggttaatgccaaatgttttgtgtctaagaacaataaaagaaccctagataattaacaaaaatgtttcctccaccatttgtcaagtgcacagttcatgacacgccatgccactttaccaactaggtagtcctggacacatcaataaaactgagtttcagattgctaaatttaaaatgggtatgattatatttgcctcaaagattaatatgagtcctgatgagataatgtatgaaacgtatatgaaggcatctaagtatgtcatgggtatgctcagcaaatattaaatgaaagcatttatgttacataaatataatatacccattgtaactaaaacatatgatacttgaatctctctccccctacaaacttttcaaaatgtatatccacatttaggcctttcaagtgtttcaaaagaagatctgacaaatccatgcatatatttttatggaactactaacacttcatacaataaatacatttataattagaagaatttaagcaccaatgtcattaaagctaaaccaaaagatcattttgaaaatatcagaaaacttacaatgggcttctctcatcatgtgttcaaatgtattttaaagctacactaaacatgttgttggcaaaagaaaagaaacatacacaatggaataaaacaaagattcctataatcagagcaatgtatatgaaggagtttattataaaataaaggagccagttccataaatggcatgaaaataaaattggctatccattttggaaactatatagtaaaacttgtatgtggaataaagtacatggattaaagttctcaatataaaaatgaaaacaatataaatgacaaaaatatatggaaatagtttcataacgttaggattagggaaggtcttttagagagtgacaagaaattcagaagccaaaaaaagacatgaaaagcagatatatgatcattaaatattctacttgatcaaagatacaataaacaaatctgatgaagaaaagacagcccgggagaaaatatctacaacatgaacattaggtaaaggattaaagacaaagaatataaattaaaaattcctagaagaaaataagatatataaacaaaataatacctaaccttatcactcatcaaagaaatgtaaattaaaatgtttatttttcatgactaacacgacataatgtcaggaagtttttagccttaagaaagaacaatggggcaagattcaattctaggaagtacagagaggtatatgtatataaacaaggactttatctcagtactgcttccaactatttcccaagctaaatgtctattccaatatgagactcatcaaatcaattatgatattaagatacagtggaatactctacatatgctaaaaaataaagaagagctatatttctaacaaggaaagaagttattaaatgaaaaatgcatactgcagaattataggtgtactataatccatttagatagtaaaaagtggtaggtataataattgtgtatatatgagaggcaaagatgggggcagggagactgaatatcatgatatacaagttgttaaatatggttttctctggagagcgggagaggacacaacttttattcacttctgtaatctttaaattctggcaatgggcaaccactagattttatttaaaaataaagatcttaggccaggcgcggtggctcacgcctgtaatcccagcactttgggaggccgaggcaggcagatcacaaggtcaggagatcgagactgtcctggctaacatggtgaaaactcgtctctactaaaaatacaaaaaattagccgggcgtggtggcaggggcctgtagtcccagctactagggaggctgaggcaggagaatggtgtgagcccgggcagcagagcttgcagtgagctgagatcgtgccattgcactccagcctgggcaacagagtgagactctgtctcaaaaaaaaaaagatcttaaaaaagtaaatttttacaaacttgaaagaaggtaatttgatagtacccaaacaaattttacatgcacaaaatctccagctcagcaccctactctaagaaatatatgcaaatgtacactaaggaatgatacagtgatattcattggaacatggattataatatcaaaataatggaaagcaaactaaacatccaataatttcaagaaaattaagtaatttattggtgttatggaacattatgatgcctgtagatagaataatatgaataaaatttcctagaagaaaataagatatataaacaaaataatacctaactttatcactcatcaaagaaatgcaaattaaatgcatgatgtactgacatcaaactatctgggacacgtatgtggaaaaaattgcagaaaaggaagagtaacagtttcgcacaggaaaatcacattacacttatatatacacacacatatatagaatatatattaaattacaagctactagggaggtaatttgagaacaaggcaaatggaattcataggagaaacagatgacttatgcattatattcttttatagagcttgaattttaaaaaagaagcatgctactttttaaaaaagattacaaaaatgctaatgtgtttaaatatgagatagctgtaatttaaagataactatattattttggaaagtaagctatatttctataacacaattaactgtttcataaatctgctactagatttcaaaatatcacattttagtagagtggcattctgataaaagaaaaaatacgcatgtatttatataaccaaccacaaataaaatattgagaatacaaatacatatttatgcaatataaaaataaaatggatcagagttatcagacttttttcaaaccagaaagactttcataccaggttcatgagccagagcatgctgaagaactttttctgctttgtcataccatttcaattttaataagagctcagccaggtcatagcaaagataattcttttgtccagttttcagagcagcttcatagtaagtgattgcctaaacaaaattcattccatttaagggaacaaggcaatgagaatggcattcaagcagagctatttaatacattacagacttaaagcattggtataactagaaataaccaggaagaattgtaggcatacacctgcctgtcaattaagtatgtcatacttctcagagaatagatcatcacatgaaacaactaatatatatatatattttttttttttgagtcacagtctcactccatcacccaggctggagtgcagtgatgcaatctcagctcactgcaacctctgccttccaagttcaagcaattctcctgcctcagcctcccaagtagctgggattacaggagcccaccaccatgcccagctaattttttgtattttttcgtagagatggggtttcaccatgttggccaggctggtttcaaactcctgaactcaattgatccacccgtcttggcctcccaaagtgttaggattacaggcgtgagccaccacacctggccaacaactaacatttcttatgataagtagataaagaacggtacttggcaaagaatattttttacaggttttatgaggccagtgaaccttatcaaaggcatacattttgctagctgttgtacatatggtcaacaattaccaggaatagggcaagaatataacagttcaagaaaaatctgtttcccttactggaaaaaaaaatgaactcaaaacacatagcttgcaaaaattggtgcaacagaaagaacatttatcatgttttgttacacaatgaaagaggtgtaagaatagcaactttatggtaattgatttggtagcaaggattctagctgcaagatgaagcaaggtctagggtccaaataatcaccacgaaatgaagcaatgaagaatctgataaatctaagaaggcctttaacacaaatcccagttcataaatacagatttggagtttacaaccattaaagatgcaaatggtgctcgctgaagcttctcgaggacagggtatgataaatttgatgcaacagacatatttcaaacaataaagtacttaccattgagtagttatgagttttgataagtgctttgcccattttgcttgccaatgttccatctttcgggttctgatttaatgcttgctcatatgctactatggcttcttcaggctaatattgccagacacaaaaaataagcaataaaaaatagcataactgggtcccattaaagggcaacagttctataattaatctctacatttgtaatattacataagacttggcatatattaaagcacaggaactttaacaatttcaaaaaggtgataaatgagaaaagcaggtatggataggtataatttattaggataattctacccatattaactgtgctcttgtctatataaataacaatatgtggactaagagacaccatcttgacttttcatttccagaagtcattaaactgccagttatagagggctgaaggattggttccctttgaagaaaacaccaccttagtctgtagctccctttatccttctgtataaagaagaagactcctaacatacctctggtatcaactctacattttttttttttgagatggagttttgctctgtcacccaggctggagtgcagtggcgcaatcttggctcactgcaaactccacctcccaggttcaagtaattctcctgcctcagccttcccaatagctgggactacaggcagggctaattttttgtattttttgtagagacggggtttcaccatgttggccaggctggtcttgaactcttgatctcaagtgatccaccagccttggcctcccaaagtgctgggattacaggcatgaaccaccgtgcctggcctcatctctatttcaaataacaatagtgctgaattactggatctcaactttaaaaatagaatccatttttaaaaattgatatctcccttttattttatttatcctttaaaatggatatctcccttttactgtgatggctggatcttcaaatattaaacattattttaaaaaacattccttttaataggaagttgtactcatcacaaataattttttaaaaatgcagttcagtaacatcagaaattttacctctagaatattcatgtatgcatcaccaaggagaagaaaagaccgagggttagccattctttcagcaatttctctggaaatcagaccaacattacttagcatattgaacacagatatcttcttccaaaaataaaataaaataaaaaataagctcccttattttagttagccagtagccttcagagtatctctatatacccaacagtgtaatattataaaaacctcatgcatacccacacccaaattgtttatgctagatcagctatttctgtcactgaatctttccattttctgaaatgcaggtaactgagttcagatagatagtaaatatctaggttctccttatttggacctacacattttgctatgtttacttctgaaatgatgtgggagtgaaggtaccaaaaaaatgatgggagaataaaattttactgtcctcctatgcatcttgagctctgatactcatggcataaattatatgctgaaataaattaccttaaaaaaatacaaaatcttctatttcagtatttgttgcttacatttgacctgaaaatgtagactactaaaggtcaaattaccaaagttattgaaataataatgtggtgttaagtctttaacatacagtatttcatctaactggtccaaaaactcttgagaattattatcccagttttacagatgatgttaagagttgcagctgatgtgtcagatcttcctgaaacaaaacctatacttttaactattacattatagtacatcaaaaataaatcaaccctattttgaattattttcatatcattagagatgacagtgataatcttctggaaataccttagaaaacacaatctaggaactccagtccatctgtctaaacatgcggtgctgctcagtttctctgaatcactcagtgcttaaaagaatctgagcagctttttgagtttgatataatatagatgagccaatactgaattacttcatcaacagtttactatgatctcaagagctaaaaacgttaattttctcttacatagagtgtatgcttctatgtttacccttctgtttggggagaagaggaagagcaatctgtgtgtgtgtgtgtgtgtgtgtgtgtgtgtgtgtgtgtgttgtgtatcccaataactcataagggcatcagtgtgacatacttttaaggtcatgctctttcaccaagaaatatctgtaatccacacgttagcatggtacatactaaaataactttttttttcctacaactactatatcgactaataaatacacctgcctatcccgtagattattgttatattacatgatgctcttaagttattagaacacagggtacaatttcccttctcaaacaggaagatctagggtctaaaaataatatttgataaggagagctgagaaactacagcaagccagtttgaaggaatcataattatgttttagggagagcaaataacttggttagagtgattgcagttggtggtagaaggaatcaggaccacattcagaaaacgatctgtaaagtatttgtgaagcagttgaaagaaagttaaaaaaaaattgggaattaatactagtggctaaatgtatcaaaatataatgggttaagacaattacttacctaaaacaagtgatatataacattttatcttttctgtgcttcagataaatatctgccattttttctctggcctctataaaataaggctgttcggctgtaacattctgaaggatgcttaaagcccgttcaatatctccttgggctagagcaaggtctgcattagcaatggtaacccgcacttcttcagatgttccagaaaattcatggatggcatcttgtaaaactttggttgcctcatgctgtaaagatgaaattaaaataatcattcttccaaaatagtgaacaaataacactagaaagggagattttctcataacgcagaatgaataaatgctagtacatttataatatttacgaaataaattgatagaattttctgaaacctcaaaaatttaaaactaaacccatgaccaaaatcagatgagcctgtaaatattgttagctagataaatgttttcacaactaggacaacagcagctgctacagagggtcactgctactatattaatgagcacttactaagcacccagcattgaataatgaagagctgtacacactggctcttcattaagtggcagattattccctccaccagaacactgttgttacactttgggtgaatattctacctcatttccaaatgtgtaccttgatgaatctaaaatgtcatttaagagtcatctcaacttcagagattataagaattccagaaatgttaaaatgtaatttaagtgtacctcagaatcaactttatagggtataattggccttacttgttaaatgtactttaagttaactagtaaaacagaaattctctcacacctgtaatcccagcactttgggaggccgagctgggtggatcacttaagcccagtagtttgagaccatcctgcataacatagggagaccctctacaaaatattttaaaaactagctgggcatggcccagctacttgagagactgagatggtaaaatctcttggacccaggagtttgaggttgcagtgagctatgattgtatcactggatgccagctgaggagacagagtgagaccttatcactaaaaaatacagtaaataaatggaaattctttgtgatttggcaaatatttagaaatacagccttcttaattttcattaaaatatgaaaaataagtgattagcaagtgctgcaacctaaaacaacggatacaaatgactttgagttcctcattttctacaaagttgtaattctcccagaattactttctatcttatcgtatatattattatttttaaaaatatctgactttataatattcctatgagtttaccaaagctgtattcatcaagtattttgtctcctcatctactagaatttcaggttggtacttcctttttatttcagtagttctggagtgtgcataaatgtgtgtttgtgtttatgtgtataaatctttttagagattcataggattataactgcattatattattacattcatggtaaccaagagagttgtacatcatgttattatgttccattgtagccaacatgagcacactgatacttaaggtcaaccaggagcaaattatgcttaactttcaggggcttacaggaagtttatttttagtgcaaggtaatgaaaattaaatttttctaaagtttaccacctggtcaagggaatacatttagcttttcattttttttctctgagatggagtctcattctgtcacccaggctggagtgcagtggcatcatctcggctcactgcaacctccgcctcctaggttcaagcgattctcctgcctcagcctcccgagcagctggaactacaggtgcgcactaccacatccagctcatttttttgtatttttagtagagacagggtttcaccatattggccaggctggtctcgaactcctgacctcagatgatccatctgcctcggcctcccaaagtgctgggattacaggtgtgagccaccatgcctgggcagcttttcattttctactaatatatatgttagaataagaaagttcacatccgagcccttaaattaaaacttgacctacctgctctccatttaagcggtgaacgtctatcaattcaagaaagatcgataaacgatggcttgtatcaacttcagtttttctgtcttttgattttgtggaagctccaattcttttcattcctggtaaactcattgccatatgcagtgttttaattgcgtctgctatttctcccattttcttttgtgactgagcttttatcaaatggtataaaggatagtctctcacctgaagaataatatttaatatttccttggagtgcttacaacatcaacacataatttacaatccatcaaacattaaaataatgagatcactgagaacagtccatctttgattgtatgcatgaggtctatctctgccctcttattaaccctctgattatgtatcacattaaatcggattcaggaaaattgcttctccctgcatcctttgagatgacaaagaggttgattacatatttctactgtgacagaagagaaagtgcaaacaagctttataaggctagcaaatacattctaagagattacttgaattttcaggaaaagaatttctttatctggcacttctacaactgatatgaagttattagatttctagaaacactgtttctcccctttatttttttaatttgaagattaaaagtttcaggacattttaatcaaacattgaccttcccctttgacactactcctaaatatgtagttctgaagcttccatctttacgttggctatcaacagtatatacagaaaacataagaaaatgataaaaatgaggtgggaaaaagaagtcaaagggaaggagaggactcagaacgaggtgacgtggcagccacctagcgattaggaagtctataatcctcctgatgctgaggttctcaaccttaggcagcctgcacatttgcttacagagcttcgtgtgagactcacgcttgtgctccttcctcagagattttgactcagtaaaggtggggcaccagcactgaggctctgacataccactagtcttgaaaaccactatcataagaagcaggtgatattttctgcaattttttttttgagatggagtctcgctctgttgcccaggctggagtgcagtggcgtgatctcagctcactgcaagcgctgcctcccaggttcacgccattctcctgcctcagtctcccgagtagctgggactacaggcacccgccaccacgcctggctactttttttgtatttttagtagcgacgggttttcactgtgttagccaggatggtctcgatctcctgaccttgtgatctgcccacctcggcctcccaaagtgctgggattacaggcgtgagccaccacgcccggccttctgcaaatcttaattaggattctctaattcactgaagggttctctcttaacagggtccatgaccctgtgaagcaaagcagaagttttcagagctcctccatgacttgaggtagttcaggaagcaactgaacctaggattttccctaacgttgaggggatactggatataacacataatatcttggatagaaaagtactgtgtttttatatcctcaaaccacaaaattactttcaaaatgacaagatgttctttcacaatgaatctaaaaagaagttattaaaaactaaggtccaagaaataaacagacaattattatctttatacataaaaatatttgacataaggatcatcatttttatataccttcattattgcatttaattctcattgtaacagcagagtattagtaaatgagttttacagaaaagaaaactgaggctcagagagaagtgaaagaccagacattaacctcaggatttttgtcaccaagtccacatagttttttacccatacctgaattgcctcaatttttcctcctactgcttgtgagttccatttttttttccattaaaaatgcaactgttagcaaaatactacaggctaaaacacaaaatacttgaatatgtaagctttcaaggagggtgatatgtcttatccacttcagtctggaatacttaccttaaaatcatagctcagacaaagttcaagagactgagaacacaatttgactttttcttgagacaagtaaacctgagctagcagcagatgagcatcagcataagagggattgtgttctaagcagtgctgaaggttattgaaagctgcttcaatatcacctaataagaaaaacaatgcattgttataattcaaatgattaagaaatggagatctgagagggaagaggaagaagagtgtttagtttacggatagccctagtgtttgtaaacttaaagtttgctgttcataggccatggtttaattccatctgcactagttagcttccttctagtctacatgaatgaatacacctgcaagtcaggcaagttcttgatcctaacgaacaagccagggaaagcaggaaaggatgagagccaagcactggtgttactgagaggccaataaacggacctttattttccttgtcaaaaaaaggttttatttataatttcattaaaataaattatgtagaacaaaaacatttgaatagctagaattttgttgtgtcacttatgttaacaaagaggatatcagtctagtaatcattcttggtcaaaaattctattactactatacataaaataacaaaaaaggcctaaggatatacttcagagattcagaaatatgagttatagatttaaaatacctttaaataccaatggaaataatgccagttatatatctgggagtcttaaaatagaaggaaataatcaagattaaagtgacaggaattgaggaattgacctcgggctgatagatgcggtaagaagaggctcttcagaggaaaacactgcattgattctaagtcttagaagtttctcatgatgtaacccgcactgatctgcacttaagtcacctcataaatgggccttaagaagatgtaagtaggctaactccccattcaaccttgctaggagaatgtgggaagaagagagcctaaatgattttctgttcatttatgcccctcaaactcacctgatgcctcagtcaacaaaataaggcttaacttactggtaacagacatgcactgagactgaaaatgttcttctcagagacagaagattaatagaaaactaactggctgagatagcataatgacttactaaacatggcatcaaagtttagcaatcaaccgtcaagcataattaacaaggttagattcttaacttattgtgatacaatccaacactcaaaactgcacaggtacaaaaaggaagagttaggcataataaatttgtgtgaaaattcttttagcaaggagaaggactaaggcgataatttgaagaaacaggttgtactaacaggagaaagtgcatagagaattagggtttgcaactaagagaatgaagaaaatgagtgccgtatgagtaacagaaatgagaatctttgtttcttttaagggtgaggagatggatatgtagggtaggatactaaatatttaaaatattttgaaatattttaaatatttaaaatattttgaaggatactaaatatttaaaaatgagaagtgggtcattacttttgaggaaaatagaccctgtcaccagagatcaacaccaacatcacattctttctaagagcagtccaacttcccttgagtgaaactgaaagacatttcagtcctgtctgtctgtctttgtcagaattctgggtaataaagcatttggctgacgtttgtcttgggttcctggaaggagactctaactcttcaaatttccctcatgttagggatttctgtgttattcattatggaccctgatagtttatcctaattaagagaatcatggtgtgcccctggatagtttatgctaaagatatgacttggaatgggggctagctgtgccagaaagaccaaccctgtgattagagggttggtgcttagagccacattatcagttggtgggggactggagattgaattcaatcatatggccaatgatttaatccatgcctatttaatgaaatcccaataaaagctagggacaccaaaccttggtgagcttccctggttgctaatactctgattgtcacacattgacatgtcaggaaggtgatgtctcctgactccatggggagagggcaatggaagctttacatctgggaccctatcagacctcaccctgtgcatctctccctgttgctgatttgggttagtatcctgttgctataataaaactgtaatttcaagtctagtgctttcttgaattctgtgattcattctagtaaattaatgaaactgagggacctccaaatttgcagctagtcaaaagcacaggaggctctaggagtgcccaaatctgtggctggtgtctgaagtcagggcagttttatgggggactgtgcccttaacctttgatgtttggcccaactccaactagttggtgtcagaagtcattgcagttggcaatttagcaaaaacactactacttagacacatgctagcagtatttcacatgagttaaggctgctcttccttttttttttttttttggttactagaaattttcttaatctttttttttatttcaataggtttttggggaacaggcggtgtttggttacatgaataagttatttagtggtgatttctgaaattctggtgcactcatcacccaagcactgtacccaatgtacatagtcttttatccctccctcactctcctcccaccctttcccctgagtccccaaagtccattgtatcattcttacgtaggctgttattcttaaaaatgggattaatataagaaattttcaagactagagactttaacaattaagtattactagattgacatataaattttcacaatataaatacttaataaattataggaatcaaagtcccagtctaattatttagtaggcgataccccttccaattaggagaaaagctgaaatatcatgtggcttaatagtacaattcaatcagaaagtattagtgtcacttcttacaattgaaatattttagaggtaaaacaaccctctgacatcatctaaattttttttaacagttaaaacagaagtccataatttccacaatctatagggaatccaaacaaatcatcaagaaaaaaaaatcccattaaaaagtgggcaaatgacatgactagacatttatctaaagaagatatacaaatggcccataaacatttttaaaaaatgctcaacgtcactgatcatcagggaaatgtaaattaaaactatagttaggtaccaccttaccacagccggaatagccactattaaaaagtcaaaaaaaaaaaaaaaaaaaagacgttggcatggatgtggtcaaagggaacacttatacattgctagtgagaatgtaaattagtacaacctctttggaaaatagtatgaagatttctcaaagaactaaaagtagatttaccattcaatccagaaatcccactactagatatctacccaaaggaaaagaaatcattatatcaaaaagtcacctgcatgtgtatgtttcttgcagtacaattcataattgcaaagacatggaaccaacataagcgtccatcaaccgatgagtggacaaataaaatgtggtctatatatacaccacagaacactactcagctgtaaaaaagtaatgaaataacgtgttttatagcaacctggatggaactggaggccattaatataaatgaagtaattgaggaatggaaaaccaaatactgtatgttctcacttgtaagtagtagctaagctatgagtataaaggcaaacagagtgatatagtggactttggagacttagaagagggaggatgggaagagggtgtgggatagaaagcttcatattgggtacaatgcacactactcatgtgatggatacactaaaattccagacttcagcactatacaattcatccatgtatccaaaaactatttgtacccaatacaaataaaaaattgaaataaaaaataaaaaaataaagaaaacagaggtccaaggaagcagtaaagacaatctcatcactccattatattacaggaaataactattcatgaaaatacctttaagttggtttctgctcttaacagttttacaaacgttatttacttttatagcattcagttggcaaaggtacatacagacaagcataatatgatggtcttttttttttttttttttttccaagacagagtctcactctgtcacccaggctggagtgcagtggcacgatctgctgactgcaagctccacctcccgggttcacgccattctcctgcctcagcctcccgagtagctgggactataggcgcctgccaccatgcctggctaatttcttgtttttagtagagacaggatttcaccatgttagccaggatggtcttgatctcctgacctcgtgatccacctgtctgggcctcccaaagtgctgggattacaggcatgagccaccacgcccagctggtttttttttttttttttttttaatgagacagggtctcactcccatcactgacgctggagtgcagtggcgtgatcctggctcaatgcagcctcaacctccctgggctcaggtgatcctcccacttcagtctcctgagtaactggggctacaggcacatgccaccaagcccagctaatttttgtatttttttgtagagatgaggtttctccatgttgcccaggctggtcttgaactcccaggctcaagtaatctgctcgctttggcctcccaatgtgttgggattacaggtgtgagccaccgcacccagccatgatggtctatttttatgtgtaaagtcaggcatttgtctgtgccttagaaaactaaggttataaacggattgtttttattttaagctatccataacaattcacagaaactaaacaagaattactcagtacttttcattagggcctgaaatctggcaaatgttgcatttggttataccagtaagaacacaaccatggattaatgactgtaaattcttattgctagtctccagtaatttctgacagacttttttttaaagtggtataactgcattttcccagcaattcgcttaagccacacaagtttatagtaatttttaaaggattaaagagtaagttatgcaattctattttggattaaaattacttatctatgcatatataaaatgtacattttatgtgactattctctatatatacacagtgcttaatttatttacgcttgtttttatcaacatcagaataaaaaggttaaaagtttttaaggtatactctacctgacaaatatttcacttttgctattaggaagactgtttgcagaagacctggaacagttcttactacagtctccaggactgagatgcaacgcctgagaagtggacaaagaggttgcccaggacttgcaggctaaacaaaacaaatcagcagatcattttataagtgtaaaaataatatttacctaaaataaacatatattaattttagtataactaaccaagctatatacatttttctaaaatttctttgatttaacttattttgtaatacctttattatgacttaactaatactaatttatttccctgggatctatgaacagacaatgcaaataatggctcttgttcagcaaaataattatgaaactattatacaattctaaatggataacatatcaagtgggtattatctattcaaaagttttatcagagaaatatatctgttaaaggaaagataactgagaggtacagtttcttgctagaactgacagagtcaaggcagtaagtgttcgaattctagatttgccttgtgatttgctcaattcaattactttcattatcccctagagtattgtaaaccagttttttaaagaattcagatttcccccagtggtaaacagaaggtagaacactcactatgctaaactaaatgtctcatacctttacattccccactcttcatcccggcatgttttagaccctcaaagttttcctttcaattaataatgagtatgataattaaagtgatactagaacactactttattcttttcactgtttcttcttcttataatggctgtctacccaaccaacttttatccaatggtcatccaatcacaatttagtaatgtgatatcagaatttaaatataaaatgttcattcctcctgctttgccttactaaggctgtttctttatgtaaggatgatcctctccaccccaagccccctgacacataaagctcttcaattggactgtgccttcttatggaaaattactcctataatgagccattattaccaacaagaaagtgctacaacttacttatgttgacacacacaatatatacgctcaaaaagataatcagaatatgactattattgcctagaatacttcaacttctttatcatatataatctatataataaaatttggcactgtataatacccatacagttctactggtagtttcatatttagttttccttcttttataggcctacgggtttttatgtgtcttgaagataagatttttatgcttctttgcacggtaatagatacagagcaaacagtttaaaaatatctgtttttttcagcctaagtaaaaatagtgaaagtgtaagtgatggtgaggttatgataatgttctttgtcacctgctaagaatgagttattgagaacaaccatcattttcactgcaaacaatttcaatgtacaatcatagaaaaaatagttatgcagacaatctttaagatatcgtttgttcaattaaaattctaaacaaaattatgtctataaaacggtcaaagaagtaggaacagagctaaagagacaattctgcctttctgatatttccctatgaaaacagtatcacatatgctgattactttctatcatgctggtaaaggaaaacagaatttcctggtaaaggaaaataggatgtccatttgaactagaggcccaactaccacttaatgcatgatttcttgttctatctacagtttattctcagcacatctgatagagaaatccattaaaacattgagttaaaatgttgacttggatcatgctggaagccttttggtgactccccattgtaccccattgtactcagaattaaggccaaaggagttataagaactgctatggccctacctgggctggtctcctgtgggatgacctcatctctgactactctcctcctcctcaccctgccccagccacatttgtctcctcgtgtccctttgggcttctgcaccagctgctcccattgtctgaaacactctaccatattttcacatgttctgtgatggttaatactgtcaacttgattgtactgaaggatgcaaagtcttgatcctgggtgtgtctgtgaggatgttgccaaaggagattaacgtttgagtcaagaggctgagaaaggcagacccacccttaatttgggtgggcactgtctaatcagctgccagcatggctggaatataaagcagggagaaaaatgtgaaaagactagacaggcttagcctcccagtctacatctttctcccatgctggatgcttcctgcccttgaacattggactccaagttcttcagctttgggactcggactggcttctttgctcctcggcttacagacagcctattgtgggacactgtgatcgtgtgagttaatattctttaataaactcccatatgtatatatggagtatatatataaactcccatatatatatatatatatatatatatctcctagtagttatatatatatatatgtgtatatatatatatcctagtagatatatatatatatatatcctagtagatatatatatatatatatcctagtagatatatatatatatatatcctagtagttatatatatatatatatcctaacagttatatatatatatatcctagtagttatatatatatatatcctagtagttatatatatatatatatcctagtagttatatatatatatatcctagtagttatatatatatatatcctagtagttatatatatatattatatattatataatatatatataatatataatatatatataatatattttatatatatatatatatatcctattttcaagtctttgttcagatcttaccctcttcatgaggcctatcctgaccactgtatctaaaatcgccatcacccaaccatgctctattattttctcctgtcattttctaaacatattatacaattgacttaatgatattatctgtctcctcctgttggaatacatgcttcaggggaaaggaatgtagtttgttttacatgggtatttccccagctctaagtagagtgctaggtactctataaacatttgtacatttgtagaatgaatcctgaatactagattaatactgaaaaaaatgtattccaacttccaagcaagggaaaatggattatgactggggagtctgaggtcaacccctggtacaattctatgagggtttaagtttaaaaaataaatagtaatgaaagcctaaaaaaggacatgataatcaaaaagtctgtatgggttccctaagggaaggtcattttccttatttcccatgttaacacagttactgaagctatagatcagggacaatgctaagaagtttgctttcagcaatggaacgcttgatagtgcctgctctgatatccctgtgctgaatgtgagctgaatataataaagttaggatgtctgtatctgcttactatctgtaataagagtgctgactaataaatccacatcaatttggaaagaaatctctggtagtacaacatagggtttcatcttcaattatactcaaaactgttaatgcttggaaaagaacattatagtaatagttatctcagagctagataaagcagatgacagatgacaataaagatccatctaaaataggtgacaatcatgatccacaaggaatatgataacatggaattatgagatgaatctgaaaagataaaatttcacaggaataaatgtagagtcctacatttgagtccaaaagtacaacaagtaagagactgaaagtctttaattaactgttaattcaacagaggtcattaatgtaatgtgatttataaaaagaaagttggatggacttccagaataagggaggaaaaggtctactctagttcttgcaggtcaaatccacgtttggaatagtaaacttaatgagaggcacagacaaaataaagaatatcatcagattcacacacagaattctcaaaactatttcatataaaacataaatggctggaaacctggagttgtttagtggaatgtgaaaactaattgccaatatctgaaggtctgtttaatgaatgaggaatgatccttgctctaagcaactggacttgccctatgtcaatctagggagcagaaggaggaccagtaaatggtcctttcttttttttttttttaaccaaaagcagagtttgacttaacacaggaaacacaggctaacaatcatagttatatgacaagaacttcattttagtgtgtccagacatgggatagacattgacagtgatgttacagactggtagcaaatataaggtaggtgtctgaattagatgccttttaatatttctttaaactgaagattttaagattttatgaaatacaaatgaatatttgcaaaccaatactttcagtagttgacagcagtcattactaaaaacagtctgattaaaagcgatttcaactaacataggtacaaatactaccattttaagatgccgatatagtctaatgcatcaaagaaaacttttaagttctttcataaaacatcaagtaaacgcatccttgaaagtaagtcccataattacttacctgcattggacagaagctcagatactccataacaatttctaacaagaaatcaggatttagcttttcaaaatactgtatgccaagaggcaaaccttctaattgtgaaaagtgagtgtccaggacatcatttaacaaattaataacttcttcttgtcgtttatttttcttcatggcaagaactgcatgtaaatagattaattcctagaaaataagtagttttcataaattattccatttagttataaagccatttatttccacttagatttcaaatgcatataatgtgctactgatatgcaattatttgttcaaactcaagtattagcttgaatagacttttagaatcattcagaagaataaagtttagttttgaatggaggtaaataaatgcaattacatattaaaattagtgtacactagtgctttacagccattacaaaacaataagactgattaataatttcatattttataaacagctagcatctaccagctgataaaataaaatactgtaccgcagattttccaatggattgctggatttcatttaaaaattctagctgctgatctgcatcctgtaattgcccttctatcaactgacattggataaatcctaaaatcaaacagcagaaagacagtcaaagtccacaccaattcagggatgcactcttcaagctaacataacaacattaataaaacaccctttcccccatcacaatacttaacgttttagattaaaaacaacagaaagaaagaaaatgaagagtgaaagaaaataaaatgggtagccttggaccttataaaatcatttactgaagaattcataatttataggaaccacgttataaaaatctattctctcaagatattatttgtgaattaaaaattttaaagacatgactttttcgagtgtgggcagtagagaacaatttaagtttagaaaaccacaaaatccatgtgttcttctctaatggcaagttaaaagcaattgctacttgtatctatattataaatatttatgaaaacagttgtcataccaactagggcagacacactagtctcatcaagtgtcatggcggtcttataccacttcagtgcctctttaactcttccttgtaaaatcatttggtatccaagttctgtagcaaattctgattgctgagggtttaaactaaaagctctctcaagtaacgtttgaattttttgaagaataagttgactacgtccacactaaaaagaaaaaaaaatgatgtaagatttcaaagtctaacatttctactgagactaaaggattattttttctaaatatatatattatttgtacttcaaaggagtgatgaaaaagaaaaaaattaataattaaggaaaaataaaactttcctattatctagacaatgcatcaagaaagagtttatattctatcagaacttaatatcctaatgaatataatgcttttacaaaataactagtatgaaaagtacacttctaatgatgtcactgcaaaaacatattttttgaactccttttccaagctgtctcatgactgttttacagattaaacaggaaaaccattattttatggttacgtgggtatgggggtgtgtgtgtgtgtgtgtgtgtgtgtgtgtgtgtataatatatgtatgctttttcttattgaataaaaaactaggactaggatctgttttccccctaaacactagctatgccatcagtgagaatattttaaaagctcatgccttagaatcttcttgaaaaaaatttcaagaaatagcagtgttgttagaataagtacataatttttcaagacaacaaactttaagagtaaaatatttattcaaatgtttgaacttatattttataagcttagtaaaaaactaattgaaataatgtgtctagcactacggtaagcaaaaaaggtaaatacctccttaattcaaactttcgttatagcatggagttttcttcctctaaagtttacacaatctgatatctttgtttttaaataagaaaattcagtatattcatgtcatttaacaattaataatccttttttctttcaactttatgcttgctaattattttaaccttcttagtttaatgaacttttcaatattctcattccttgtattgattttgagattctactgtatttttctatttcattcttgattacctttcttttactgggagcttataataaaaacatttctttcctgttgttttttaaaaaataagataccaaccattccctccaccaaaatggtcttttatacactttaaaactttttaaaaatagttttaaaaaacaaaagctaagagcaatcctggtcataaatcttatgctctgatgaaaataaaccaccttctatttcctttgtctggaaggcacttcgctatgcttaaaagatcagtaagtggcatttcctccatgaagcctccatcaggttcttacagttggaaaccacacctcctctaaactgcctttcctaggagtatatcatatatttaaatacatatttgcactctaggccatatgctcttccctgcttccaccttttccacttattttatgtcctctactatagataacagagctctggtacatggtaggcactctcacagttctgctgaaggcgagtgtaatgttatagaaaagttgagcattctgtggttccatggcatccaatgtatttcccaagttttccagcttggtggaagcctaaaacaaaaggaactggtattaacttaaaatatactaagtaaaaacaacataatacatgcacatacacactaacaaagcattaccctactagtattttaaaagacctttgcttttataaattcctcctccttcaatggatgattatatgttataaaacatatttaagattctaacaaactcaataattataaatgtgttttagaatgtgtttctttaatacttgttattgaatggaaacctttggataggcgaagacacccataatattccattaactgtacatgcccagctccgccttcaatagttaattcatgacacaaatgagatacgaatgataatgtatttacaagtatatgaggtcagcccttcaattgcctatacagactggtttatattcaaaatatattctagactagaaaaatcattacagtacttagtataagtaatttcaatgcctggaaaatttactgaagatttacccctactaagatactcctagcatttactgaagtatctatcaggcactgtcacattaaccaatttaaccacactaaacaaaatgcaaatctactacatgttatactaatattacttccttcagattagagtttggcactccatgatccaatctacagtcaatgtgttcactactacagaaacagatgtgctttattatgaggtataatgggattttatcccaagcccatttaatttttgcaaattcagttaaattgtaaatatactataaattacattttgcatacatactttctcatatctagtatcactagttacattacgtatctagttacattaatcatatatattactacacaggagtttcatacagaaagccatatatactataattaatgatttaagggattttcaagggtaatattaactgtatagtatttttgctttaccaatagatttcagaagctgacctctttgttaaggtatactctagtaatcaactaaaaactaccatgatgtatattttaaaagagaacttcaaggctttaatgtatatgcacatgcacacatgggtgtgtatgtgtaatgaaatatattttttaatataggaaacttaaataatacaatgccacttaccttctctatatccccctctctacacacatagtagagtgcctgcattctcagtgcttccacattttggctatcttggagcagcaacctgcaggaaaacaatttagttaatgtcaaaataaatttatatattttcttttattcgagggcatgaaaagttggtttgcttgcctcactattccactgttcaaataagtaattttcactagtaaaatgtcatctgctttgtgaaaattatcaactttattatttaaacaagtaaaagtctctggagtttaatttttaatatgtttttaaaagatatgaatagattatactagtctcattaaatcttgtggcaatcctaaataaaatattagctaactatatacaacagtatagtaaaagaataattcaccttaaccaggctgacttattacaggaattccgggaatgcaaaccagggtcaaacattacaatacctactaatgttattcacaacaacagattcctacgtgataaaaacaaatgagaaaatattacattaaaaaatcttattaataaatggaacaaaaaccaaaaagaaaaacataacaggcataaacttaagaaatgtgcaaaagctataaaattcctatgaaactgtactcagggacatttttaaaaagaactgaaccaaaaaggtaacgccccagacttctcttatcatggatgatgtggtacatatcacaattactggttccagtttttcaaccctccctgagtacgtgtcttctgccatgtaactaactacaaaagttggagtgtaccctactgcttcttgactagggacttggacatttttcttatattggccaatggaatgtgggcaggaatagcagtgtatcaacctaaattttagaggcactgcatacttctgcttgttctctggcacttgctatcagtacaagaagaatttcctctgggtagtggctgctacttgttgtgagtctgggggaaacactattggaggtgacaagagtccaaactgcaatgatgtgccacattcacccagctgcatctgaactgaagcagggccccagccaagccttgcctgagatcagcagaccctcgatgacccacaaaaatgtgagtaaagaatacttattattatatgtcctgacatttgtggttgtttgctatacaccaatagctgcctgatataataatggtcatttttgggaaagaaaattttttttccccacatatgactacaaatttaatgcaattcaaaccaaaatcttctatggcttcttttttattattttgtaaattgattatgacagtcaagagcgaaaaaaagagccaacaaaactgttataagagaaacacggagaactccgtctctactaaaaatacaaaaaattagcagggcgtggtggtgggtgccagtaatccaagctactcaggaggctgaggcatgagaatcacttgaacccgggaggcggaggttgcagggagccaagatcgcgccattgcactccagtctgggcaacaagcgagactctgtctcaaaaaaaaaaaaaaaaaaaaagaaaagaaacgaaacatgatggagaacttgtgataaaaattatcagagtccattgaaaactgaggagagaataggctcacttaaaaaaaaaaaaagcatatttagaaccagttatataccaaagaaaaacaagagcttttagcatatgaaaaattgctcaatctcaacacaataaaagaaatgaaaataaaaatgagatacctctctttcagattgcttgaaaaaaaaaatacacgcactgaaaatggccagaattggtgaggataaggtaagggatcattcaatagactactagtaggagtgtaaattagtacaatttcctaggagagcaatttggcagtgcctatcaaaattttaaatttatatacttgagggagagactacaatttgtctcctcaaattcattctctccttatttgcttgggcatgtggctagccaacacttcctagatatctttgcattcagaggtggtcaacgtgaaataaagtaatatatgccatttctgggcctgggcttttatgaaaagtggaatgacttctctacattatctttccctttctgccaagtgttatgaggtcttaggagatggcaggactgcaagatggaaagcgtctaggtccgttaaaaacagtgtggagcaaagctgcctgatcacttctaacatttacccaaaacagttacatatggggaaacattcttctattacactgaatcattatatgtttagatctgtttttgtagcagcttagcctaccctaacaaatacagtatcttggattcaacaatctctcctttgggaaacttctctgcagatatagtcctacatgtgttcaaagaggtatgtgtgtatgcatgtgtgtacagtgcactatactgaacagtgaaaaataggaaactgcttaggtgcataccaatgcggagagattaaataaattatttgcattttcaattcatagaatgctactcagttttaaaatgattagggaaaggaagaaatacatagatgtttacagatgacatgaacatctatgtagaaaatctaaaagaatcaattaaaaaaaactcctggaatcaacaagcgattatagcaagattgtaggatatgaggttaatatataatatcaattgctttcctatgcactagcaatgaacaagtggtatttgaaattaaaaacacaataacatttacattagcactccttaaagtaaaatacttaggtacatataaatctaacaaaatatgtgcaagatttctatgaggaaaatttttaaattctgacaaaagaaatcaaggaaaaaccaaataaacggagagatattccatgtcatggatgcaaagacaatacaagatgttagttcttcccaatttgatctgtaaactaactcaatgcaatcccaatcaaaatcccagcaagttattttgaggatattgacaaactcatcctaaagtttatacagattagcaaaaaaacacagaatagcaacatactatggaaggaaaagagcaaagttagaggtctgacattagttgacctcaagacttactataaagcttcagtaatcaagagagtagtgtggtattggtgaaagaacaaacaggtcaatggaacagggtggaaatcacagaaatagacccacatagatagtaaactgatctttgacaaaagagcaaggacaatgcagtggagaaaagacactcttttcaataaatggcactggaaaaactggacatccacatggaaaaaatgaatatagatacagacctcaccttcttcacaaaaattaatctgaaatagatcacagagctaaatgtaaaacataaaactataaaattcctagaagataatacaggagaaaatctgacggcctatggtttgatgatgacattttagataatacacaaaaggcataattcatgaaagaaagagttgataagctggacttcattaaaattaaaaatttctgctctgtgaacgacaagccacagactgggagaaaatatttatcagatatagatatatctgataaaggactgttttacaaaatatacagagagctcttcaaacccaacaataagaaaacaatcaatcaattaaaagatgggccaaagaccttaacaaacacataacaagcaagatacacagactgcaaataagcatatttaaaaatgctccacatcatgtcatcagggaaacgcaaattaaaattaaaataacaatgagataccactacaaacctattagaatggccaaaatccagaacactggcaacatcaaatgctgatgaagatgttttaaagcaagagaaactctcattcattgctggtgggaacataacatggtataacatttttggaagacagtttggcagtttcttagaaaactaaatatactcctaccatatgattcaggaattatgttccttggcatttgatccaaaggagttgaaaactgatgtccatacaaaaacctgcacaaggttatagtagctttattcataaatgccacaatttggaagcaatcaagatgtccttcaatggataaaactgtggtacatcgaaacaatgaaatattatttagtactaaaaataaatgaactatcaagtcatgaaaagacatggaagaaagttaaatgcataatactaaatgaaagaagccaagctgaaaaggctacatattgtattattccatattacaggacattctggaagaggtaaaactataaaggcagtaaaaagagcagtggttgcaaggagttggggagatggagggatatatagcggatacacaataaagataatttttagggcagtagaaatattctgtatgatactataatggtggatacatgtgattacacatttgtccaaaccactagaatgtacaacaccaaaagtgaactgtaatataaatgacggactttgggcgcctatagtgtaagttcatccactgtaacaaatgtaccactctggtgggagatgttgataattaggcagcctatctatgtgtggaggcaaggaatatatgggaaatctctgtaccttctgtttaattttgctgtgaacctaaaactaccctaaaaatactgtctattaaaaaacagtttggtgtatctatgtgaataggtataaaatgatatctatgaaataccctcttaaagagaaaaacaagtttaaaagtacattatgagtctatttattatttttaaaacaccctcaaatatatacatatttttaaaatatatagaaaccacacacacacacacacacacacacacacacacacacacacacacacacacagtgcctagaaaaaaaatcttgaaagatatatacatcaaaaaattactagtaccctaattgtggccttcaaatatcatttcacactaaaagagattagattgccctggacaaatgactgatacctacttggggaagtaatacacaaaatgagcctggacagcttgtcgtaccaaatagcaaagtaactatcaaagactactaggatcatgtcaaaaggacttaagaacaacttgaagaagctcctaatagtcagagaaaagactgtgcaattataatgactaaaatgtccagaagcactcatctaaatccatggtatgtaaaacaaacaaacctgagccactaatcaattaccaatgaaggatgctaaggaattcttggcatttttttttttaaacctggaaataacggaaaagacttcagcatcttatcctacttttcttatatgaaccataccactcagtaactaaccaggagaagagaagtttttctttataggtattctagctaagaaacaaagaaagaatgacagaattcaaatgcaaccctactataatccctatgaatcaagcacctagttattgagcatgaataactgctgatatcacgaaaagagagagacaagcagacattctgtcactgtgatgaaagacaacagtaccactcatgaagtaattgccaaaacaacaaaattgaatgtgaatttaaccaaacctctagatccaactaccaacttacaggaaatacagaggataaagcaacaagttgtactacaccatggcagacaaacaacaaaatctagatcatggaaaatgctacaggacaaaacactggtttcttcacttaaaaaaatggcaagaagaaaaagagaagggaaacagggaaacagaaaaggcaggaagaaggagggagggagagggaagaggggaaggagaaaggaagggagagggaaagaaagagtgagaaagaactcacagagacagggagacagcctcgagactttaaagatataaaccaatcaccatatgtggacttatttggatcctgattaaaaaataatttatttaaaaaacacaatatttgagactattggtaatttgaacactggataattgatattaaaaagctatttttaattttttatatgtgataatgatattgtcattatgttgtagagggaaaagaattatcctattttttcaacacatcttgtgatatttacaaatgaaatgatgcagagttttgaatttgcttcaaaacgaaaattaaagccaagaaccaaatgggagtttagtcatgtggtgacggtagctaggggcaggaaacagataaagagtacctcatgatgttcttctgtctgcttttacataaatctgaaattctccataataaatgatagacgatcttagcaaagatgttaccaagatgttcggccctgagatagccattaatattttgtcagatatgaataaaagttagacatgcttgcaagtcacttattctcaagattctaagactataaaccttaatccaaactgaagtaaaggtgactttctatgcaatttatacttcatttgtatcttgaaagtatcctgcctattgtttgcatgaaaagttctattaagacattctgattttaaaggtatatttgtattacctatgaaatttacttttctgtaatttcagtattaagtgacatgaattcatctgttagaaagtattgatttgtgactcaaatatatttattcttgatctcatggctttaaagtcactgacacataaatcatatctatgtgtcagtgactccaaaatactagctatagcctagacctctcacaagaactccagattcagacatccagctgcctgcccatacatccatctctactttgacttctcataggcatttcaaacttacaatgttgaaagctaaactccttacctgccctgaaaccttctttttccataatcaccctgtccagctgaagcaaactctatcctctagtgcaagtagtgggtaagagcacagactctgggactagagtgctctggatttgaatcctgactccaccactaagtaattgtgtggctctggagaaacttcttaacctctttgtaccttagtccactcagctgtaaaacagaaatactaatagtaccttcctcttagggttaccctaggaataaatagcacttcctatgagccaggcattctgaacacttcacaacagttcattatcatcattgttgttgttattctggtagttcaggccaaaaaccttggaatcaccttaaactattctttctcttacacctaaacaaaatgctacaggtccagattccaatcacttctcaaagcacttccaccacaactatactgggcctgccccgaccatttctcaatgatggcaacagctttcaaaaggttctccctgcttctgcctttgcctgctcgcccacagtctgttttgcacatggcagagtgattcttttaaaacagaatttagatgatggcactcctctgctcaaaaccctccagtaacctcatgcttcagaagaaaaccccaaatccttacatgggtaacaagacccttcaccatctagcacgggctcactcccaccctttgtctcagacctcacaccttactcacctctcttactccttcccactcctcaaacatatgacatgtgctcccacctcggggactctgcatttgcttttccttctttctgcaaagtcttctctcaaatatctgcatggcttactcccttaccttctttagaagatggctcaaaggtctcagccttccatgaccatcccataagattgaacccctcaacactccccatctctttcttggtttatcttttccccatagcacttatactttctaacatactacacaatatacttatttggtgtgcttagtatatggttcctttcacttaaatataagcttcatgaccacagggatattggcctgtttgcctaaaaagagtgtctgtcttaaaccaggaatcaaatatttatgtaaatcaataaattcaatgtttaaaagcagtatgattttaagtatttcctcggttccacactgtttgaaaaaaatcaaatttaaaaacccttatgaaaaaaattcacagatgtcgctttttctcaaaattataaccaaatccaaagagacttgtgtcatcttttattacttaacctttgtgctgtctcaactgtctggtcccaatcctgcaaggctagttgtaatttcattttcttaacaaaagcaggaaggaagctcggaaaattcacgattatctggttcacagtctccagggcacctgaataattctggcgcatctcaaggcattgtgcctaatggaagggaaaaaaagtgatatccaaactgtgatctttcatatcaaagttctcataacgcagagcaggcagagtatgagcgtttaatacttacttttctgtgaggagcagttatcactttttaagtttttgtcaaaacaaaattttaaaacatcacagaataatacaaatacattatataagctattgtgttttaaaatttacttttaaatggctgaaaaacatgattaaaggataaaattttttaaaatgttctcggaaataccataaaataatgtttccatttaaaacaaaattatctttttagattaaaatgtttccaggaaattttcaagtagcatctaaaattttaagaaattttagaaattttgcatcttttttaagaaattattttcaggttaaagaatatatgattttaaagaacaagcaaaatacagttcaaacaaatccctctacttcaacatttttcacttctatgaattatctgaaggaaataattggacaagaccacaaggaagtatatagatgatatttatggcagaattgtttatgtataaaataatcccaaatgtacctagaggagaaaattatagtatatctaatttaataaaatgttaagtaatcattaaaaatgatgatataaatttgtagacgtagatttactgacatgaagagatattatatataatagtttaactggttatttccaatggtgatgctcattttctcattcagatgttattgtattttctgaaaaaaagttttactatgttcatgtatctcatagtcagaaaaaataaagctataaatatagttagtacattaaaaagagatgatgaggcaaatttttatcaactagcttttctttaagagaaggaaaatgatcaagaaaagtatatggccaatttcttcagcagtgctattaggtaaaacttgagggtagtgggcctgaacacaagatgttcaacaggcttactgtccacacaaagtgacaggaaaagtgatgtggagacattaacaaaagtcaagacatgaatcctctccccttcttttttatccctccaaattactgcttatctagcagacttgttcccaacatataatttctttttgctgagtcaaaaaaaaattaaggcatttagatagcatcaatggggattgaagaaagggtcctacttaaatatttccatccatcagtaagttctaatgactccttcaattgctcatccctcaaaatgtatgtccgatcatgttatttctctgttcaaaactttgtattggctgcctgtctctctaatagaaggtagaagccaaaggccttacagaacaggccaggcccaccactcctcctcacccccatcccacctttcttcctcaggccttcacttctgttctctttactcaacccactttggcctccttgctagccctgaatacaccttagggtacctgaactcatcatctcctctatttgaaatactttccccagatgcctgcagggctttaaccctcacctccataaatgtgtttgctcaaatgtcactttctccgaccacttcatgtaaaactggaagttcatgccctagcttttccagctgtattttccattatacttatcaccttctaatataccatataacttacttattttgtttattgtctgcctccatcagtaggatataagctccataaaaacaagaggttttctcttgctcagggtttctaatatctagagggatgcctcacatacataagacacataataaatgctgaggaaagaatgtgtgaaccaaaacaacaacaacaattaacagttacagctgatccaggattcaggaactctggcagggaatacatttctctagtgtattgctcattgtcctacacaaatgccagtctaccttacagctgtgagctgacaacagtatcatgaaaattatcaacttttttgagctacttggttttgtcaggtttcaaatatattatgaatatattttgaaacatgatttatttaccctaactccaactcaccttacccagcagagcaaaagtatcattcccatcttggagtccctcttcaaaatacttcagtgcttttttagtgtaaggctcttttcctcttgtaatatcaagccatgctttcaaaacgtgtccctgtaaaatgaataattctatttttacttttttagaaatgagagaaataaatgttaatgaaagagcctaatgtcatttttctggcaattaataacaaaaaggactctatcaaatatgttatgaacaataaaattctgttagtgaaatcacttttgaacccttgccagcctagtgtcttgggaactatactacaaatttcagcctttaacattactattaagctcaatattaaaattaagaagcttatcaaatattccattagtgttaaaaccattattttctctgagactttgctagtaattgacaattaataacacttaaacatgaaattcaatatatagatgagaatttgttgtttctttttggacaaaccgtctaaatgaactaagatgaaataacagaagaagccttgcttcacatatcttaaagattcagataatctggcaacaatcttcttaacctctttgattagtccattgaatttcaaatgacaggtggatagcctgagaaattataaactgaagaactcatggatatttatctttacacatgttagtgggccgatgggttgtaagacatatgggattgaaaacaagataaaaactggttatttttctctttaaggtcaaataaaaaactgtgaaatgtgctttttctattaaaaaaatctaggttaactgacaaatttataaacctttaactaagactatatttacctccctgtatttcacccgaaaatacaaataaggatcttaaccaatgctatgtgctaaatcagtgccatcattgaatggttttaactattgtctctgtgtggatgattcccaacctatatttctagccgaaaacctcttctaaatttttctttttccagaaattcatctgctatctccatcttactgttctgccagcaccagaaatacagcatgtcttaagacaaatagatcacttccctttaagattagtttcttatgccaatgtattttctatttatgctaactggtctctaatttttttaggcttaaggcctcaaagacatcctaatacgtgacaacttgttatctttctaaactattatcagttcacaggtcctgtgggtatttaaaaattttgaactttgtactcactgtacaatattttagtgtagtgcctcaaaaccttccacaaggaagtactatctttttcttttcactgcatttcagtttattctcaagccacttcatccaagaaaccattgtctaattaatcttctggatttgcactctaataaaatcactaccatagttaaaagtcttcaatagcctctcaatgcatgtcaatcagatacaaatatttttaactagcagtcaagatccttcaatttgtctcaagttacctctccaagcttttcttcccttctcgttatcaacgtatcctgtattccatcaaatatgagtatcttagtgtaccctcaagtaacatgtctcatttccatctattatttctcaccttgggagtacctacttccctttcccataatctttgcctgttgaaattgtatccatctttcaggttttagctcaaatgctagttccttcaaaaaaattctttcacattctcttaacacttaagcgtgtgatctctccttaatttaaaacagtgcctagcacaaagtaagcaagcaataaatgttagctattattttcttgcatactttaatcacatatctctcatatcatctatcatttttctcacaatattagctggggatgtgctctatgcactactgggttattcattcatgaaagcaaagtttatgtattattttcctttgcattattaacagtacaaataatggtaccttgtatctagagctgttcaataaggagagagggagaaaggaaaggacaaaatatggagggaaggaaaaaaaggtagagaaaaagaaagagaaaaacagagagaaggaaccaggcagggatctttgaagactcagtagcataaaactaaccttagagaattcctattctacaatacactattaaccatattgataaccataaatgggttaaaataaagctgttatttacaaactggcaatagagtgaacaataataaagagctaaatcacagatactactggatatatcaataacataagcattttttaatgttattattttaaactcagaaaaatagctacctgtttactaccatctgatattttgatcattctgtcaatatattcccttgctttatcatggcgaccaatgtgccataaaaataagcctgcatggtataaggctttctctccagctcctttacgttgttccttcactctggcatctgattccagaatagcttctctatctggtaggggaaaatgatattaaataaaaattaaattctggatcaggtatttataataggtcagataattaacaaggcaaaaaatttacttctctctatagtggtactgtctaatagaaataaaatgcaagccatatatgtaacttaaaattttctagtagcactatcaaagaaatagaaagaaacaattaaaattaatcttaatgttttatttagcccaatatatctaagatataatttcaatgcatcattgacataaaaattaatgagatattttgcatgctctttccttactaactgtgaaatctggtatttcataataacagcacatcacaattaagatgctaaattttggctgggcgcagtggctcacgcctgcaatcgcagcactttgggaggccaaggcgggcggatcacgaggtcaggagatcgagaccatcctggctagcacggtgaaaccctgtctctactaaagatacaaaaaaaaaaaaaaaaaaaattagccgggcgtgatagcgtgcacctgtagtcccagctgctggggaggctgaggcaggagaatggcgtgaactcgagaggcggagcttgcagtgagcagagatcgcgccactgcactccagcctgggtgatagagcaagaccccgactcaaaaataaaaaaaaaagttaaattttatttaaaaatacttgatttgtagttttcataaaacttatggctgaaaagcagatttttagactcaagttactcctaaataagttttctaataactgaatcaagtatcatttttaagtttaaaaagtaaattaattagaattaaataaaatttcaaattcagttcctcaaacttggtaaaaaagctgtatatggccagacatggtggcttacacctgtgatcccagcactttgggaggccgaggtgggtggatcacctgaggtcaagagttcgagaccagcctggccaacatggcgaaactccatctaaaaataaaaaacaaaaatagatgggcgtggtggtgggtgcctgtaatcccaactacttgggaggctgaggcagggagaattgcttgaacccaggaggcagaggttgcagtgagcctagattgcaccactgcactccagcctgggcaacagaggaggtatatggttaaggatcactgtaatgcacaatatagctatagagtttacatcattcccaaaatagaaaggctgtatatactaatattttttaataataagacttataaaaatgtataatggttctaaccacaattattaggaacaggtccagtactggtactcaacgtattaataattcttaaatacaattctaaaatatataaacatgccagctactgttatgggtcagtaaaaagatggcataattgctgttatagtttaatactgactgctcccttaaatagataactctattcacttacattaagtctatacactctctctctctctctcccctcccccatatatatatatatatatatatattagtatctgcttaggacacagaagtcaattacacccaaaccctggatggaatcagaatcagaatcagccatgcaatgaggaagaagaaatgtaagttgcggcctgtgattccaacagttctctttctggaatggctaccaagagaaaggtatgtgactcttcctttcaactctaatgatacaaatttaaatgtgaaattaacaaggtacaatctaatgagtgaaggaaacaaaactgtttctgtaagtctacagattgcttagcaagaagacccttttctcctctccccactccccacccctacaaccccttcagaagtgttcattaaacagccatgatacagaaacagaaataagaaaacaaacaaacaaaaaaaacaaccaccaggcagaagcaggcattgtacaggaaatctttcctactcagatttccatcacgtccctaatgaggtatcaatcagctctaacaccgtctgcacaaagttgttgaaagatcgcagcctttttataagcagggtttatttacatcagcatcctggaaggaatgtatactaacaatctaggactttcctaggcagtatttacagacatctgggcccctactagagctcaagtccattcagcatcatccttggtgcaaagcagagttagcactcaggttcctctgaacagtatttctgattctgtcatttcagtgtcctgcaaatcacagtgtccaacagaatcaacactggtaagaataaccaattaaataaaaacttgattctaataataaattattttgtactaatttcttcaatctatactaactacagctctcccatgaaaattttctgctctagctaaacacactcccactggagtacggagaaaggggatccacagaagagcctaatcctgaaccacttccatgtatttgcccatccatttctcctctctggccaatactcttcatattcaaattctaccagtccttcaaagatcagattaagttccaaaatttcaaaagccttctcagcctactcttacagctgaatagtgcataccaacttcaattaattataaactcatgtttcattttgtattatttaatagaaacattggaatttaatctttgtgttttttacattttgttttctccactagattaccaacttgatgacatgaaccacttattagaattcttttgtagcttgtaactgtattaggcacagtttcttgaagaaattaagcacatatttacatgttttaaataactttgtattgatttgcatatgtatgaaggaggtatgtcatacttggctttagaaaaaagtctcgtctaatattcaaggaaccagtctgtgacctttgtttattatgtaattttttgaaacacaatctatatttacaatcctattagctgttactggatatatatttatggaagaatataacactacttcttctttattacatacaatttggatactcttctgccttcgccattaactatacattaagacagttcacataactttattttttattttctgtttttttttagagatggaggtctaactatgttgcccaggctggcctcgaactcctgggctcaagtaatccttcacctcagtctctcaagttgcagggattactggcttgagccactgtgcctggcagtttacacaactttaattgctggtttatgtataaatttccttctataatctagtcagaatctagtcaacctactactgcataaaaatttgctgaatatctcccaagagctagccctcataaagggttttaaggctctcaataagcttaatatacagaaataaactgcattggctgtatatttgcacaaaagttgtaaacttggctgctgcagagcaatttatgtacatacggtacctgtttctttggctgtcctttttttgtgtaacaattactaatatacattcccttttatctaaaaaaatccctatgtactaatgaaacctctgccagaggatataaggaacacgaaaatagtataagacacatttcttgtgcctgatgaatttacacccttgtcaggaagataaacatatgtataaattgtacctacagaaaatacataatatagtgtgatcagactgaatgacttggtaactgagaaaaataaaaataaactgaataggaaaaaatgtcctaagcattgcatttaaatatcatacctggattaggactcattttatgggcatatatcagtgcaagtagagaacaaagtgatacatcttgtttatttttaatagcctcaaattctcgaagagcttcttgagttttacctgaaaatcaagattatgatatgaaaaactgttcttagtgcaaagcaagaatttaaaactgatggaacatgtttaatgattaacacgtaccttccattaatgtgccataggcatgataaaacctgaagactggatcacttccatacctcttaattccttcactggcaaccagtaatacatgatggaaatatctctcttgacaatagtaattaatcaaagtctaaatggaaataatgaaaaaatgttataaaggaattctggtgctctgaaatactctaagaagcagataataatctaacatctagaataatgtaaaattcaggcaatgtgacttttttcttccaagtttcttaaaatactattaatggctagaactcaatgctaaggattgcagaactgaatgatcataaaattactgaaataattcaatgttttctaataatttaaattatttttcctaagtttttgttaacagcaccgaaatgaggctgctttcaccttttttcctttgcccacattttcttgaacgttttagaaaacagaaaggcagacaataaacaggaactaaaaaaaaaaaaaaaaagacaagaggcttccattgccagaccataggtttctttaaaaaaaaaaatcttctttttaaaatatccagtattttattacagcattacaaagtaatgacaaatttaattcttcaacatatcatcaaatgttatcttactcggctttgagttctgcgacaaataaattgtcagttaagaataaataaactatttttcaatgaaaatcgttgtctttaagctttttccaaagttatattatttccatatacaagacaaaactactatcaggacctactaacttctgaataaaaatgggcctgtgctgtctaccatttttcctacgattatgtctaaggcttggttgctaacctcatcaaagacagaaaccacactttcccaccatcactaggatacacctgattcaccagaaagcagtttgggccaccccatacctacctacctggactctacagcttgttcagtagcagtgagaaatacaggtgactaagtgacaggattgaaatctaagggtatctagacagctctggtttgtttgttttgttttgttttggagattctgtcactcaggctggagtgcagtggcgcaatctctgctcactgcaatctctgccccctaggtttaagcgattctcctgcctcagcctcctgatctgggactataggcacaccccaccgcacctggctaatttttgtatttttaagtagagatggggctccccatgttggccaggctggtcttgaactcttgacttcaagtgatccacccgcctgggcctcccaaagtgctgagattacaggcgtgagccaccacgcccgtccgacagctctgttttatatagtctcttgcttctggagggctatagtccatgtacttctctagatcagttaggcgactgttctctgtaattttactctgcctccctccttgtgatcactgctccctaacctcctttttagccatgtttcttaaaagtgtgctccataccccatctccagacccccacaacacatttcagtgaaacacagttttcctccaatgctccattccctaaagttgcagaatgacttcttactttgccacaactaaggacacgtttaataccttacttgacttctgcacactatcactaagcatctataatcctcctgaaaggcagtggcatagcaccataaaaaggacgcgaatttaaaggcaaaaagaatctctggtccttcttacaacgcctcagtctgctcatttataaaatgctgttagtaatgcaaatgtacaggtcactgtgagaattaattaagatatcatagtataagagttctattctgaaaaaaataagttcctctgcatcccatatgttaatggaataaaaaaaaaatgtgtcctgcgccaagacctcttgtctatgttccagattcatatttccattttccacctgctaccctgctactcatgaatcctcccttcctatttgcccagtctctctaagtctaaccacttagtaggttcttctatttctccagtctacctcccactaaacatacctaatgctactgccttggttcaggttaggttattcaatccaaaacatttactgactgcctactagtacccaggcactgggctagctactatgaatagaaaaatgagtaagacatggttcctgtccccccggaaaacctacatttttcagatgagactgtaatctgaagactaactgaaatataatgtagtaaatgtaagaaaagagcttataaactcctttgggaatgtgggatagcaacattttgacagcattgaaaactgaatgtggtgtgaggggaggatggatgactaaaatcaagggaaagattattggggaggatttcagagctgactcttgaattgcaaacccctcattctccctccacacacgtacacgctcttcctatttccttttcatgattcttgaggaaggtacaggagttaggaagaggaactgcaacaacacagataacaagtcatcaatggtacattgggatggcagtggtgatgaagatgactaaaagccactccatactctagagcagggtttggcaaaccacactctgtgggccatatctggctggctggctgtacagccagtgaactaagaatggtttttatattttccagctgtcaaggaaaaaaaagaaatatttcataacatgaaaattacatgaaagtcaaatttcagtgttcataaataaagttttattgaaacacagccatgctcatttaagtattgtctatggctgttttgaacaagccaattagatgtgatagaccatacggtccataaagtctaaaatgtgtactatctggccctttgttgagaaagtttgctattctctgctctggaggcttaagtgagacagagagtattggatgatgaggttggagacgaaggtggggtgaaaagcctcatattaagtacttggacttgaacctcaagtctaagtaatgaggaggcccatttttacattttacattaaagtgtttttattaaaatgttcatttgggtggcagtgcaaataatacatttaagggaataaaaaaatgtaaggatatagggggatagctagaacagaggataatgtaaaacttcaggcagaaaaacaagacatttcagcattccctaacctcctacatcgccaaattgtcctccatccacttatcaccatctcacaggatacacatttcatttacctacttgttgtctgactcctcctactcaaatgtaagctccaagattggaagagtttttcttggttttattatttcagtgcttagaacagtgctagacacataggaggcattcagtaaatatttgttgagtcaactgaattagggtttttccccagcattaattagcctgtaaaatctgagaaggcagaaactgttcagttttgctcactgctatctccagcttctaatggacatacagtaacccttcataaatatttgctgaacgagtgattcagtgaacaaatgaatagagaagaccaacatccgaaaagttattttattttcaagcctcatgtctttaactgttttatatcagcctttcttaagttgaccgtcattaatatttgctgaatgaatgagtcagtgataaacagagaagaccatcaccctaaaataacgacccctccacttttaagtcttacgtctttaatgggtttcatataatctttctgcgctctttttactgtccagtgtgggagctgacactagtttgccttaagtccttaaaaatcgcacccggaggcgcagtgtcataggtaacccaagctttcctagtaaacatgatacaaaagtaaacacaaccaacagcatggggaccagcaattcagaaacaccgagcgggcgggctgcccagacctgggcttccccagcagggcccgcggagaccggccgtgagcagaggctgcaggcccaccccgcaacccgagcagccggggcaccgcagggaaacagcggcctagcgaagccacccgagctccctccgcgcccccgggccaaaaggccgcaaaggaactccgcccgcccgcccgctcacccgctcacccgctcacccgctcaccttcaattcctgcgagtccatggctgccccgaggccgggccgcggggctctggggattgtctcgccgcagcctaaaggaagacgcagaattcagctcccctagcctcccggagcgctctagcgccccgggccccagcgggaggggcggggtcgcgccgcgattggctgtcggagggagaggcgggcctgtgtggcggggatcgtgctgtaatggagcaggggcggcggggacccggaggtgagggctgcgagggccgcccgggagggtccgggctgggaaaagggcctccgccggagagtgcagctggaaaaggaggtcacactgggaaacggctgtctgaggacagtgggtgggcgggccgaggaaatggaattcaggaataaaggaaacggagtatgaagaaggggaagtctgtttcctgtcactggttgtaaaggaagacaccattttctgcacgtttgtctggaggcggattcccgcagtgcggctctcagcaaggctctgccggcgcgggaaaaagcggtcaactttcacgtgggcaagttgttttacggccacaaggtggcgcagaaaaaaaaaatcacacgttcttaacagaaatacggtgcgcttgggcccgtctttgcaggcgttgctgcaatctttgttagaatgtgtgttcaattagcccttttttaccagccccgataataagagggacaaataaattaaacttccagaaaattagtgtcttgttttcaatgatactactgattttaaactgagaataaaatgaatcccaatgcaaatttttatgtttgcaccccattaggcaactcaatcagtcacacatagatttcttaagtccaggaaattaaatggaaatataatagactaagattttctatttctgcttaaataaatatttaaaatagtgcataaggtctgagatttaagtgatctttgcagaatctttcacgtggattccaaattttgatcctagtgttaattatcttactttagttgacatgatacgtagttgccttttccagattttaagtttcttaaggagtttataaacattgactttttccccatgccaataggttatgtaaggacagtcttgagaaaaacggtagctaccatcctaggctttaaggtgaagcaatatttctcaccggtttctctttaaaggaattcaccacgtattttcacgagcaacttttttttctttccaatatttatagtccagctaaatgtctgtggtgatgaacaactggtgatatctctttgattttcaaagctgcggattaatccgcacttggtatacagcaaagaataccacaggaccagggtgctcaatgaagtgtataatcttgaactgtaaacctttggttataagagaaaagttcatctgtaaggaaatatctcaggatcatggttaacagaacagatgatcaacctaccttttggagatcttgaaagtcatattaatttagcctcgtattctcttcactgaattctgttctaaggttgaattatttagcacaaaacaccaagcctgatgtttcataaatgtttgttggattaaaagtactctgagatttgctttgacactcacggtgacttggtgtgccctgtgcccttactagatctcatgtaagaaatttattttggatctcaggccaggaaaaactcttgtctttcctgaaaaatcgatgtgttccttagcagtaacatttttatcggctcacttttactagctacaaacttttgagtctgatatccatgacccttcacctcatcgtcttttcaagccttatcttctacctccccttcaaggagcctttattccgctcagtgggacaaatattccttcttctggtaatgctttcccctactttgttttgagctctttcttcacctgagaaaatctccttcttctgagttcatttcaaatttcatgaagtctttaaggatcaccataactggatgggtataaaaatatcacagtgtagtggcaagaataccctcttctgcatctgaggtggagctcctattacgctagctacttttgtgacttggggaagtaatttccctaagcctcattttccttatttactaaagaaactaaatgccttacagacatattaaaacttcctgacacataataggcattgtataaccaatagtttccattaaacacgtagtgctctatagcagtggtccccaatcattttggcaccagggaccagtttggtggaagacaattcacagaagataaattttccatggacaggggtaggggagatggtttcgggttgaaactattccatctcagatcatcagattcttatctaaggagcatacagcctagatccttcacatgcacagtttataatggggtttgcattcgtatgagaatctaatgcctcgctgatctgacaaggaggtggagcttggggtaacgctccctttcctgccccgcagctcacctcctgctgtgtaccccgtcctgctgtataccccatcctgctgtgtagcactgatttgcagtcctcagattggggacccctgctctataagacttattacacttgcatagtccttgtattactagttatagtgcatttttgtttaatgttctctaccagatgatgagcactataaagctagataatataatgtagcagttaacatcttcgtctccagaaatacgtcattttcgttcagaccttaatgtgtccggaattggtgggttcttggtcttgctgacttcaagaataaagccgcggaccctcgcggtgagtgttacagttcataaacgcacgcagacccaaagagtgagcagcaacaagatttattgcaaacagcaaaagaacaaaccttccacagagtggaagaggaccccagtagagtgcccctgctagctcaggtggcctgcatttattcccttatccggccccacccacatcctactgattggtctgctttacagagagctaattgggctgttttacagagagctgattggtccgttttgacaggatgctgattggtgtgtttacaaaccttgagctagacacagagtgctgactggtaaatttacaatcctttagctagacacaaaagttcttcaagtccccaccagattagctagacacagagcactgattggtacctttacaaaccttgagcaagacacagggtgctgactggtgcgtttacaaaccttcagctagacacagagtgctgactggtgcatttacaaacctttagctagacataaaagttctccaagtccccacctgactcaggagcccagctggcttcacctagcggttcccggcccgccgagactgcagcggagctgcccaccagtcccgcgccacgcgcccgcactcctcagcctttgggcagtggatgggaccgggcgccgtggagcagggggcggcgcccttcgaggaggctcgggctgggcacgagtccaccgggagaggggagggctcgcgcatggcatgacgggctgcaggtcccgagccctgccgcgcgggaggcggctgaggccccgtgagaattcgagcgccgcaggggcaggctggcagtgctgggggacccggtgcactctccgcagctgctggctcgggtgctaagcccctcactgcctcgggccagcggtgccgacccgccgctccaagtgcggggcgggcggagcccgcgcccacctggaactcgcgcgggcccgccagcgccaaccgcagccgcggttcccgcccgcgcctctccctccacacctccccgcaagcagagggagccggctccggccttggccagcccagagacaggctcccacagtgcagcggcgggctgaagggctcctcaagcactgccagagtggacaccgaggccgaggagacgccaagagcgagtgagtgctgctagcaggttgtcacctctcattaatactactattcactggctattcagttggaaaaagttatttaacttctctgtatacttcagctgtaatatcagactaacacctcagaaaattgttaagaagactaaataagttaatatttaaagtacagagcagtattaggggtatggtaagtactgaattactgttacctataatcacttgtactcccaactactccagagtacagtattgatcacataagtatttagaaagttttacagcattgatagtttttttcaatcatatctgtgtttgattttctcctcctccaattcttatactgatccacttgtagctgtattattttatatattcaaattaaagaaaaacacttaggaaaactagggagttttggtaacaaacaaagtaaaagtgaatacactaaaaataaaacagaggtaagtatatgtcatcattaaatttgggaggtgaaaataatgttagcagcttgaacagtttcattttatggaagagtaagatgaagcccaaagctaagaccaatagttttccaccgtccaatctagcctgcacaacaattgtgaataagaagagtgtttgccttttctttctttttaaggcttgttaaattaaattaaatttggcctaaagaaaccttcatacatactgcaccataagctatatgtaaacagactgaaatgtaactaagagtatgttttttaaacagccaagttttggccaatcatatcagccaataacaagtcgcaaactgctcagacatgttctaataaggcaaataccaaactataaccaatcaggctgtttctgtatgtgccttcctttttctgtctgtagatactacctaaagaagttgctgggtagacctctctgaaccttgactggttccaagtgctgcccaattcatgaatcatttttttgctcaaataaactctgctaaatttgtctcaaagtgttcttttaacattattactataaaattgaaattatatatagaagttaaaaatgtatgaaatccaaactaactagcacataattcagtctcagaggcaacatcatggaacagttaggttaactgaaatcagaattgctgagttgttagagttctgtccctcaataacttcacaactttgggtaagtcattaacttttttaaaagaaattactttaggctggacacagtgactcatgcctgtaatctcagcactttgggagggtgaggtgggcagatcacttgaggtcaggagttcgagaacagcctggccaacatgatgaaaccccatctctactaaaaatacaaaatttgctgggcgtggtggcaggtgcatgtaatcccagctgctccagaggctgaggcaggagaatcacttgaacctgggaggtggaggttgcagtgagctgaaatcacaccactgcactttagcctgggcaacagagtgagactctgtctaagaaaaaaatgtattttattgatgcataatagatatttattatttcagttacatgtgataatatagattcatactttataaagatctaatcagtgtggttgggatctcatcactttaattatatgtcctttgtgctagaaacattcaaattattctaactattttgaaaagcacaaaagaatattgtaaacttaccctactgatctgtctcacactaggtcttatttcttttgtcaactatatgtttatacacattaatcaatttctcttctttctgctacttccatacccttctgtcctctggcaactaccagtctactccctattttcatgagattgatttttttagctccgacatgtcagtgagaacacacaatatttgtctttctgtgcttggcttatttcactttaatatactgacgtccaaatccatccgtgttgctgtaaatgacaagacttcattgttgtggctgaacaatatcacattgtgtatatatactaaattttctttatccattcattcactgatgggcagttaggttgattccatattttggctcttgtgaatagtgttgcaataaacatggaagtgcagatctttttcagtatactgattttctttctcttgaatatatactccgtggaattggtggatcatatggtagttctatttttagtttcttgaggaagctccatcctgttatccataatggctgtactaatttatatttccaccaacagtgtatgagggttcccctgtctccacatcctcaccagcatccgttattgactgtcttgttgatcaaaagccattttaactggtgtgagatgatatctcattatagttttgattttcatttctctgattattattgatgagcaattttcctatccctgttaggcatgtgtatgtcttcttttgagaaaagtgtgttgagagcttatgttcatttttaaatcagatatttttttcctattgagtggtttgagctccttatgtattctggtttttaatctcttctcagatggagagcttataaatattttctcctattctatgggttatctcttcactgtgatgattgtttcctttgctgtccagaggatatttagcttgatgtaatcccatttatctgtttttgctttgattgcctatgctgttgaggtctgacacatacaattttttcctgtatcaatgtcctggagcatttcctcaatgttttcttctagtagtttcaaagtttcaggtcttaaagtctttattttgatttgatttttgtatatggtgggaatttggggcctagtttcattcttctacattcggttacacagttttcccagcaccctttattgaagagactatcctttccccatggtgttcttggagcctttgtcaaaaataggttgactgtaaaggcatggctttacatctgggttctttgttctggtccgttggtctatgtgtctttcctgtacacattgtatggtctatgcccacacaatgctgttttggtactatagctttgtcataaattttgaagtgagataatgtgatgcctctagctttgttctttttgttcaggattgttttgtctattaggggtcttttgtggttccagataagttttaagattatttttttcaatttctatgaagaattttattcttattttgataaggattgcattgaatctgtaaattgctttgaataggattgccattttaacaatattattcttccaatctatgagcatgcaatatccttccatttatttgtgtgtcctctccagtttcgttcatcagcgttttaccattttccttatgaagatctttcacatctttggttaaattgacttctaggtattttatgtttttttagctattgtaaatgtgattgcttcttgatttccttttcatattgtttgctgttggcatgtataaatgctactgatttttgtgtattgattttgtgtcttgcaactttactgaattcatttgtcagttctaacagtttttttgatggagtccaggattttctaaatttaagatcatatcatctgtgttcagggctaatttgactcttccttttaaatatggatgccctttatttctttatcttgcctaattgctctagccaggagttccagtattatgttaaagtggtgaaagtaggcatccggctgggcgcggtggttcacgcctgtaatcccagcactttggaaggctgaggtgggtggatcatgaggtcaggagatcgagaccatcctggctaacacggtgaaaccccgcctctactaaaaatacaaaaaattagccaggcgtggtagcgggcgcctgtagtcccagctacttgggaggctgaggtaggagaatggcgtgaacccgggaggtggagcttggagtgagctgagatagcaccactgcattccagcctgggcgacagagcgagactctgtcccccacaaaaaaagtaggcatccgtgtcttattttaaatcttagaggaaaggccttcaatttttcccttttcagaacagtgttagccgtggatttgtcatatatggcctttatgattttgaggaatgttccttccatacccaatttgttgagggtttttatcatgaagagatgtcgatttttttttttttttttttttttctgaggcagagtctcactctgtcgcccaggctggagtgcagtggcacgatcttggctcactgcaacctcggcctcccaggttcaagtgattctcctgtctcagcctcctgagtagctaggattacaggtgcccaccaccacgcccggctaattttttctatttttagtccaatgcctttttttgcatctattgaagtgatcacatggattttgttcttgatcgagttaatgggatgtatcgtgtttgcatatgttgaatcatacttggatccctggggcaaatcccagttgattatggtgaatggtccttttaatgtgtggttaaattcagtttactactatactgctgaggatgtttgcctctatgttcatcagtgatattatcctatgtttttctttttttgttgtatccttcttgcttttggtagcagtataatgctggccttgtagaatgagttccacagtattccctcttcctcaatttttttttgaagagtttgagtaaaattggtattacattttctttaaatgtttggtagcattcagcagtgaagccatcaggccctaggtttttctttgatgagagacgtttcattatggcttttatctcattactcgatactggtttgttgaagttttgtatttcttcatagtttaatcttactaggttgtatgtgtccaggaatttatctatttcttttaaattttccaaaaggttggtgtatagttcttcatgacagtctgtaatgattccttgtatttctgtggtttcagttgttatgttccatttttcattttttattttatttatttaggtttttctcttttttttctagtctagctaaaggtttattggatttttatcttttaaaaaaaaacttttcattttgttgatcttctttattgtttttatagtctgaattgtattttttcctgctctggtccttactatttctttttgtcaactaattttgggtttgatttgttcttgctttccttgtttcttgtggtgcatcattagtttgtttatttgaagtctctctacttttctgatgtagacatttattgtggtaaatttccctcttagagctgcttagattttggtatgttatatttccattttcatttatttcaataaattttctaattttcttcttaatttctacatttacccattgtttgttctggagcatgctgtttaatttccatgctgtgtaatttcatgaagcttctgaggttctctaattgatttctacttttattctactgtggtcagaaaagatacttcatagaatttctacattttgttttattttatttatttatttattttggagacaaggtctcactctgccacccaggctggaatacaatcatgcaattgtagttcactgttaccttgaattcctgggctcaaccaattctcttcttctgctttggcctcctaagtaactaggactacaggcacaagctatcacgcttggttgttttctacaatttgaattggttggaacctgttttgtgacttaagatattgtttattctggtgaatgttctatgtattaatgaaaagaaacaatgttattctgtagcagttggatgaaatgttctgtaaatgttagttaggcctttcagtatgtagtttatctccattatttcctttttgattttctctcttaatgatctcttcatttttaagagtggggtgataaagtcccctactattattgtattacaatctatctctcccttaagatctattaatgtttgctgaatatacttggatgttccagtgtttggtgcacagatatttataattgttatattttcttgctgacttgactcctttatcattatatagtgaccttttgtctccttttacagtctttgatacgtaggctattttatctcatataagtgtagccactcctgctttttctttggtttcccattgcatgtaatatcgttttccatctcttcactttcaggcagtatatttataggtgaagtgtttttttctgtaggcagcacatagttgggtcttggctgtttattcagccactgtatgccttttaattagagaattgagtccatttacattgaatgctgttaataagtaaaggctactgacattttgttgcttgttttctggttgtttcataactccttcttcctttcctcccttcttcccttcttcctttgtggttaagtaatttttctctggtagaatgctttaattcattgattttcatatttagtgaattattggtttttgcattgtggttatcatgagacttgcaaaaaacatagatggaagttattttaaagagaagacaacttaccttacttatatcaaaaagaataggatagaaagaaataaaaaaaaaatctacgctttaaccctattcccccactttttgacttttaatcgtctcaatttgcatatttttatattatctctctctcttaacaagttgctgtagctattactgcttttgatagatttttcttttgggttttgtgttagaggaatcagtgaattgcacaccatgcagtattacagtaatctgggtttgtctatgtgcttcattttactggtaggttttatatcttcaatttttttgttgttgttttcctttcagattatagaactccctttagcatttctttaaaaatgggtctggtggtggtcaattctctcagctcttgttcggggaagactttatctctccttcatatttgaaagataactttgctaattaaagtgttcttgaatggcagtttttttctttcaacactctgaaaatgttggtgcactctttcctttcctgtgtgatttccattgaaaaaaaaaatctgttgccaaaggaattggggatcctttataagttatttacttcttttctcttgctgcttttagaattctcactttgtccttgacctttgagaatctgattattatattccttggggtagtgttatttgggtcagatctgtttggtgttctctgaccttcctatacccgaatgtttcttttgaagttttgtgaagttatctgttattatttctttaaataagctttctacttcttgctcttgctccattcactcttgaacaccaataattcttagattttactttttcaggtaatattctatatcttgtaagtgttcttcatgcttttcattctttttttttattcttctgactgcattatcccacagcctgtcttcaagattacagattctttcccctgcttgatccattctgctgttgacagcctctaatgaattttgacattcagcaaatatatttcagtttcaatatttctgttttattttttaaaaattattctaatctctgtgtttaatttatctgataaatttctgagctccttttctgtgttaacttggagatcattgagctttcttcaagaggctattttaaattgttggtcagagagctcacattatcactatgttgttaggttccttgctttcgggaaatcatggttccctctttgctgttgttttttgtggatgtacatctatgtctttgcattgaatgatttattatttatttcagtcttctttttctggcttgtttgggtttttattggatatatttgcttaaaggttctttaccactaggctccatcgctccatcgctcaagctggagtacagtggtgcgatctctgctcactgcaagctctgcctcccgggttcacgccattctcctgcctcagcctcccgactagctgggactacaggtgccggccaccacgcctggctaatttttttttttgtatttttagtggagacggagtttcaccatgttagccaggatggtctcaatctcctgacctcgtgatctgcccgcctcggcctcccaaagtgctgggattacaggcgtgagccaccgcgcccggcccaggctcttgctttttatccaactgttgctttctcatacactgggccttcctaatcagcccatccacttgtcggaattagcaaaatgaaaacagctggagctcacgcctcaggatccctcttcagaaatttatttataactgtgctttaatttgtggcagtatgtttctttccccaaatgtttattttgagaatattcaaacatacagaaaaattgaagcagagtataatgaatgcctcatgctcatcaccggagaacattttagaaatgctattttgcattgctctttatatttttcattctctgtttcaagtagatagccaggctatttgtatttttacagcaggataaaagaaaaagcctgctgtgctttaaaactgtgcagcccaataaggtagccactggtcacatgaggctgtttaaatttacattaaaattagatgtaattaaaaactgatttgttgcactacccacattttaaatgctcagtgggcacatgtggctagtggttactgaattggacaatataggtatatagcatttttatcctcttaggaagttctactggacaccactttaaaagacatttaggtcttttataaaagactaaatttgttaaagaaataaatctgcgtttcttggagggcaggaagagatagaggagtacctctgaagcaagagagggaggagcagtttccacaactgggaaaaggataaaagccgataggtcctgtaatttttagggatccagctgctcgtctgtagcagtgcacccagagaagacaaaatctcagataaatggttgtgtggtatgcccaggagagctgaatctaggacacaaacctcaagggtccactttaatttggcagtagggagtccactagaggctctaatagaaggaaaggtcaagaaatttatcccattttctgagcactgagtgatatggcttggctgtgtccccacccaaatctcaacttgaattgtatctcccagaattcccctgtgttgtgagagggacccagggtgagataattgaatcatggaggccagtctttcccatgctgttctcgtgatagtgaataagtctcagaggatttgatggattcatctgggatttctttttttttttctttttttttttttgagatggagtctcactctgtcgcccaggctggagtgcagtggcgtgatctgggctcactgcaagctccgcctccggggttcatgccattctcctgcctcagcctccagagcagctgggactataggcgtctgccaccatgcctggctgatttttctgtagttttaaagaaagagagggggtctcaccgtgttagccaggatggtctcgatctcctgaccttgtgatccgcccacctcagcctcccaaagtgctgggactacaggcgtgagcatcagggatttctgcttctgcttcttcctcatttttctcttgctgccaccatgtaagaagtacctttcacctcctgccatgattctgaggcctccccagccatgtggaactgtaagtccaattaaatctctttttgttcccagttttgggtatgtctttatcagcagtgtgaaaatggactaatacagtaaattggtactaatagagtgaggtgcagctgaaaagatacccaaaaatgtggaagtgactttgcaactgggtaacaggcagaggttggaacagtttggaaggctcagaagaagacaggaaaatgtggggaagtttggaactccctagagacttgttgaatggcattgaccaaaaaccagatggcaacatggacaataaggtccaggggtggtctcagatggagatgagaaacttcttgggaactgaagcaaagatgactcttgttatgtttcagcaaagagattggtggcattttgcccctgccctagagatttgcggaactttgaacttgagagagatgatttagggtatctggcagaagaaacttctaatcagcaaagcattcaaaagttgacttcagtgctgttaaaagcatttcattttaaaagggaaacagagcataaaagttgcagcctgacgaatgcagtagaaaagaaaaacccattttctgagaagaaattcaagccagctgtagaaatttgcttaagtagccaggagcctaatgttaatccccaagaccacggggaaaatgtctccaggccatagcagagaccttcacagcagcccctctcatcagaggcctggaggtccaggaggaaaaagtggttttgtgggccgggcccagggtccccatatgtgtgcagcctagggacttggagccctgtgtcccaaccattccagccatggctgaaaggggtcaatgtagagctcaggctatggctacagcggttagaagccccaatccttggcagcttccatgtggtgttgagtctgcagctacacagaagtcaagaattgaggtttgggaacctctgcttagatttcagaagatgcatggaaatacctggatacccaggcaaaagtttgctgcaggggcagggctctcatggagaacctctgccagagcaatgcagaagggaaatgtggggttgtaggccccacacagagtccctactggggcactgcctagtgaaggtgtgagaagagagccaccatcatccagaccctggaatgttagatccaccaacagcttgcaccatgaacctggaaaagccacagacactcaacaccagcccgtgacagcagccgggagggaggctgtaccctgcaaagccacagggacagagctacccaaggccatgggaacccacctcttgaatcagcgtgacctggatatgagacctggagtcaaaggagatcattttggagctttaaaatttgactgccctgttggatttcggccgtgcttgggccctgtaacccccttcttttggccagtctctctcatttggaatggctgtatttacccaatacctgtactcccattgtatctaggaagtaactaacttgcttttgattttacaggctcataggtggaagggatttgccttgtctcagatgagactttggattgtggacttttgagttaatgctgaaatgagttaagactttgggggactgttgggaaggcataattggttttgaaatgtgaggacatgagatttgatgggccaggggtagaaagatatggtttggctgtgtccccacccaaatatgaacttgaattttatctgcagaattctgtcatgttttgggagggacccagggggaggtaattgaatcaagggggccagtgtttcctgtgctattctcgtgatagtgaataaatctcacgagatctgatgggtttatcagggggctttgcttttgcttcttcctcatttttatctttctgccaccatgtaagaagtgcctttcacctcccaccgtgattctaaggcctcctcagccatgtggaactgtaagtccaatcaaacctctttttgttcccagtttcaggtatttctttatcagcagtgtgaaagtgaactaatacaccaagtaagcctgtggatatggttgatttctagagagaaagatatgatactgagtaagaattagtttctaggcagtctagtgtccgtttgggatttcatcatgaataaagagaagaaatttggcaactgagtttcaagctcacttaaaaacataataaaagttatctttggaaattattttcaacacagtgtacaaacatatttacataaaaagataatgtacatatttgtggccactgggggacattgttccctcatacaaaagacaaagaagattttgaagcagtggttctcaaacatgagcatacatcagaatgacttggaggacatttcatctagactcttagcatttttcaagactatgatttactgttaactacagttaacttgttgtagaacaaattgttctcacgacaaaaatgaaaagtatgtgaggtaatgcatatgttaattactagatctattaattccacaatgtatatacacttgaaaacaatatgtcgtacatggtaaatacacataattttatatgtcaagttaaaaattaaataaaataataaagataatgaacatttaaaaaaatcacttgaaagacttgttaaaacacagactgctggacccctacctgtagaggttctaattcagtggagatgctgggaaggagacaaaaatataaatttttaacaagttcccatgtgatgctgttgctgttggtctggggaccacactttgaaagccactgctttagtaaaacttttaaaatatagtattaagactatttattgatcaaacttacttcaccatgagaatattataatgaacacaaagaacagtctggatgtactgataggtggcttttatctggcataagaagaatgtgtgcaattattctatttttagatggcaatagtgctatagagcattatacaaggttatagtttctatatagttaaagagaaggtgtacagtggatggggcacagcaatgatgtgcaagatcaaaaaacagaaccgcttctgagactaaattagcttaggtttagacagagcctagtccccaaaatattggtataggaaaacctctcaaggtgtgtacctgggagacttcctgttccaaaatgtttgtgtagacacaggtttccttcactcttcattccccccaccccacaaaaccaaaagaaatatacagccctgagatttcaccagtgacttccagaaattcaaatgtgaggataaatcagttcctgaggacatagagaagtaaaaaaattctgagcagatggtaagagaatcaaattttcatatccgaaatgccccttcctaatatctgccctgcaccaatttgcagaaaatgtcccttgattcacagtttctgcactggataaggtgagatcaagatgaacaaccagctttcctaccatcttgggttccctggcaggagacctattcatgcctcaatccacagcaagtattgtgagtgtctggaaggagagaacagccagagacaaggagagaaggtggaactaccattcttagtgcttgaaactctactctgtacttaggccaaaggagatgctttggaggtacatgtggctgctcaccagcaccatgctgtaggaggtacatgtcacaggtcccctgagcacaaatccccagccagcctttttatacgaccaggatatcccctttcaaatctcccactgcagatgggcagtgctctgattgtttgctagtgcaaaggcaaacctgagtttaaggtgccatctagtcctgaaaggaggaagtgaccaagtgagaaaaaagtataagatattgaacaggtaatttaagaagaatctctaagttaacatcccatccccaattaaaaccaaaacaagccagacagagaagactaaagtaatcctttaatgcaaagacgtaaatatacatccacaagaaacaacaggaaacaggaaaccatgaacaacacaaatggacaatgtaaagaaccagtgattgaccctaatgagatgacagtacatcaaatacctgaccaagacctcaaaataatagttttaaggaaactcactggtatctaagataacacagaaagggaactcagaaatttatcagagaaattaaacatggaggttgaaataaaaaaaaagccagcagaaatcttggaactgagaaatatatctgctgagctcaaaaatttactgcaggctctcaacagctgaatggattaaacagaggaaagaatcagtgaactaaaagacaggctatatgaaatcacgaggaaaaaaaaatgaaaagcaagatagagaatattacacagggtagctggcatgatggccgaataggaacagctccagtctgcagctcctggcgagaccaacacagaaggcggatgatttctacatttccaaccgaggtacccagttcatctcactgggactggttagacagtggggtgcagcccacggagggagagcagaagcagggtgggacatcgcctcacctgggaagggcaaggggccggggaactccttccagtagccaaggaagccctgagggactgtactatccagcccagatactatgcttttccattggtttttgcaacccagagaccaggatattcccttgtgtgcctacaccaccagggcccggggtttcaagcacaaaactgggcggatgtttgggcagacactgagctagccgcaggagtttttttttcataccccagtggcacctggaactccagcgtgatagggctgttcactcccctggaaagggggctgaagctagggagccaagtggtctcactcagtgggtcccactcccatggagcccagctctcactgccagcacagcagtctgtagttgacctgggatgatagagcttggtggtggcaggggcatctgtcattactgaggcttatgtaggcagttttcccctcacagtgttaaagaagccactgggaagttcgcactgcgggaagttcagactgtatgaaactcactacagcacagcaaagtgcctggggccaaactgcctgtctagattcctcctcattgggcagggcatctctgaaagaaaggcagcagcctcagtcaggagcttatagataaaactcctatctccctgggacaaggcacctaggggaaggaatggctgtaggcacagcttcagcaggcttacacattcctgcctgctggctctgaagagaacagcagatctcccagcacagtactcaagctctgctaagggacagactgcctcctcaagtgggtccctgacccctgtggctcctgactgggagagacctcccaggaggggttgacagacacttcatacaggataggtcctgctggcatcaggcaggtgccactctgggatgaagcttccagaggaaggagcaggcagcaatctttgctgttctgcagcctctactggtgatacccaggcaaacagggtctggagtggacctccagcaaactccagcagacctgtagaagacgggcctgactgttaaaaggaaaactaacaatcagaaagcagtaacatcaacatcaaaaaaaaaaaaaaaaaaaaaaaaaggatcagcaccaaagatcaaaggtagataaatccactagatgaggaaaaaccagccccaaaatgctggaaattcccaaaaccagaacacctcttctcctccaaatgatcgcaactcctctccagtgagggcacaaaactggatggagaatgaatttgacaagttgacagaagtaggcttcagaaggtgggtaataagaaactactcggagctaaaggagcatgttctaacccaatgcaaggaagctgagaaccgtgataaaaggttacaggaactgctaactagaataaccggtttagagaagaacataaatgacctgatggagttgaaaaacagcatgagaacttcgtgaagcatacagtatcaatagccaaagtgatcaagtggaagaaaagatatcagagatggaagatcaactttatgaaataaagcgtgaagacaagattagagaaaaaacaatggaaagaagtgaacaaagcctccaaggaatatgggactatgtgaaaagaccaaacctacgactgattagtgtacctgaaagtgacagggagaatggaaccaacttggaaaacacacttcaagatatcgtccaggagaacgtccccaacctaacaagacaggccaacattcaaattcaggaaatacacagaacaccactaagatactcctcaagaagagaaaccccaagatacataattgtcagattctccaaggttgaaatgaaggaaataacgttaagggcagctagaaaaaaaggtcaggttacttccaaagggaagcccatcagagtaacagcgaatctctctgcagaaaccctacaagccagaagagagtgggggccaatattcaacattcttaaaagaattttcaacccagaatttcatatccagccaaactaagcttcataagtgaaggagaagtaaaatcacttacagacaagcaaatgctgagagattttgtcaccaccaggcctgccatacaagagctcctgaaagaagcactaaatatggaaagggaaaaccggtaccagccactggaaaaacataccaaaatataaagaccaacgacactatgaagaaactgcacgaacaaatatgcaaaataaacagatagcatcatgatgacaggattaaatttacacataacaatattaaccttaaatgtaaatgggctaaatggcccaattaaaggacacagataggcaatttggttagagtcaaggcccatctgtcttgacccatctcacgtgcatcaggagacccatctcacttgcaaagacacacataggctcaaaataaagggatggaggaatatttaccaagcaaatggaaagaaaaaaaaaaagcaggggttgcattcctagactctgataaaacagactttaaaccaacgaagatcaaaaaagacaagagcattacataatggtaaagagatcaatgcaacaagaagagctaactatcctaaatgtatattcacccaatacaggagcacccagattcataaaacaagttcttagagatctacaaagagacttagacccccaaacaataatagcgagagactttaacagcccactatcaatattagacagatcaacgagacaggaaattaacaactatattcaggacttgagctcatatctggaccaagtggacctaatagacatctacagaactttccaccccaaatcaatggattatacattcttcccagcacatggcacttattctaaaatagaccacatagttggaggtaaaacactctcagcaaatgcaaaaaatggaaatcataacaaagtgtttctcagactgcattgcaatcaaattagacatcaggattaagaaactcactcaaaacagcacaactacatggaaacggaacagcctactcctggatgactactgggtaaataacaaaattaaagcagaaataaataaattctttgaaaccactgaaaacaaagacaatgtaccagaatctctgggacacagctaaaacagtgttaagagtgaaatttatagcacattaaatatataaatatagatatacataatataatatatataaatataaatatagcactaaatttatagcacatcagaaagtggaaaagatctaaaatcaacaccctaacatcacaattaaaagaactagagaagcaagaccaaacaaattaaaaagctagcagaagacaagaaataactaagatcagagcaaaactgaaggagacagagacacaaaaaacccttcaaaaagcatcagtgaatccaggaggtagtttttttgaaaagattaacaaagtaggccactagccagactaataaagaagaaaagagagaagaatcaaatagtcacaataaaaattgataaaggggatatcaccactgatcccacagaaatacagactaccatcagagaatactaaaaacacctctatgcaaataaactagaaaatctagaagaaatggataagttcctagacacatacaccctcccaagactaaacctggaagatgttgaatgaatccctgaatagaccaataacaaattctgaaattcaggcataaattaatagcctaccaaccaaaaaaaaaaaaaaaaaaaaaagccaaggaccagattgattcccagtcaaattctaccagaggtactaagagaagctggtaccattccttatgaaagtattccaaacaatagaaaaagaaggactcctccctaattcattttatgaggccagcatcatcctgataccaacctggcagagacacaacaaaaaaagaaaatttcagggaatatcccttatgaacatcagtgtgaaaatccttgataaaatactggcaaaccgaatccagcagcacatcaaaaagcttatctgccacgatcaagttggcttcatccctgggatacaaggctggttcaacatacacaaatcaataaacgtaatccatcatgtaaacagaaccaatgacaaaaaccacatgattatctcaatagatgcagaaaaggcctttgataaaattcaacacctcttcatgctaaaaacaataaactagctattgatggaacatatctcaaaataataagagctatttatgaaaaaacttcatagccaatatcatactgaatgggcaaaagctgaaaacattccctttgaaaaccagcacaagacaaggatgccctatcttaccacccctattcaccatagtattgaatttctggccacggcaatcaggcaagagaaagaaataaagggtattcaaataggaagagaggaagtcaaattgtctctgtttgcagatgacatgattacatatttagaaaaccccatcttctcagcccaaggactccttaagctgataaacaacttcagcaaagtttcgggatacaaaatcaatgtgcaaaagtcacaagcattcctatacaccaataatagacaagacagagagccaaatcatgagtgaactcccattcacaattgctacaaagaaaataaaatacctaggaatacaaattacaagggacgtgaaaaacctcttcaaggagaactacaaaccactgctcaaggaaataagagagggctcaaaaaaactggaaaaacattctatactgatggataggaagaatcaatatcatgaaatggccatactgcccaaagtgatttatagattcaatgctattcccatcaagctaccattgactttcttcatagaactagaaaaaactactttaaatttcacatggaaccaaaaaagagcccatatagccaagacaatcctaagcaaaaagaacaaagctggaggcatcatgctacctgacttcaaactatactacaaggctacagtaaccaaaacagcatggtactggaaaccaaaacagaaatatagaccaatggaacagaacagagccctcagaaacaccacacatctacagccatctaatctttgacaaacctgacagaaaccagcaatggggaaaggattccctatttaatcaatgatgctgggaaaactggctagccatatgcggaaaactgaaactggatcccttccttacaacttgtacaaaaattaactagagatggattagagatttcaacataaatcctaaaaccataaaaaccctagaagaaaacctaggcaataccattcaggacataggcatggacaaagacttcatgactaaaacaccaaaagcaatggcaacaaaagccaaaattgacaaatagtatctaattaaactaaagagcttctgcacagtaaaagaaactgtcattatagtgaaaaagcaacctacagaatgggagaaaattcaatctatacatcttacaaaggtctaatatccagaatctactaagaacttaagcaaatttacaagaaaaaaacaaccccatgaaaaggtgggtgaagtatatgaacagacacttcttgaaagaagacatttatatggccaacaaacatagaagctcatcatcactggtcattagagaagtgcaaatcaaaaccacaatgagataccatctcacaccagttagaatggcagtcattaaaaagtcaggaaacaacagatgctggagaggatgtggagaaataggaatgcttttacactgttggtgggagagtaaattggttcaaccattgtggaagacagtgtggtgattcctcaaggatctagaaccagaaataccatttgacccagaaatcccattactgggtatatacccaaatgattataaatggttctactataaagacacatgcacacgtatgtttattgcagcactattcacaatagcaaagacttggaaccaacccaaatgtccatcaatgatagactggataaagaaaatatggcacataaactccatggaatactatatagccataaaaaaagaatgagttcatgtcctttgcagggacatggatgaagctggaaaccatcattctcagcaaattaacacaggaacagaagaccaaccaccacatgttctcactgataagtgggagttgaacaatgagaactcccacttatcagggaggggaacctcacacaccggggcctgttggggggttggggacaaggggagggagagcattaggacaaatacctaaggcatgtggggcttaaaacctagatgatgggttgatgggtgcagcaaaccaccatggcccatgcctgttagaatggcttttataaaaaagatagggaataatagatgctggtgagatgtggagaaagaaccttttataccattggtgggaatgtaaatcagtatagccattatggaaaacaggatggaagttcttgaagaaactacaagtggaactaccatatgattcattgataccaccattgagtatatatccaaaagaaaggaaataaatgtatcaaaaaatatctgcaaccctgtttatttcagcactattcacaatagccaaaatatggaatcaacctaagtctctatcaacagatgaatggataaagaaaatggatctggagatcatcatactaagtgaaatgagcaaagagcagaaagaaatattgcatgttcttactcatatgtgggagctgaaaaagtgggtctcatggggtagagagtagattggtggttaccagatgctagaagggtagagggaagtagggaatgaagagaggttgattcatgagtacatatgtacaattagatagaagaaataagacctgatgttcaatagatcagtaggttgactatagttaacattaatagaatgcatatttcaaaacagctaaaaagaaataatttgaatgccctagaataaagaaaggtaaacatttaagatgaaggatatctcagttaccctgatttggttatatgagtgtagcaaatttttacatgtatgactaaaataggtacagctattatgtataaagaaaaaagatgtgtacttgaatatggcaggccttaaaattcagtaatttatttccaaattgttattcagacagtatcaaggagtctatatttgtcaggataatctagagttagatcctattttagagtttaattagaggctgaaacgtgagcttcctgatgacatacgcacagccttgaagggcagagtagaggaaaatcacctttcgcaggttcctatcatcttccacaaattcctaagaattggatgctcttctataatattggtatcctttttcctctcatagttataataccaaaatcactgcatagacggaagttataccttgtcaggagaaaccctttgtatattgtcttaaaagtctataaaattaatgtgaggtttacttgattcactatgttagttatgataattgttttatgccactagaaatcgtttttactctctgaaaaataatgtttcaaaacgaaaatggaccttgaaagattttatctttcaaattcttcattttgtaaatgagaactcactgttcaacaaagttaaataattagctcaaggtcttagcaattttattagactaacagtatttctggttttctgaaagagtgattgagaaacagtagcttaggaagtttgaaaaattaagtaaatgtttttgatccagttttacatatacttacaactcatgaaaaaatatgaactaagttttagtagtgtttatctttgggcttctcatttcctactatgtaaatttcatagtcttgttttgttacaacaatcaagactaatttctatttcagaaatatcttttgcaatctctttgaatgttttaaaataaaacctctactgcttaataagattaacttcttttaactataattgttcacagataattaatgttttttatttattaattcaaatgataagaaagaattgagtaacatcaaatgtgctaatagtgtttgccatatgctataggctgaatgtttattgctaatagcatttgccatattctatagactgaatgtttatatctcccccgaattcatatattgaaatcctaacctcccatatgatggtatctgagggtggatcttagggaggtgattaggtatgatagcagagccctcatgactaagattagtgtccctataaaagtgcccaaacatctccctcactccttctgtcatgtgcggactcagtaagaagaccattgtctacaaacaaggaaataggccttctcgagacatcaaatctcctgtggccttgatcatgtacttccagcctccagaactttgagaaataaatttctgttgtttttaagccacccagtctatggtatttgtcgtagcaatctgaatgaactaaggcagaaattgataccaaaaagtgggagtgctgttataataaatacctaaaaatgtggaagcagtgttggaactgggtaatgggtgaaggaggctggaagagttttaaggtgcatgctataaaaaagtctacattactgtgaaaagggaatgtcataaaattctaagacaaacctgactagtttcatactaaatttaatactattaatgcctaatgaattttattctagcaaatcataacatataataaatagaagaagctctgctgtaataatgtcattcctcattctcttctctgagagaaatattcctagatactttaaccattccccataaatcctattatccaccttcttacatatttatacattcacaatcttatggttactacattttgctctagcatttcacctgtctcaggttatcgatcagtataactcaatagacgtttcccttaggtagggcaaatggctgcacttatgactaagtctgatcaaaggcacaatttgtttgcctttagaaatttttgttttccatgactgcaagaaatactgctgaacaagacatttcttcatcatccttgatgaaagatgaacattaataatgcagatagaaatcaggccaagtaatgttgaagagaaaacaaggtccagtagcactacttccttttagaagataagaataaacagatttaaaatggcaagctcaataattttaccctaacaaaaaatgaggtgagtactatataacccttaaattctgaagagtttaaaatcaatttatgtactcgtatcttgaaaatatttgtgtataaacatatctatacttatctacatctatgactatttctttacaggtatggtatgcactcttatgcatgtaacatatgctcttttaaatatgagtcatatgtatccaatattactgtaatataccaaggtcaactttcatttgtaagttttgtgatatcttattcttttatgtatcttctatataatggaagccctctgatattctgtataagtaaagaaaaaagattttagaggcataaaaacttaaaaaaaaactaaagcaatactaacatttaattcaattgctcatttactaaatacttactcatcattttgtgtatgccaagcactatagaagttcatttctgcctatcaggcagatggtatatgttttcttgtggcagcgtagaagtaagggtgataaaagggggaaacctacattcccacatatacataatggtggattagtaaccttctgtcctgatgtgcctgtaagagtcctggattgtgcctgttttagcacaattattaatattgtcctctttcactctcagaagtgtttgggtttgagtatctgggtacatgtccaaaccctgacacttttgaatgaatcccacagagattcataggagaaaaaattcttttccagtaataagaaacaaagaagctgtctccgaatcctgaagaatgggcttgctttcactgggtagaaagaaagaagatattcaaggcttatgtctcatcattgcttgtgttttcccagtagcttcctaaactttgtccctgatttctgtttcttttgtttttttgttatcagcagttgcttttatttattttatttatttattatttccattgctttagtggtacaaggtttttttgttgttgttgcatgagtgaactgtataatggtgaagtctgagcttttaatgtagtgatgtagtgatgaatagtgtacattgtacccaataggtgattttttattcctcatctccctctccccctccctacttctgaatctccagtgtccattatagcactctttatggctttgcatacccatggcttagctcccacttgtaagggagaacatgtggtatttggttttctattcctgagttacttcacttaggataatgaccagttctatcctagttgctgcaaacatgtttcattcatttttatggctgagtagtattctgccataaataactactgttcagtcttcaagcttgtcccgcctaactttattgttcttgttgttctgttttgttttgttttagactttagcagcctgaagccatgacttttagtttctgtccctagtgataagcagaaaagggagatgagcaaggggctttactgacccaaacagaaatagaaactaagaacccatgactgtattgtctaccttggacacccctgattttctttatccactcttcagttgatggacacttatgtagattccatatctttgcaattgtgaactgggctgtgataaacctacaaatacaggtgtctttttgatataataacttattttcctttaagtagatacccagtagggggattgctagatagaatgttagatctcttttagttctttgagaaatctccatactgttttccaaagaggaaacataaatggtacataaatagtacataaattgtgctaatttactttcccaccaacagtgtataagcctttccttttcactgtacctcaccaacatttattgcttttttaccaatgtcatttttcctagaattagacaaaacaattataaaattcacattgaatgtttcctttgtcttgaagtcaaaatctactctcaccgacttttgcttcttttacaatttctaaatgggtcttcatcaccaaggcccccaccctgcatttaaagccctttatcatctgagtcctgcttgtctctcagtcactgtcattgctcctttttcacattagcaacagtgaactcttaaaaatgctctgaactgtccttgtgtttctcattttcatatgtgtctttaattgtcatcattaaaacaaagacttatgtagtaattatatgcctggaactgttgatctgaaagctttacttccgttaactcatttagtcctcataagaattattattaccatttttacagatgatgaaattgaggcaatgagaggccaagaaacttttgtaatatcagtatagctgatatttggatccaggcaatctgactctagagcctgtggttttggccattggtctgatatttttgctgtcctggctgccctaccccgcttattcttcaaaacccagatcagaagttatcccattataggctcggcgtggtggcttatgcctgtaatcccagcactttggggggccaaggcgggtggattacttgaggtcaggagttcgaggccagcccggccaacatggtgaaaccccgtctccaccaaaaacacaaaaattggccaggtgtggtggtgggtgcctgtaatcccagctacttgggagactgaggcaggagaatcgcttgaacccggggagtggaagctgcagtgacccgagattgcgccactgcactccagcctgggtgacagagggaaactctgtttcaaagaaaaaaaaaaaaaagttttcctattatataacctttccctgtatcctcacatagcattactcatttgttcttcaatatatcctgtaattgtacttatttcttttgccgaattagaaagataacttgaacaataacagatatggggaaagctggttgacttctggctagttttgttgatggctgatagggatagactataaagggactagttttggacatattaagttgaaggtgatagctgaatatgcaagtacaaaagtccaacagacgtgtggagatgcagcaccaactcagcaaaaaggctgctgctgcactacaaatctaaaaggagagaaaatattgatagagagtaaaggcaaagaatcaaagatacaggccaggcgcggtgacttaacgcctgtaatcccagtactttgggaggcggggcgggtggatcacgaggtcaggagatcgagaccatcctggccaaaatggtgaaaccccgtttctattaaaaaatacaaaaaattagctgggtgtggtggcgtgaacctgtagtcccagctactcaggaggctgaggcaggggaatcgcttgaaccagggaggtggaggtcgcagtgagaggaggttgtgccactgcctggcgacagagtgagactacatctcaacaacaacaacaacacaaaaaagaagaaagaaagaaagaaaagaaaaagaatcaaagatacactaagaggcctagggtactctagttttatggaagacacagtaagatgcaatttaaagagggaggaggtgatgatcatcatcatcactgaattctaaaaatctgccagatacgatgaagcctgaataaagatcaaatttagctaatttagagtggtaaaagtaggagccaggtttgagaccatgaaggagagagagaaggtgctctggaagaataagattcagcattgggctggtatttgaatttgtttgagtcacaatttatttcaaacagcttgaagaagaaaaataagacttgtatctcaatggtttccaacaaaatatacacatgcataatggcaagtttaattaacacaggggtagtcagttcataacaacttaggggaaaaattaaactttctataacaatacttttttcatgatgaatttatccttaaatttttttttttacaaatttattttagggactttctggtctccatattctcataaataaaagttgcattccatgaggagaaaacaaaaaaacccatcacagtgaacaattgaattgctccgtggacatcatgcctttctaagcaagcattgaatataggagatgtatttatgataaccagagacagagtatgtatagcttggctccataggggtggtgttctcggttcctatgtctaccttttgtattttccagcccttccctcataatgttactgggaaagttaacagctagcataacattttgaaaacccaaagtgtttatatcaacaagattattcacagtcaaattttcccataaatatcactgggacctatatttcttttaattttaaccaagagtgaaggtagtgagtatagagccctggctttagaaactaacctttaaaaataatgagataatgacacagtgaataaagatgcatcagggttgagcaaagttattttttaagattagaaaaactgattttgaaaatgcaaaggcagacaaaaaggatcagtcaagagggaaagaataaagatagaagagaagtagaacaagtcatggagcaaggtatctgagaatgtagaaatgaatgggaaaaattgatctctgaaaagatataaaagtatggattgaaggaaggaaggaaggagagggagagaggaaggaagggagagagggaggaagggagaaagggaaaggtaggagggggaggtaaagtaagaaaaaggaaggaaaaaggaagagaatggaaggaaagaaaaaggaaggaaaaaggaagagaatggaaggaaagaaaaaggaagggaagggaaggaaaagggaagggaaaagggacttagatatttttcactggataggaaagaaattgaggaagtttataatgatgtcctcttgcttgttgctgaggtgaggggctgagttatctgcaaatatgaggagtgttctaacggaatgataaaggactcaagcagttgagtaaaatcaattgatattgcaaattatccacttgtgattttaagaatttcttggtgatgcaattttcccatctatacttgattgtctagagtattttcctcctctagtgcctttgctgccacactgattaaatcaatattgattgacaacctcagtgggatatttccatgtgccaggaagaatagtactatcagcagtacccaattcatggtggtttagaaacacatttattttcttatataataagaaattccagtgcacacatgaagaatatgcaattaccagacatatttgctgtctttagtgcgacaagtttatatagttcgagtgtctgggctttgtgatacagatatacaaacatacaaacttatgcagtagagttgtctgtcccaatggttactagacttttggatttcatgcaccagtaaaatacaaatgggaggaccgacaccaggttgccaattttccacttggctaaataaaatattaaaaccaatgacccattatcacgtattctcaccatcatttccaaagaacatttaaacattaaatggtattagtctttagaaaataatctaaaagatacaatttcaggataaaggtctttaacttggatatgttcagctttataaatatttatggcattattcttaattttctggcttaactatagacatatgaaaaccttgtcataagggtgctgctctgtggagctgtgtttggaattactatttatacccacagtgtctggtccccagcttaaacagcaaagtgccaccttctgttatccaaatcagatctgtttagcatcaaatactggggtcttaaccactatgccgcagatcttttctaaaatattcttattttaattaaacagtgattattatgaagaacaaggaatgtaatcatttctgtgacttttcaggaagattactgctaggaaatgagaatagtagttaaaaaaccagtatatattgaattaattaccaacagtagatctaattttgaaggtagaaattataaagtccagggcatacaaaatatgatagtgtgaacacgcagacataggcacttcagtaacacacagcaaaaaaaaaaaaaaaatcctcccctttctaaagacacacacacatctatacttttatctatgtctgtttacatacatacatatatatataaatgtaactcatttttctttgaactgattcaagaatgagctgcagacattgttgcattcacccctaaatactttagcatgcattttcagagaataagaacattttctattttcatggaacaggcacactagtcttaacaaaattaggaaaattaacactattataatactaataactaataaacagtccatattcaaatttattcaactttcccaataatattatttatctgttattttttaatttgatattccatccagaattgtgtttagttgtcatagttctttgacctcatggaattctttagcctttctttgtctttcatgacattgacatttttaaggagttcagtccacttattttatagagtgtcctcaatttgattttccttgtagttagattctggttttaaaattttgactgtgtaccaagaagtaatgtggccctttcagtatatcttatcaggaggcacatagtatcagttggtctcataattgatgatatctttgaaggtattgtctgctgtatttctccaaagtatactttcttctgtttaaattttctacttaatagagaagagatactttaagatgctataaataccctattcctcatcaaactttcacccatgagttttaatactcattgatgattcttgtatgaatcaattgtcattagggtgattgccaaatagtgatttttctaactccgttatttcttctacaattgttaattaacattcaactgcaagaaacagatttgtacttttccttatttacttacatcagtatgtatttgctgattcttattcaatgaattataatcttttactatcatttattttgatgctcaacttgccccagatttggccagtgggaagccccttctagttggttcctgtgtcttactgacatgacctcatcattctttgaagaataattactttttagcacagaaaatatcatgccaaatatttcaaaatgaatatggagatttatatgattatgttttaccagttcttctctttgtatttggaaaggtaacagtgagtaatggcgtggatgggtagtataaaaagtctgcagggtttatcctataattctgacctaccttagttggaaatgggaatttttttcagctactaatatatcagaattaattgttgtgttgctttaggattgtgatgttatgaagaggcaaagtcagtccattgtacaaggatgggaaaagccttttaattactgtcccttttctggttgaggctatattccctcttctggcttcacctgatgacaagggaaggcttctcgttcctcagaaatttagatagattaatttagactgttaattttactatctggaccacccgagtaacctttccatgatatctgtgaattctgcactggacttcactgtggttcccccagttactgtttttctttatctgcaaaagttagcaagattaagaccccaagctgaagcaaggcacatctttgcttcctgctgactttcatgagctgttgaatcaccttgtgtcagccaggcaggagacagatggcatgctgaaatgaggcatatagaagaatttcatgaaggggacatttacaaaagtgtcagcaatgttaggagaaagctacaaggaatacaaaagcactctcaatgcagcagcagacctgaaggagcaaggggaggagtgattacctgaccccagagaaagtagcttcagttgtatgaggggcagtctgattggagtatgacttttcggggaggaatgagtccagtgccaacccagcaaagaaggaattggagaagaaatattcctatgtcaatcttctctctctggtgctttcccactggtgcttctcattggccaaaccaattgggagctcaaaggtaggagagcccatttttgcaatgtgtagaagtcacccttctgggacacacagaatgatgcagaagcagagagagtggctctggaggagcaaacacagtatcctacacacatggcaattctaaatttttaaatgatgatttaagggtttcttttcatagctcaaggggtcatccaccatcactctggcttccatacttctcttcctcctagaatcactagctatcctctgacaccagttcttcctcctaacagagaacacacctgctgcttgtaattctgggaggtcattaccccctacctccagtgacatatctaccctaggttttgttgtcaacgtgggtatgcctctgtgtgtgtgtgtgtgtgtgtgtgtgtgtgtgtgtgtgtgcgcgcgcgctccccttctcccccaatttgtaatgtaaaaaatctccatatcattagaatattctgttaacaaaaagtgactgggcaaacaataaaataaaaaatgtaatctttattagttttgcacattttaaatgttggttagcattatttagcataatagtagcattttccagcatgcagttcacgaatacagtttatctaagtagttttaaggaaaagaggagcctatggtttgcttctgtaagaaacacaaaatgtcctgatgtaattgactatataagttgactactctgtttttgtggaaaaaaaaattatgaagcccacattctatttagaacaatctagagcagcattactccaaagaaatgaaaacataaaccgaagtcagaaaaaaagaacaaaaataacataagcactaccttcaattcagttagtgcaggtactaccagaaatataaataaaattttaaacccttttccaattgcaaagcataatttggatatgaatcgtgaacctattttgctccttaaaattgtgaaataatctaaaattagcaaatgtaatttaaaaagcagaaatctacaactacccagtcttgttttcatgtcttatttagcaaatttctttcatgaaaaagtactatggacagaaagtaagaaaagtgattgtgatatcaacctgaagataatttcctcttcatatttatgtacataatgctgaaaaataaaataaagtgactttttacagtatttatatttgcttataaaattctaaacacatatttaataggttaagcagtgtgtttttttaaacatgtctgtacagtctggctatataccatatgttatccacttaaaatgtaaaaataaccaaaaagctgttaaagtgctgcaaactattgcttaatgacttaaataaatgagatctgttgaacaatttccttgactttaccactgacatatggtttctcataaatgagattctgagcagtgagagaaaccagatacagcagcatggtaatataaacatgcattgatagcatccaaactatctataaatggtacagaatacattttattacctgtgtaaagcttgcactctacatttcttgtggtacatatttgatgcaataaatactgtgcttaggtcattatttgtttgctcaaacgtgcaccacagggtaaaatgactatttacataataaatagcatttcattaacatatacagtgtcaaccttgctgagagccgaagatggctaaacaaagtgcaggaaaaagcagaaatttataaagagtaattttggtcaattcagtcttctggcggtggagggtgaggggcaatattcactattcaggttttttttttaatacaacaaaaagaaacataacatttatgactccaaacatttgaatgaagtttgcacctgctaagatttactggcctacccacaaataatctacttggtctaggggctggatttcgcaaaacaagatcaacaaagcacctccacttatcacccaattacccctcccagaaatatggtgaaatttaagaatttgtttttcttgtgactttttctcatgcatgatctctaagtgcagcatgccctcatgcaaaccacgactttgtgtagctgggagggccatgtggttgccataccccccaggtggcatacctgttatagaggtccttagcctatttctcaacagaaacttcgtttacaaaaatagtcacatataataaacacatggattaacaaaaagatgaatccactaacagattccataaaaatgtgacaaatgtggcagttgaaatgcaaacagtggatacaattactacactaaagtgtttcatgttaaacaaccccaaaatcacaggtttgcaccccttgaaactggtccctacagtctgactagccattgtgcatcttatcttcagcagtgtcagctggtagtgagaacagtaacctcctgtcaaggtcatctcccctttacacagagtcacagtttgctgacaaggggtcactgtcttattgtaggcactgaccttaaggagatttgtgtaaaaacagtcagtttggcattgacctcctaaaggagtcctgttgataaaaatacatcaccttcacaggctgtaaacaatttgtcacccaattatttttatttattttcatttatttccctttggctttttcatctttgccttcttgctcatgtttttccacaattggctttgtcacccggtcataggaaggtggacaagctgcagtggacatggtcagatcagttttttctgtaatagagttttcatttattctgtcaattatcatgtcttcttttataagaagattagccccacctttgattttgtttttattgtacgtaaaggaagcttgttttacagttcgctttaaaaggtggcgtctgtaagcacgctgaataatgacagcagatacttcctcttgttttcgttttaaagtagtagtgattggctgataggagaccttggaaggattggaagccatgaatcgctcttccatctgtattcgtagagcatccatctctccactctctcctagaacccgctttgtaaaagcaaataagatatcaagacagtggatccggtcaccactcaccatgggcaaatccatggcaatgagctggagtttgtttggttgtggcagattgagaggcggttcaagcgcagctgcaaactgagataatttttcaaattccatgaactgagttgcatcgggatcaaacttctcccaaacctcatagaacatctcaaagtcatcctcactcagaggctctgcactttcttcagtagcaacactgaagttctccaggatgaccgcgatgtacatgttcaccacaaccaggaaggatatgatgatgtaactgacaaaaaagaaaattccaacagatgggttcccacagtctcccttaactgagcttccagggttaactttattagggtcacagtcgggtggcttactgttgagaatgggtgctagcaatccatcccagccagcagaggttgtaatttggaataggcagatcatgctgttgccaaaggtctcaaagttgaacatgtcatcgatcccaacttccctcttaacataggcaaagttggacatcccaaagatggcgtagatgaacatgactaggaagagtaggaggccgatgttaaacaacgcaggaagggacatcatcaaagcaaagagcagcgtgcggatcccctttgctcctttgatcagacgtaggattcggccaatcctagcaagacggatcactcggaacagggtaggggacacgaaatacttttctatcagctcggcaagaaacatacctatgaataaacaatgagaataccaaccagtgaagaaatcatgcgttaaaataaacatatgtttcttctaaagctccaaggtaaggttcagagtcctgaacccagttatattaaatatgacaactatatataatatatatataattgtacataatatattataaatcttaattttgaaattcagcaataatttcaattataaggattatagtacttttttttatctttaagagatgtttataaactacttttagtttatgtaaagtcccaagtcagaatttaaaaagaaaataagttaaaaatgcacatttggccgaacagtagcagcccaacagtataggtacaagtttatatgtatacagtgactttttctgaaattgccatattctaaattctctatttactccttttccatctgaaagtattggtagcttttgatgctactttcatctccccatgatcttggtacttacttaaattccactctaatatttttatatactcatttatgtatgttctggtgcatttctgaaaggatcccaggttgatgctctttttagtatcctgtacttaatgttgtatttcaattctttttggtctcctgtacctaacactgtaatctcagtcttcttattttcagcttctctctccatttgctttttagataaaaacaatacttgtaaagttaaaaagaagagctcaagaaactaaatgccttcaagtttaaatgcctcattctgaaaagacgaagtgtaagagtgtgtgtgtgtgtgtgtgtgtgtgtgtgtgagagagagagagagagaaggagacgtgtgagaatacaacttttataccttagccacactagttataaccaaggattataattagtgggaatcaaaggctatatacaatgagctggatataaggccagtttcttcagagaggggagtggcatgaaaatctgtccaacacaggtgcctcgttttggatagtaaaatattgacccaatcatatcatcctgtttagggaagaatgaataggcccacagacagatgctttttactttactagagctttagttttgtctaatgaaatgagctattgctcatgaggctagttatgtgttccaggctttgaagtatagtactgatgatgtcccatgccaccttatttcccttgtgcatcattatgataaacccatttttaaggtagtctagaaaatctctacatgacacttgcagagaacctactatatgcatttgctaatgtttagtccttgtctttattctctttttatgcaatacttttccttatcttgaaaccactttccactaatatctatatgctggtgactccatgtctattctctaaagcaattttcgtgagtaccagactacatttctagtcttgttaacagaaccatctagatactatattggttcttcaatctcaacatgtcaaaaacatttttattttagttaatagcacagttctagttcaaatgaatgaggttttactacatttacactaagtatattgttctaaatggatagaataagaaacaatactgacatatagtaggagacattttgttaaaaaaacaaacacacttggataaaatgtatcaaaatatttacagtgattatctctgattgctgggatgatcttgaatctaatcttgattgtttcagctttcacttttatttaactgaatttaagaactttaaatatttcttacctacaatggagagaatgacaaccacaaaatcaaaaatattccatccaatggtaaaataataatggcgtagagagatgagtttcagtacacactctccagtaaatagcacaatgaacaccagattgatgcgtgacaaaatggtagtcacatattcactctggtcatctgtttccaccatcattgtgaccatgttaagacagatgagaatcatgatgcttatgtcaaaaacttgtctggttacgaagtcaaagaccattccttgaaatttgttctgtagagaaatagaaatgcttttaacaacaaaggagttttctcatgtgcattagcattaagtactttctgcattaattgactttctagtttcttgcaaagtagtcattggccctgatttttgtaagaatgatttatagcatattaattgttaaaatttagttatttaaattgccatttactaatgtgtatttctcagaataacaatcccttatccaaagaaggtttctgataaaaacaaacaaacaaacaaacaaacaaacaaaagaaacattcaacactgtatacttcttccagaggtatgcaacacatatcaacattttaagattatgaaaaggtaagaaacccatttaatttttttttcaagactttccaatgatcagctggaccatacatccattttaaaatatagtactattaatatttcacttgttgtattctcaaataattgttaaggagaatttggaatttccaagacacatctataacattatgcatttaaataccacatatggcaatactcatattcttctaccaaatagccttggctaacattgtcagacacagaatcctgaaactgcacaaggataatgagaccagaatgacatttcctatatgtttatgtcaaaaaaaacttcacgttctttgtcgttgatctgtgattctgcttcccatttctgccactgctagtcactgaaggccatctgcaggcttatttctttgggccactgaggaattctgagggaattttccaacttatatttttcctaaattgttgtttcatttctactcttagtgctaaattttaatggagaaagtatatatttctcatcattctcaggaaggcaatattcaatcatcacaatatgaatatttgctagtagttttttccttgatgcaccctaggaattactgaaacctctcagatcatcatcataaaaatatttatagtgtgggataatagctgtacattttcatagcaatttgtttatttcatcatggaagcatgagtattgttatttatcatcataaactgtaattactgaccctgacttctgcagacattagtaatacctaactctatagccatacatatgaatagtagatactggaattctttcctcctttaaaacacttagtatctctagtgaaaaataaaatagaagtaaggtgttatttcactcaacacttcatttcttaaaatattaggaaattgcatttcttacagccccatcccaaggtttacttctttccctgatattacttggcaaccattcttgagttgtgtgattaactttctcttgtgcacatcacattgtctatgtgtccattggccaattaatatggattgtaatggggtgcttctaaatctcttgaagtcaagggtgtatcttctatttcttcttgttcttttttggtctttaattttttttgttgttaccattatcataaaagatacaaacatcacttttagatgatgctctacaagtgaaagaaattttttctactggaaatgttagctactttcttttttgtgagacaagcatgcaagtttttgtttttgtatttttcccccatatcatttgatacttcttactcctggtcgaggtataggcttttgcggttttttcgatcctaattttttcattgcattatagtatttcttctgttcttctgtcataaagatgtcttgacctccaaagtatagaaaagaaaaatcaaactggttaaaactgtgtccttttgtacatttttttcaatgttaaaatagaaaatggatggctaaaaaaagaaatacaaaattcaactgattagtataattatatctgggatttaaaatgtaaaaaaaattgtactctttaggtatgataatatttaattccctaaataattcaaaattgactttattattattatcttatgaagacaaacacccccaaatctcaaaaaggttaagtattttacccaagaccttatgcttagtgagtggcgaaatttggttcactgagataataaatacttggtaccttatactatacatactacctttatgatgttaaaggcaataattttcttatttaaatgtagcaaagagttagaggatgtatactgcaagacagtttggagttactcattaaaaaagtcactctaactctgtcaagaattggaggaaagggataaaaagaaaactggatgagttagtgagagatttaggggataaatcagagctcatagcatagtaagtatgggacagaccagtagggatagaagattggaacactggcaagtaagtgaaatagagtagcctgatattgacttaagaatactactggtaataagaaaagggaattgaggggagaatgttctgtagtctaagaaagcactcattcattatacaaaaagcaaacctactgaacaagtgagatgaagcaacagtacataaaggaagaaatacaaatggccaatgagcatttaagaacatgttcaaatgtaataaaatacataaaagtcataacaattaaggttataaaagtcataaaaattaaaattaaatacagttttcacctattaaatatcaaatattcaaaaacagaatgtttggtgacagtgagggaacggtggcatgggtgttcatacactgatattgggagtttgagtagttatattactctaggggagtaaaatacttcattgtgggaatttattctcaggaaataattaaagccttattttctgtccctctctctttttttttgtacaaaactttcaacaaggtactatttaaatcattaaagattaaaaacaatctaaattatcaacctactggggaatgaataagtaaattatgataatgcatatatgaagacttaacaaaatgagaaaatacttatgttaagtctaaagtggaatttataattatagataaaaagtacaacaataagagtatgtgcagaaatactctgaacagaaaacaaaatgtgaatggcagcagttacttccaagtgatgatatttatttactttccatatgttctataatgtacataggtaattgggacaatcaaatgagccttataaatgataaataatagtcatacaattcaagactgaaacggatagcttgtatttaaatatcttggagaaagaaatgggaatatataaaagaaatcaatgacagaaaaaagcgtaaaaataaacactagaagaagcttacatccagtgcctaatttattgcaaagaattagttggaaaatatattttcaagggggagtgggtagttgtagggataaagtaacaaattgcttttgggaaagaggcatattcggttgctttctagttttattctaattattattttttaaaagatagaaaatgtttcttgataatgaataagaggaggaaaaactttatgaacctatgaacaagagtgtggaacacagttattcttagctttctatagccggaaatatatggatagtgaatgacagaggaagaggaaggaaaaatcagttataatatatactcccattttgtttctaaattcaagtactcatttggcagagaaaacactccaaggaataattttctatctcagtgggagagaaaatattagaaatacttatcttctttttctgctggttgaaattatctatgatgacaccaataaacaggttcaaggtgaagaaggacccaaagatgatgaaaataacaaagtaaagatacatgtacagactttcttcatacttaggctggagttccacctaccaaaggggaatattttgtaaaatattaccatacattttagtgctggaaatgtcactggtgctttttcataacaatagaaaaaattattcttactaatatgtcagcattttttttttttctgaatcaactacctctaaaaaacatccctgaaattggcctttagggatgttttcatgtgaaaaatatggctattatgacattctaaaatctatttttataactataaatacaaataatattcttccatttgaacagtaatgtgctaaatttgcaagcttttaaggtactgaattttagtaattttaaaattattaataaaaaatttaaaactgtaaatatctacaggctaggtttagaaacagtcattcatgtatgcatgaaataatgtagcaaataagaaatgagttgttcattcagatgtttggcactttaccctaaagtaacagttattgaatttttcagattaagtagacatagatggacagtccattttataaatcctcagttgattatttaattcctagattgtgcttaaaacaaatgggctattacttataatttagtaatggactgaaaggtcactatagttttttaacagattcatgtccttctaaaagcaacaaagttaaaaaccaactaaacacacaaaacaaaatataagtgacaaagtgaaataaaacaactctggaggttatcaaaatgatattcaacataaaactaaagctatttgaaatgcacttcaagaaagataacatcaaactctatcaggttgaagactgcagggacagaggttattctttatgatgataaactaaacagatgggacttgagaatagaaagatgaaggttgatagaaaatactacatcttacaaagttttgaagagcaaagttggaatgagcatgaatttcagtttaggtcttggagcctgaaagaggctgaaatcaaataaaataggtttatattttggtgatatacacttaaaggaatctgttggtcacagaagtgattgcaacattagtaaaggctccagtcaatttatgaatgcaaaaatcatataaaaacattcttttatatggtttaaaataggattatttgaaagaaatcatcacagtaatctaaggctgacagaacaatatccataacttttcatgctgtctaatatggagggtgactatacatttcaactaatgatagaaatcatatatttcttcaaatttggtcccgcacactaaaattactactaattatataatgtgtggataaataggaaacaaaatagaaaatatttaaaaggaaaatatttgttagttactaaatacatgaatttgttactttggttttcaaaataattcatgtgttgaattatcttagtaagatctttctgataaacattgctatgcttgaatatttacctgtcacactttttcccaaatattttaaatcaagatagaatcatttcatttggtcgtttatgctttattcgattaattttaccacctgatcaatattgtaaaaagacttagaatacaaggaatacttacatttctggaatcaactgctgcatacattatatccatccatcctttgaatgtggcctattaagaaggacatgcatgttttactttggagtaaaaataatttagacctgatgtttaataaatattcttactgatataattttcaaaagggaatatttttgaaagacatttcaaaacaaattttacacagattttggaccaagacagtattttagtatggcttttcatttctagaacacatattgaacaaaatggccatttgatatatcctccccttgataaccaactcacaagcacttttcaattctttagagttcatggtgtcatgatatttaaagcagtattaaaatttgctggagcactttttagaaagtcttacaaatgccaacacatgggtcaatagctctatcagccaaataattacaacttagatctaaggatcatctgctaaaatttatctgcagggtgatcaaagtgattgaaaatttaagatttctctttattgtaacaatgtaaggatagtaccaggatacataaaggcagggttgcaactatccttttaagaattttggagcaaaacatttagaaatacaatccttttaagaattttgcatcaaaacatttagaaataaccccctattctattttctttctgaaattcttgaagataataagttaatatgaataagaaatgtgaacaatagtacagcagacacttggcactcacaggatgaaggatactcaggctaacaacttacagtaatttgttacttgtcctggggcatgaattttgagtcctgtgggcctaaaaggattatcccttagctagtgagggaggttagcaaagcctttagcgtctgtatcacaatatatctttgttctgataacgctaacccttgtgaggtggtggatttcatgagacaaaagctaagcaagggtgtgggtgacagcagtgaaaagaaagtaatgattcctagctagaaagtacaaggcttttgtatatgaaagagagagagatgtgttaaatatgtcagtggcttaggtcaatgatagaacaattccattacacacttggtatagaaacaaaaaagtgattcaagggaccatttcaatgacttactaatcaatagagaggtgattctataaaagccaaatgtgaagcagtattttagagggttttttttttttttggtggcagaatttatttaatagctttgtgcaggaccatcactgtattttcagaattgcttacattttaaaggattgcttaaaatttttaatttttctttcctcaaatttatggaggaggtggttgctttagtgatatttacaagtatggtcattagttaagggttagaataagtgcccaaataaatatcatcatgtgtcgacaatttttaaagaaagcattcttgctagattttttttaacttttgtttttatttgtctttagagacaaggtctcactatgttgcctccactggtctagatctcctggcctcaagcaatcctccagctttggcctcccaaagagctaggattacaggcatgagccaccatgccccacccgttcttaccagatttaaaaaatctctattttaattgcatgaatattattcagagtagatcaaaaatgttaagaagagaaataagaatttccaacaaaaaggtgggaagaatttgtaaagtaatcatagttgacacctctggaagagctgcaaaagggttttgaccagtgttggtttgtttgcttagttagtcttctggttgaacagttgaaatcataaccttggtgagcaaaaattgatttctgccctaaagacactgtagaaccacaagggaagaaagaaattgtacagtcttttttttttaagctgagttttcaaataatctggactcttattttattccctgctttgttgtggtgctgctgcagctagaagcagaatcaaatgaaaatgtttaaagggctaccttttttaaatataaattataaactatttttcttggagacccagtcttagagacccagtagtgaaaacattaatatttaggacaaaatagacttaaataatggtgctgaaaggtcatttgagataagacaacagctgcttttgcttcatttttgtttctagttgcttccaggtataattctctctctttttttttttttttttttttttttttagatggagtttcactctttgttgcccaggctggagtgcagtggcacccaccgctatgcctggttctaattctaaaacctaaatgtcattccccaaactttgatccaaataatagaactcagcagcagttaatccctaccaattaattacaatccaattaggtgtattaagtgtatgtgttttggaagatgatctatctgttaagtgtattccgttttggtagctgatcagggaaacaagccttctaatcacaataaaaaatggcaaagttactgatttattaatttacttgtttatatagaaagagcaatatagaaacaaagaaaatacaagaaaaaagacaaagaggtctttgtttggtctggtcactactgactatatctgcagtccttacatgtaataaagttttcacccatctgggctcataaacttgtactaacaaattgaaattttttaaatagaaagaaatatatactttttcttaggaactaaataatagatgtatgtcattattttgttattattccaaacaataaaaatattcagagaaaatagtgttcacttacaacttgaagcaaagagagatacccaaatcctacattatcaaagtttactttcacatttttccatcgagcagtctcatttctttctattagttttaggcaatcagtatgattattcacgtcttcgatgtcaaacctgtcaccagttgtggtgttaatacagtggtagaatttgccagcaaacaaatttacgcccatgatgctgaaaattagccagaatataagacaaaccagaagcacattcatgatggatggaattgctcctaaaagggcattcacaaccacctaatacacaaatggaaaaaaagaaaagtcagaattcttatctgttaataaagaaaaaaaattcccctagtaatctctggtctttccattctttttttctatcaatgctatttattctaggatatgtaaaagcaaggttcaaaaaaatcttaaaattcatttttttttcttaagcaatacacttaggaaaacaactataggcaatataaccaagaaatgaaacaaaaatgtttttaaaaaaaagggagggagaagcattaaaaggttaaaggaaaaggaaaatcagaggaacttgctgccagatgaagtcagaattgtgttatcagaataaagaaaagttaaaaagcctatacagaagtttaactcattttaaaaaggcaatatattaaagaacaaaactaaaacatttggacctgagttgatttgaccaatatatttttaaaataacttaaaaattcagatgataaatataaaaaatattattaaatacctaatataattgtctttaattattcatgcattgctatgactaataatttttgcataagaagcaagacaatttgcattatgtatttcattagatcatcacatcgtttatttcaagctccagtcatgtcagttgtttcatttactgagtttaattcaaaaaacttatttcaaatgaaacataatagaaatcatttcttaggaaaataagaaaaagagggatgccatacatagttctcaaatctgatgtgatcacatgaagttctgtgttcaattattatctacttttttttttttctatagaaggatgttttccccctctttacttctggaccactagttaaaaatcttgagtgttcatgtttggaaacaacatagggatggcttccttgctttttcctccatacctcccactggagctgcacaggagtggctaagagggaagctaaaaacagaccctaaaatgcttataaggggcagctgcctcaaacttggacattaatagctaagtttaattccacctatgtgcttgtattattcttgtcagtctgatccaatggaagtagtcgtcaaaacatcttctatttgccatttgatgccagtgtatttttagaacaattttttttaactgcctgtctgaaaaaaaaatacatgagccaatttcttatacttctgatccctgtttaaagcctgtaaagaactctaggccttctggggaacataaaacagtgtgataagtgggccaaagaaaataagaataccagtaatgacaaaggtggaggggatgagtatgaaaaattaatttggttgagttatccaggcagaaccaaatgatgtggccgatgcaactaccaagctgacacgtgacactttgccttatctcatctgactgtctgcattaatacaatggacttcataaattctcgttatataatttattttaaatggatgaatagaattagatttctttcagattagagatttggaaattgaaatcaagttactatttcccttcttttctgaatattttgtccactatccagattacaatgctgtttctagtgtgtatacacagagtactaattaaaatacgtattttgccttcaacacccaatttagagtatgagcagaacactgattatctatacctatttctcgattttcttttcacattacctgtctcacattttttctttgaaacgtttctcagctttgccacctcttttccattctcacagtcaccacctagaactgccctctgttatttcatacttgcactgtcatctgtctcctaaccttctccttcatttaatctatgtaagatgaattaatcttccccaagtcccacttgaaagttatttattggctctctggtaactaacaaatatttttcttaccttggtattcacatcactccacaatctatatttccagttttaacttccctggtcatctatacttcatgccacttcaattaatataataaccgtgtgctaatataattgccaggtgattgagatgccatttacattgaaattccttgtctaatagctcctcttctgaaatactctcccctcttaaaggctttagttcaaatagcacttctttcatggagcctaactttgtcccccagtttagcctccaaaataaagaggaatgttttcccctttgaattcaagaatcagaattctagtactgaacagaactgtacagataattcagtattgcgttctcatttggcatatgagaaaaatgaggttaaaacaagttaagttcagaaagtagcctataaatagcatttagtgctgtttccagtctacgtggaagagttgctcccacttatctggtacccatattactctgtactagagttcagtgtaatcctgacagattgtaagattttctaaaaatttaagatgcaaacatatgttcgtgaatcttccagggccttgagtgtcttgaatataagaacataccagagagctttgaatataggaataaaataatggttgacaaaaatgaatgggttaatgaagcaaagtttagattagtatttattgatcaaagcataatttttaaatgttatttctgaatatgggatgagaataattaaggaactgagcacagggagaagtttgtgcttaggtaatatgtttgagaggtttactttgaaactggggattgatttagagttaaagcgaactctatggaatttatgacgcaagcatgtactctgcagcagtgcacttcaggatatgatttgcaaagttggcatacatttggcccagagaaaagttttattttttttgtgaacataaaataactttatcttagaaaacatctggcacagtattggggagtttattatacaaagctatagtcatatttatgatgtattaaattagacaatgaaagatcatagaaaagattgtcttttcccaagagttccaagccattccttggttcagcaaagaaggaggtgtattaacttttttcagtctcaataaagctgcagtaattggttcttatggggggaagaaagtaggcagaattagtctgaataaattggaaagaacaaatttcaaattgaactttcaggctacatgaaaggaaatgtctgagaaaggagctatcttaatgaattaatactgtactagaggttgtttcttctcagaagcttttttttcaaaacaatcatcaaataaagtttctctactctagcacaaccaattctatttctggttcattacctgcatttttaaaaataagtctacactaaatgaaggattgataattaaatatgcaaattcacattagaaattttcatacatgcagaaatgtctttttatctgaattaattactttgaacttcaaatcaacactattcatgaattctagtgcttctctaatagaaataaagaaaatctatgtgaataaaaataaaagtgggcaaagtaggaatcatccatttttaagtataaagaagaataatagaatctttcttaaaaatctaaaaaaattatgttgtgggttttaattaagacagtttttttgtaagctatgatatattggtgatccaaacaaaaattctgactttttctgtctctcgaatataaactcttcttcttgtataatacacttaaactttaagaataaataaaatgtagagttatgtttatgtatgttttcactgtgttatgttttaaaatcctagaaagttagttgggagttacttattctaagaagtgagtttatgccttaaattttatcttaatactcatgataagacgtttttgttttatttctaggtatgtattctattctgcataattcaaataagtggatttttttattctaactttttgtttacaacacaattcacatgtgcttattcaactatttcttaatatatttttgccttgttaacattttgaaaataaccccatatgaacttacacaataaaaaatgagagtggtcacaatcaataccagtcttatgaaacctgaaatattgcaccctagtatctgctcatacatatcaataatcaactgatggtatctaactggtaattttcaggacccagaccaatgtactaaacagcaggggctgtatgcctcaaacagtatcatgagcttaacaagttaaattgttttttcacataatcattctacaccagggtcccccgccctcaccaatccagtaatctccccaaagatggataactccatatacacataactaaatcatattcaatgaaacttaataaagatatcaaccattggggttaaaatccacagagggtaaattcataaaggtttttttttttttcaaatgaaatttaagacaattgaaaagaggggattaggatgtaaataatgtattttccctactgtggtgcaataatagtacccttcccaatccctccctcaccccactacacataagtcacagtgcaaggattaaaggtagcaaaaggggtaatacagtacccataataaagggctcaggggaggaaccagcgctccaccccatccaagttggagcaagattatcctatacaaaatagaaatatatagtttgttattagttagaaatctgatatgacagaacatttggtgttactttttgttcatgatgctctccgtctgtttccctatccattaagacttgagttcttttgaaaaagaaggtatttaagatttcctaggttaggaaattaaaaatacaaatttaaacacaaattttattttaccctagatattcacgacatcaattcactcagtttaattttacaagttgaaaaatttggactggaaatttgaaatacaataaatgtttaaaagctgtcagccagaaatgtgcataaaacatgcaaaacacaaagtgcaacgtgatgataatttatttgttactttctaacttcttatcaagcactgtacaacatgctttattcagtaatgttgcataaaagcacatgctttgaaaaaataacagaacaacaaaaataaaatgagtgcctgagttacgctttgacgcagctattgtgattttatgctgctagggcaaagaattaaatgagagtttctgagcatgttcaaatctcacttcccaatcataatcatcattcttatatccaacctcaccatcattcatgattatatttttacaaaataaaatatccaaacactagaagtataaaaaatagaatcaattataacgttattttgactctacaatgccaaacacgtattgaagagattagtcattttagtgctgtgtgtatgttgtcattatgaggaatagagccatattcataaatctgaccatttaaactattagttatatcactatcagcatttataaggattttatgtctaaaactccaagtttcaaaaactaacctcttttaatataaaaggcattattgattaataattatagatatggttatttctgagaaaattaaaagtataccgataagatcagcttttttatagaaatgaagtgtaatgtatggaaatatctgagcacttgaccaatgaatttaataaactttcaaatggtcaaatgtaaaaggtttataatattttcaaatgtttagcattgttcagatttcacaagccatataaaatatattattttgattcaggcaacatgttttcaagtagaatgtacacaaatgacattttttttctccagaactgaaactgccagtctgaaacaaaacaaagtgacatttaattggaaaacagacttaattcttatacaccccagagataatttctgttaacattttggtgaaaatttgaggctctctgtgagaaataaaagaggactacttgtattatattgttctgagttgtcgataatgaggacaaagttttcatatatgttagggaaatcgaagacaagtcctacgttcttacaaagtgacatttataataagacttgagaagagaacataaggctataaacaatctacaaagtgcaaatggaagtctacaatacagcttagtttccataaaagtaactacaccttaggaggtgaaagagcagtgtttttctattggaatcacacaattcagtgttttgttttgataatatttttttttaaaaaaaagcagaactaattttttatattatatatctataaactaatgcttcatgccgtaaaaaaaggcatggaaaataagtcaataatggcaaaatttctaatctgttatgcatgatggaaaatgattattgcatctttgaaaaggataaaataacattttgtgtgactctgaccaataagatgcaagttaaggttaatgtataaattacctatagtaatgagtcaaaattatattttctgttcattataagtgttttactttattgttataaaaatgatgtggatttgtatgtaatctttaagttagtattactagttttataaattcagtcaacacttaatatctaaccatctaatcttgaatatattcaaataatgcaaactttggcattatacagacaaaagttttaacaactcctttcatttttttcttaacactcatacttaggcacatgtgtgattcacattattttcaggaaaactcgttaagtacagtatatcatcacaaagaataagtacctgatatagaatttactttagattaccattatatcattacacatagtactttaataatgcatcagcttttttttgtatatagatttgtaaggaaactcccaagatggattaggaaataaagtcatttaaataagcacagcagataaatgatattatatcatttcaagagaggcctatttctcttgcatatcacctagaagtaaatatgcaacagataaaacaataaagtagcaattttgcaagaatttgccattccttttgcatgcatagattttcctttttctaaatttaatttagtttaattttggctatatacaatacttcaggttctttcatttttcttaccctcatcccttcaaatcgagataaggctcttagaggtctcagagctcttagtgtcctgagagatttgatggctccaagttctgagtaacccaaggcatttgctgttaaactgaccaatgaaacctgcacacacaaaaataataacaattaataaacagaatcatcattcaatgtgtagttgctatataatacaacaagtataatttttgcttataattattcagaggataaatgttcagacattttcagtaaacctttaaaaaattaaagaaataatttcagtttgatgtaaaggatgtaatttttaggaca

SEQ ID NO: 4911 - DNA, 1003 bp, Homo sapiens
ctttgattgaaccaggatgaatgcgggtgttggaagtagaatatatatatacatataaaattggttgggagccacgtgtaccagtgtgtgttgatcttggcttgattcagtctgccttgtaacaggtgaggtttctgctttctatctgccaaaccccaccgcaaaatttgtccaactgggcctaacctcaggacccatttccaagttgggtataaaactgggagaataagtcattaggactgacattggcctgttggtattactaggtctttgttggaaataagagcttggagttccaaagaaaacgagcacttgaacaaaagatttctcagcaaggcaaatttacttctgccgtagggtgctgctgctggcattcctggcaagagcacacctaacaaaagagagaaagggtttttattcctaacaagtagtccctgcttctgtgtcctatccccattggctggagtcgacagcgcaatctaaactagtcctgattggctattttaaacaggaggcatgtgggttacagctgtgggaagggcaggaaacttgtttacagagctggttgctaggagtgagggggacttttccaaatagggaacaggttacaggttgagattggccggagaagttgtttatagaacgggtaactcggagcaggaaggtatgaggaagttgaccttaagaacaaagaacaaggaagttaaaactttgaagagaaatccattgtatctaacgatttcccccttttgatttttataattatttctcttcagacttgttttagcgtgtcttgattttgttcctcttggtcctctgaaattagaagcttaactgaatgatgcgagggaggattgaggaagattttggtgggtgagagctgttaaaataagcttttgtattaatcctcagatacagggtatgatacagcatcctacaagaatgagcaaacctattctgatggcaggagattgaggacaaactggcgatggaatatgagagg

SEQ ID NO: 4912 - DNA, 3105 bp, Homo sapiens
ttttttttttttttttttttaacaaaactaacactaattggtagaagccaaaatagtgcttctctttggtggggggcagtgaccaagagagggcacaaagaaaccctctgggctgttggcaatgctccatatgatgaacttggtgggggtgtgtggctgcttacataggtagaatctggagctgtgcacttagggttgatgtccttcactgtgtgtatgttatccttcaatgaaaaaaaggggagagttatgtatttattaatatttcagtgagaaaactggatattgaatataccattgaatattttattttctttagaaaatactacctattatataaatcagaacagttgatagctgaatagagagtaaacctcacacagatggggagggagccctatcctctaccttaacttagtaagttttggtgaactgtgaaattgtcctctttgtgcttctgtttggaaagtctgctttatggtggttcatactggacaatcttcattacaggtctgatgattatagtacttttttttcagtgctttccacatggccaggccctgagctgaacactttgtaaacattatttcacctaatctttgcaacagccttataaggtagatgctgtttttattcccaatttacacatgagaaaaccaaggcttaaatcacttccctgaggccacatggttgataaattgcagagccaagatcagaccggtttccttgtgactctagagctgtcctgcagatgttcttctttttatataaaacaagatcaagtctagactatgactgtgcatcaaaactcagatcctcattcagtctatggtattggaagcattaaaagaaaaccacccctctttcatctttttgttctttttttctccttaatatctagcttttatttttagcttttaattgtttataagagaggaaccactggaaagagtttaaaatccttgttccattttcaggttgggaagtgtacgtgtgtgggggtgggtattaaacaagacttgagcattaagcatttcccctcctgagcccagctcctttcctcacttgttgactaagccctgcttcactgagcattttctttttttctgcccacaacctgagtgccccatggaggtgaaggacatagcctgagtctgagccatcagtcagtagaacaaatgggcttgctctgcctaacatcgggccatctcggattccacctcttttataggaatgagtgatgaagagaggtgggttccgctttgccgctgtattaatacacatcaggggccagctcctagcactaaatcacgctacggcatacatctgttatcggactcttcaccagtgtgatgaacaagactgcagatagaggcttccttgtgtcattctttataggattttcctaaaagaataaatagctcagatctctgccaacactctcccctgtcactgtgatgaattcagcttctttcttaaacatgcagccacaaatcttttccctttttcccctcccccagtggtagaaagttttgagttgcaattgactgaatttaaagatattaataaggctagagaggtgaagagcaggaagaaacagcatgtcttccttgcctttttgtactaatagtaacaaaaggccaaggaaaaagactgtaaatgaccataggttgttaaatagacccatcttgaaagtgtagcacctttattttctttgtatcttcattctccctcctttacggctttctagcatgcaggtgtctagtgcacagaaccacaccctggatcttagtgagcaagcatgctaacctgcttctcagacttgatacaccagaacagggatttccctgcaagtgtctccctcatgctgaagtgaactagctgaatatgctcttaaagaaagtagtcagaaaagaaaaaaaagattatcttctccaaaatttgagaccaagtagctgtaaaaaacataataaacccagatgaaaaccaggcttcgttttcttgaaatgattttcttcatcagaatggtagatcagagccattggtgtgcagattccaatcctttaaaaagtaaacacatgccttttgataaagcggaattgaggtgatcagaaattctgttgagaacccagctatttgtgtgagtatattttagctatcccaaaaactttttctgacctttctctttctgggataggatatgtgtgcttagagtatcattcagaagggtacctaatagttaatctgttaattagttacatcaggtttcaaatactaggtcagtgatatgagagcgagagagagagatttgaattgtcaaatgtattgtcagatgcattcacaagagcaggactgcttatctgttttgttcactactgtacccctagcatctaaatgaatacctagcccatagaataaacccactggttatttgttgtaagaataaattaatagaatcttaaagttgaaacagagtgattcctaatatattgtaaccacatggttggattcagtagttccattttaggatgtcccttttctcaggagtcatagggcaaattcttattgcccactgtgtctttttaaagtttaaatgttttttaaaattaaacatgtttcttagtaaatattgaaggggtataaaagaacatttatagcagatatgtaaggagtaaataaaatacagcaaatatccacgtacctaccattcactttaagaaaaagttaaaattttcttttataaaaggtttaaaagttttaaaaagttaaaatctttaaaaatcttctccctgctctcctcagaggtaaaagttattctgattgttttttatcgtttgtcattcttttgtttttttcaagtagttttagcagacatatgtatcttcaagcaatacattgtccagttttgtgtttttgaaccttgtgtatatgaaatcaaagtatgtcatattttatgttgcagctttcaccgggttctgtttttgagattcaattatgctttgtcctgccaaaatctatgtttcaactgccatgtatgtggtattctattgtatgaatatgattaatatgttataattaaatgttcttgatgaacatttggattgt

SEQ ID NO: 4913 - DNA, 3388 bp, Homo sapiens
tatccagtccatgtgcaatgaatccttggagcattagctgtgtggccttcctactgataatctgcagttatcacagtaaagagatctctgttcctaggtcaggccttagcaattacaaatacaggaaataaaggggtactcaatgctgaagacttaattttgggtacctacaaagtcctgggaagggaaaaagaagaccttggcatttgtatttgcataaccagagatggaatgtttgaggcttttaggcataaagattaattagattttatcatataaagattagggcaaattatttttttttccagttcattcttaacatgttaagggacaaattttaatgaataaaaatttaaaggccttaaaactttcttttggattcacatttccactctggtataatccactctggtgtagtctgccctttatgacagagaaagcctttgaaaatattgtcccagggaatgaaaaatcttaatgatgatctatggaaatgtctctcattctctattacagccctttgggccctcctatagattctctgtgaatttaagtttgaaatcatttggtgtttgcatgaaaaataattcttactattcatttaaataattcttaaatgtggtcttaaattgcaagagagaacaaagccagaaaaaggggaaccttgtagattgaccaaatatttattctttattttcagcatcacaaatctaaaccatttcaagctaatacaacaacctgagtgagtagaaattccttaaggtttagatttctgcttttagtcacatcttgaagcagatgtttatgacatatttgaagatgatccactgagtttcctataaagtaatagaatcctaactatagtggttctttaagaaccactgaaaaaacagaattgcagtgcagggaacaaagcttaaaatgtgtttcctctggaagccaagatgctaaaaaaggggtcactaatagtgtgactgaagtccgtctctagaatggctatctgttagatagcagaaatatttagaatgtatatggcatttctaatatttttacaaaaataattttaaatcatgtaactcgaattttttttaaaaagtctgttttctttttggaaaactggcacaataaaaataacactaatataattccattgtatatgcatgtgcattgaacccagagtgggtatactaaagatagttcatgcaaataacttatgggaagtttggctattttttcatgtatgtttataaatatatttagtcatctactgtgaccttggtagcacagaagcattttgttagctgtatcattaattctaaaaatcaaattcttggcatagtaggctatgagagctttttgttacttggtattttggctaagaaaattatttcttgcactttctatttgtaaagatgttataacacaatgcacccacttaatgcagcttttctttagagaatttattaccctaaaatagtgagaaccactgttcaaactaactagctaccaagtgacttctaactcatgaagaaaatttgtatttaagagcaagttcaaatgtagcaggctctcttctgagagtattctggataccacggaaagtttcatttatatattgcttacaagtacgtggtaatttgaacttcagtaggtgatatgtgcaaggagaaaaagtaggtcaaggagaaagttggttagtgcagaggactgacttagcatcagtctgtgaaatttcattaaagtagcactaaggcctggctgtttgcttagcatgtaaatgctgcagtgtccaagaaaatgcctcctatgccttagaaaatttgctgaaggcttcctgttactggtggagtagaaaagcaatagcctttgagactccaaagagagtagcccccttagggttttcatactgaagaaccttgtggagtactgtgaaacattgttgaactttatgcaaattatactgcactggattttaagattttatggggagagagtagagcagagtggggaagtaatgataaaagataaatacgtaaacttgtactatattttaagcaaggaatgaaacaaattccctaacaggaattccctgtcagcactgtgaagtttggtcaagttctgcctaatgggttggcttgctgattcctcttaaacctctaggaaatcctttctaagacagcaaaacaaacgttagtttgagtactactatttcaccaccctgctccatccccctactctcaacgaaagaaaagcattcccaaactataggcaaaagaaatgtgttctcagtccattaatttttcatctgctatgatctctgtttattttcttttagagacagagtctcactatgttgcccaggctggtctcaaactcctgggctcaagcgatcctcccacctaggactcctaaagttacaggtgtgagccactgtgcttggcctagaactctgtttttggcatttctttctaaatgagtacattggaagaacatttaggtttccaggctcctcataatttctgaatgggacccgctctgctctgcctctgaaaggaggagaaaaggctgagggttcaaagacagaaaagtcaatgtagcagaaatttgatttccttcagatggacatagtctgaaagaaatctatccagctgttctctatggtgcttatatgatgggtgacagctgtccccatctacctgtccctggcactgtgccttcacactggtcactgtgaaaagcagatcacactggactcagaggccagaatccaggacaagatcccccttctcatcttgagcccatcacatctttgtatagctgttaatgtagcatttacttctctatgggaaactcttgggtttttaacccaagaagaaattgtaaagcatttaaactagtcagaaaataagattctgatggtagcgatcaaataaaggaaaatttcacttcctctcagttgatattgattgatagcaaggatcaactatgcccacctcttcctaagtttctaaaggctaccataatatttgtaaacaacaaatttatctaatattttttacaacttgctaatcaaggaggattcatattaaaacagacaatcagtttctaaaatgttatccctgaaagggaatggaatagagtatttttagctgtaagaacctaccagtctgttttttccctttgaaaaaaactaatgtttgagatttgtgtcttttcatctgaagcagttactccattaatagtaaagatgcctcgggaaagtcagtgaaccagaatagtgctcttgcaccactgagggtgctagactggctttgtgcatcttatttcctaagaatatcagtttttattatgaccttaattataaatacctatatataggagtaggatt

SEQ ID NO: 4914 - DNA, 2214 bp, Homo sapiens
gtttattcatctgtggtaacatttcttacttccaatgccagctctacccccatggaatcgctgcctactggaagtgctgtccccaagagcagtggcaggatgacaacactctcccagccacattccctccatggcctgcaacagggcccaaggtgtgcactcactcagtgacagtgtcttggaaccagacccacagctctgcacctgatggggcctgcaggaagggtggcccccagtatcgggtcctccaaaagccttgtgtgaatgacaggtgcagctcccgtagagaatacttggagatcagctgccccagggctttgggaaagagcctgtaatgggacactggggaaacgggagcaggtgagtgacgatccccacctcgtcggggtccacacccaggatcccgaactctacccaggaattaggccccgcccccaaagtttgccttcatcccacggccggccagccagcaggcactacggaaatctttccctggtcagatctcgcgccctcacctccttcccgctgaagctccgaatcccagcgcgtgcggaactggaatgtggcggctacgtccccggaaggcagcggggtgatgacaagttcctcccgcaggctgtcgcgtgggggttctgcaaggcaccagccgccgggccccaggagcaacaggacgagcagagcaagcggcatagccgccgccatgcctgcggctacttccgcctacccagcggcgctcggccccatgaaaagccggtatccaataagaaaggcgtgtgagaagtgacttccgctgtcgtcccggaaaccgggatgcggttatcagagcgaccgcctgcgcaggtcgcgaagattccctcagagctggtgggtctaagggggtactgggaggacacgagagggagtaggcagggcgagtaaccagcttgaggccgcacctagttcatggcgtattccacccaccaggaaatgcttaataatatgaagctccttcactgccattttacccatttgatagttgaggaaacattgactgaaaaagatcaattacttttgggaaaaccattgtggttttaatttgcatttcccaaagtaagaggaacctcctgcccctcttagcttctagtgtctccatttgctgcaaaacccccaaataagtggttcttttattacgaaaatgttcaaacaaaattgaaagaatgagcacctgttacaataaacctattttccaccacctagattctactatttacattatactatacttgtactttaccacatatttgtctatacatccatcattccatcttgtgttttggtgcacttcaaagtaaattgcagacattagtacactttcctttaagtagttaagcatgcatataattaactagagttcagtattcgattgcattttgatgtaaaattcacatacagtgaaatgcacaaatccaaagtacacattcactgagttttgacaaatgcacacacctatgtaacccgaactcctatcatgatacagaacattcctaaaaccccagaaaattagcaataccctttcctagtcaatccctgctcctctatcaccttccagaggcagttagtaccctgattttttcccacaatagattaatctgttccagaactaaatataaatgaaatcatatagtatgtatactgtgtaaggcttttttttttctcatgggaagaatgtttttgagaatcatccatgttcttgcatgtatccacaattctttttattactgcgtagtattattaatttatccattcaactcttgatgggcacttttaaagtttttggttattattaacaaggctgctgtctgtgcaagctcctttgtagacgtatatttctcatatcctttggccaggtatttaagagtggaattgctgggtcagagagcaggtgtatgtttaattttataagaaactgtcagacctttctccaaaatgtatcattttatgtttccataaactatgagtctccattgtaccacatcctggtcagcatttgaagtttctaattttttgtactttttagttttgaccacttgggtatgtatgtagtgtttgctcattgtggttttaatttgcatttccctggtaactaaaaatgttaagcatctgttcatgtgcttatttgccatttattttttaatttaatttttatttttttgtgaaaggtctgttaaagtcttc

SEQ ID NO: 4915 - DNA, 2029 bp, Homo sapiens
agccggctctacaggtaacaggcgtttcttctcgcgcagtttgaacaaaaacaatccagaaggaacagatttggttttttaaaaaaaatgaacaaaagccaaaaaagccacaaacacaacctaaaccttctaagaagctcgactactcccgttctgcacgttccttcccagaaggatgcagacccccggtgtcggcgggaaccaggaagctcttggggcctccctgggccagacctgcacccgggaagccgccgcaaggcttcaggagccccaggtcgccccaaggccgcgccgcaggattgaacaaagcggcgggtgcagcaacctcggcgcttccgagcgcgttcggggccggacgcccggcgtccggcgctggctccagaaaggcggcgggtgtggggcgcagaggcctatctcgcgccctagccgcggcccgcgccccgccgcagtccccggggacggtactcacacacgcagagctccaccacgtacgcgtagtaggaccagacgaccacgaaggtgatgaagagcaccggcacccagcccacgacgcgctggcagcagcgccacagcgtccagggcgccatgttccgctggcggctgccgagccccgcgtcccaccgttctggggagcgcgggagccccggcgacggtgactcggacgctccaggcggctgctggtccagctcccccgcctccgaggcaggacttgtgggagcaaaagtccgaggcgccgccgggactcctcccgtcccggcgcccagccaggccccgcccccaccccacatcccgtcgcccccctccccccgcgtccgtccccgccagcccgcccgccgcgggccgcgggccgcccccggtctccgcgtcgttggggcggggtttccgcggccggggaggcggtgagggggcggggccgcagctcgggaccgcccatggggcgtggcggggctggatgcggacaggctgggcggacgcgggaggccggggaaggagaggcgaaaaacacgcccttgatggatgagagggacaggggatagcttttgtggatcgagactcaataggggagggagactatggaaatgattccttagctgatttgtggatcttggccctctctgtgtacagaactcgctccactggggttcctgggacattgagtagttggggcactgtttcaaacatgacaaggccattccccactcagtgtgcgaagaatgcacattgttagaaggctcctcctgtgatttttatgttcgtccatcttggcggaacccctccctttcttgaagatggaacggtagatacctgtaatttcgggtagaagccatgtagggtccatcagtttgattcgtaacccaaatttaagattgagtagcgagaaggaaagggcatgtaaatgaccctctccttgccccgcaaacgactaaggaaatttaaagaatttatttacaactagaggttgctaagcaatgacgataatcatatagaacccagaagcatcactgtgaagacttcacaatgcaaggtcagacgcattagaagggattccagaccgcaatcttcataccagttcctgctactagcattcagttttggttagaatgaatttttgtgtttgttttttgaaacagggtcttctcgctctgtcgcccaagctggagtgcagtggcacgacctgggctcatttaagcctcgacctccctgctaaagcactcctcctgcttcagcctgcagagtagcagggactacaggcccgccaccatgcccagctgatgtttgtattttctgtaaaaactaggtttcgccctgttgccatgctggccctgaactccaaggctcaaggaatcccaacccctctccgcctccacctcccaaagaagtgctgagattacaggtgtgagccaccacgaccggcctacactgagctttaaattagctactgctcactaaagtctccatgaagaagacgtcaccctttgctgtgtcagagaaatgtagtaaaagcgagtaagtatttaatcactgcaca

SEQ ID NO: 4916 - DNA, 519 bp, Homo sapiens
gacacacgtacacgtcccttcgatagctcagctggtagagcggaggactgtagctacttcctcagcaggagacatccttaggtcgctggttcgattccggctcgaaggagacaagtgcggtttttttctccagctcccgatgacttatggcactttccttgggtgccttcagtgacacattgcattccaacgagcagtttgaaagtctagcgctttctccccattttgggcctcccagcctgcacgggactcatctgaggctaagctgcccatagttcggggagacccacagggaaaacaaaacaagaaacagagaacttggaaacggacgctgattactttgaacgtttgctcaaccgaggaagcaggaactgttcggccccatctcaagtccgcagggcggactgcctggctctgggcagatccgaggtggataggacaaggcaaaaggtagccctggagaggataactaggtgatttctccaaatcgactttgtttcaaatactttctaacattag

SEQ ID NO: 4917 - DNA, 856 bp, Homo sapiens
aacacgtagtacatcacgctctggcccgccatgaagtgctgctccgccgtctccaggaagcgctccaggtacttctccagcttgagagaggctgtgcaactcacccacagcagccgcgatctgggcctcctcctatgttcccctgttcagacccctgctccatgaactgggcggacccatgtccactaaagtgctgaggaagtgacagcgtgtgatttctgaggctagatcataaagggcacagcagttctcacctcactcttctgcctgggttactgcagagtaagccagctaccagtaagccaccccagcaaccctttggagaggcatgcgtggagagcagccaaggccctggtggtccccggcctccttgccgtgtgagtgaaccgtgctggaagtgggttttctggctccagacctcagacactgcagcctgtatggcgtcttccctgagacctcatatgacctcaaactcatacactgggtctgtggaagggagcagataacctctctgtttctagttcttagactaagaggaactggacaccaggagcctcataccaggactgcccagccgagccactcgattcctgacccacatggcccttgagatgacaagtgattgctgcttaaagtcactgagttctggaataatttacatcatggcaataggtaactaatgcagattctggtacctggaaaaggagtgctgacatcaaacagctctatagatgtgggcgtggcctcagaactggccacaggcaggagccagaaggactctgtggaaagcgtgagtgtctaaggtgctttgagagactgtatatagaagtctcatggcctttagggaagctgctgg

SEQ ID NO: 4918 - DNA, 855 bp, Homo sapiens
ccaatcaattattgttatttgttgggattaatttggtgactaatatttttaatgcccatcaggctactaaatgtgaatttggctttaccctgtaatgataacaggacaaacccaacgggtttctaacattgcttgttttcccctggtaggggatttctttgcatatgggaaatcaggccgaagttgccagtaacagccacatccatgatttgtattaaaaataactattcatcattctgggctagagctctgcttaccatggctcacctgggaagatattctgattatgtatctaatcattatgatgccacctttcgagaggtgagcagacaattaacaagtccttcaaattatgttcaaaacccagagtttgagaaaatgttccaacgccttcaagtgtgaagataataaaaacattacctaatgcttaccgttcactgacagtgtgctgggcagacattgttttcagctctggccttgtgttaactcgtgattctcagaggagtgggtattattcccagatggaagatgaagaaatggccacagagaagttaagtaatttgtccaaggtcacattactgttcttggcggggctgattccagagactgcatccctaactagtgtacagcaaaagcgagctggccactgccactttgttataagacattttgtttctttgaggcttgtatttctttgtgttcccaaatggagtctcgttggtttttgaatagaaaatatttttatatgtttaggatttttttaaatgttgatgaagatggtgataaatatttttccaattaaagtatatacttctggtggaaattatattaaagaagagaaagtcttaattttta

SEQ ID NO: 4919 - DNA, 8797 bp, Homo sapiens
ccgcagggttggccaccttgagaagctgcgaagatggcggagtaaggcgtgccgctgcaaactggcctctgggccgggggcgagcagcccccgggaggccgagtgcatctgttggaccgtgcgaggtgagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgtgttccttatcacaggaagaaaattttccttgacctttaggtgcttttatattcatctcaaaaacaaaattctgaactcaggacttggcaagtgaggtgcaagcgaagatgcag[450 bp omitted]tttctactaaaaatacaaaaattagccgggtgtggtggtacagtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgaggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaatttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcac

SEQ ID NO: 4920 - DNA, 328 bp, Homo sapiens
attagctttacactagccctagtgaccgacaccttactagcaattacattttgactcccataacttaatatttatatagaaaaatccagcccttatgaatgcggatttgactcattaacctctggccaccttcctttctctagaaaattcttcctagtggtcaccacatttctcctgttcaacttagaaattgctctactactgcccctgccatgagcccttcaaacaaacaacctgacactaataatcagcacagcccttatactaattatcattttaatcctaggcttgacttatgaatgaacccaaaaaggattagactgaattg

SEQ ID NO: 4921 - DNA, 1102 bp, Homo sapiens
atgaccaaaatatgcacaacgcacctgctaataaaaattattagtcattcattcattgatcttcccacaccatccaacatttctacatgatgaaactttggctcacttatttgtgcctgcttaattctccaaatcactaccagattatttctggccatacactacacatcagatcccttaactgccttctcttcaatcaccaatatcagccgagatgtaaactacggctgaataattcgttatcttcgtgctaacggcgcttcagtatttttcacctgcctcttcctacacattggccaaagcttatactatggttcatttatatttctagaaacctgaaatattggtattatcctgctactcacgaccatagcaatagcatttataggttacgtactcccatgaggccaaatcttctgagtttttacacacctattctacaaacctgctatcagccattccgtatattggaactgaccttgtgcaatgaatctgaggtggattttcagtagacaaagccacccttacacgattttttgccttccattttatcttacctttcatcattgcagctttagagacttttcaccttttgttcttacatgaaacaggatctaataacccttcagggatctcatcagaccctgacaaaatcactttccacgcttactacacaatcaaagatattctaggcctaattctcctcctcctcttcctaataattctagtactattttcacctgatctcctgagctacccagataattacactttagccaaccccctcaatacctcgccccacattaaaccagagtaatactttttatttgcatatgcaatcttatgatccatccctaataaactaggaggtgtactggcccttatatcttccattcttattctagcagttatttctatacctcacatgtctaaacagcaaagcatagtattccgtccactagtctcacactcatatgaatcggagggcagccaatcagctacccttttattatcatcagacaaacagcatccattatgcacttctcaactatcttcaccttacaccaattaccgccctaattgaaaacaaattactcaaatg

SEQ ID NO: 4922 - DNA, 470 bp, Homo sapiens
cattgtgtgagacccagccctggcctctcccctgcaccatttcctgagctcaagaggctaagggaaaatgggaggggggctaggagagttaatctaatggaaaaagaagcaacacgatgatgggacccccagtttgaatttcagacagtggaggagggaatattgctaggagggagttgaggaagccttgttaaacctcatctctttgagggacagaataaaaagtattggcatcatagcatagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcc

SEQ ID NO: 4923 - DNA, 760 bp, Homo sapiens
agaggagactcgggggccattttgtgaagagacgaagactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacaggtgttttttttttaattgtttccaaaaccgggacctggatttaagatgtaatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacactgcagcaacatggatgcccagcctggagcagcagcagccaggatgacctggagccaggggggccttcggaacagatgcacacccttcctgggtga

SEQ ID NO: 4924 - DNA, 20397 bp, Homo sapiens
atggggttttccaaacagttcttcacattctattaggacttctatggctacagatatgtgtgtgttttcagcattaactgtgattttttgttgttgttactgttttgttttgttttttttgagacggagtctcactctgtcacccaggctggagtgcagtggcgtgatctcagctcactgcaacctctacctaccgagttcaagcaattctcctgcctcagcctccagagtagctggtattacaggtgcccaccactacgcccagctaattttttgtatttttagtagagacagggtttcaccatgttggccaggctggtcttgaactcctgacctcgtgattcgcccacctcggcctcccaaaatgctgggattacaggcgtgagccaccgcgccctgcattggttaccttttatggttggcactggatggatggatggccatttatggtagtgatgcaacatttctctcaaaataaatttaagtcagtttaaaagtaagccaggccgggcacggtggctcacgcttgtaatcccagcagtttgggaggctgaggcaggtggaacacctgaggtcaggagttcaagaccagcctgaccaacatggagaaaccccgtctctactaaaaatacaaaattagccaggtgtggtggcgcatgaacgtaatcccagctactcgggaagctgaggcaggagaatcgcttgaacccaggaggcagaggttgcggtgagccaagatcgtgccattgcactccagcctgggcaacaaaagcgaaactctgtctcaaaataaataaataaaagtaagccaatttgaagaggtgattaagtacataattgtaaaggtggttgatgaatatgccaaaaactgtgaagatgggatgaagatgaccaaagtctatcagcagttcttaaagtaagacctggggacccctgtgaacacgtgataccctttcagaggtctcacacccagctaattttgcatttttagtagagatgggctttcgccatgttggccaggctggtctcgaactcctggcctcaggtgatctgaccatcttggcctcccaaagtgctggtgtacacgagccactgcagctggccagttattttttaagttttttaaaaaatttttaattttaatttttgtgggtacatagtaggcatatatatttattattgttatttttaaatgaattaatattttgaaattttcacactttaaatttctaaaatggtaaatatagataaagaaaatccagatgattaaaaaatctttgtgatcctcaataatttttcagagtataaagggatcaaataggccaaaaaacttgagaactgctgagttagatcattccaagggcccacccagtgctaaaaatgtccacagtttcaaaaatgaaactatttatagtttcagccttttgggcaacaacatctcttccaagttttgacctttggtataaaacaggatgtctctgaatgtgtcctgaatcagcttttagagtcccgggggtctctcatgttctgtcactgagactcagtaaacagacttctgtacatacggtattgctatagaaaacgtgcacacggtggggcgcggtggctcacgcctgtaatcccagcactttggggtgccaaggcgggtggatcatgaggtcaggagtttgagaccagcctggccaacacaggagttcgagaccagcctggccaacgtggtgaaaccccgtctctactaaaaatacaaaaattagctgggcatggtggcacgtgcctgcagtcccagctacttgggaggctgaggcaggagaatcgcttgaacctgggaggcggaggttgtggtgagccgagatcgcgccactgcactccagcctgggcgacagtgcgagactccatctcgaaaaaaaagaatacatgcacacacatatgtctgtaacacagtaacgtcctcctctgctaggtttaatatgttcatactctagatgtgtaaccagacagtaagggctttgagggcaggaactgtgttctataataaaccaacgaatatgcctggcacctgccacaggctgctgggctgcacactcaggctttgcctgccaggatcttacagcctcccagggaagatgagagcaacacgcggaccagtgaagggaagcaggatgctcactcgggccaggtactgcgtgtgtcacttagacattctgtagagggtgaccaagtgtccaccataacttttccacaactcttccagataagtattgacaccaccattttccagatgaggaaatcgaggctgacaggtgacatggcttgctcagggccagtctatggccagagctgtcatttttccctctcgtgccatgcaagtgccaaatgggggcacaggtggaaaaggtaccacagcacacaggaggtggtgttattttgggctgagagggggacttggaaggcttcctgagggaggagtcagggtctgaactgagctttgggtgggaagatgatttggagcagctgacgataggagggagacagtggggaggagggctccagtccggacagccctcctgcattcccaccggggccccacagggcaggacacgcggtcctgggctcaccgacatggccaggtgcagcggggtgttgccgtgctctccgcgggcatccgcgttggccccgtgggtcagcagcactatggcacagtcgaagcggttgcgcatcaccgccacgtgcagggccgtgttccccgcggagctggtgctgttcacgttgcagccccgtttcagcagcatgcgggccatctgcgggagacggtcaggctgagttagcacaggcactcggggagctgccgcaccccgggacacgtgggcactgccacttctgctctgagaggcctacaggtactgggatgttggaaagcgctagcaagaggattccaggggcaggccccagttctaggggggcctagactgcctcccatcccatcagcatcccaagactagggacaaaaagccaaagatgtgctgactgttttaagaggcttctggtcctttcctagtgccaacagaacccactctccttgcaaaggctcctctggggcctgtcctgaagcaccccgctccctgcatccctccctggaaccctgcaaaggtatcacctctcactgggccttggcaatgcacatccctggcagagccttgggaacagggaggggagcctggctttggagtcacagacctgagcccaaagcccagcttcactcatcccagctgcctgcgcttggatgggtcactgtagccatgtgcacttcagggcttctgtgaagatgggaatgcaagtccccacctcacagcatgtgatgacaatgagtgaccaaacctacacggaagggcctgactcggtgtccggctcctggaatgcagaggtaccctgaggctggcagtgccctccctcctggcccatcacattgagaagtaggccatgaactctggggcatcccattctctgtcaagctgtgcttcctggtgatgagaccagaggcctccatcctcccaggaggacagagcttagcttaggggaagaactcagaggagatgcccagccaggctccctgtgtgtgcagctaggcccagcaccaccaccaccaccatcatcatccatcatcatcatcatcatcttgatggttaataatgagtgtcaacttgattggattgaaggatgtaaagtattgaccctgggtgtgtctgagagggtgctgctaacggagattaacatttgagtcagtaggggaaggcagacctacccttaatctgggtgggcaccatctaatcagctgccagcacggccagaatataaagcaggcagaaaaaaatgtgaaaaggctagactggcttagcctcccagcctacatctttctcccgtgctggatgcttcctgccctcaaacatcagactccaagtccttcagctctgggacttggactggcttccttgctcctcagcttgcgatggcctattgtgggaccttgtgatcgtgtgagttaatgctccttaataaatccccctttaggccaggcacggtggctcacgcctataatcccagcactttgggaggccaaggcaggcagatcacgaggtcaggagatcgagaccatcctggctaacacggtgaaacctcgtctctactaaaaatacaaaaaaattagccgggtgtggtggcgggcgcctgtagtcccagctactcaggaggctgaggcaggagaatggcatgaacctgggaggcagagcttgcagtgagccaagattgtgccactgcactccagcctgggcgacagagcgagactccgtctcaaaaaaaataaaataaaaaaataaacccccctctctctctatatatatatctcctgttagttctggccctctagagaatcctgactaataatacaatcatcatcacgccaccttctatttgggaagcactttacaatttgtgccgagttttgtcacacactgccttgctgacttcatcacatcgccaaagcagaattcatggatgaggaaactgaggcacagggcggatccccccgcccagccagagagcagcagagccctgccaggatcccagctcttcatggacttctctgcctgcacacccactgcaaggtcagcccccaagtgctagcctcagggtcctctcgggaacctgcttcctgagggccctgaggacctgcggggcccggccccctgccccacccacccacctcaggatccactcacctctgcgttcttggcccagtggagggggctggctccgtaacgggggtctttgctgtggatctggctgctgtccatgctgatgatcatctccgcacacctggtgagagaggggccccggttggtgagcagaagctagggtctgcgtggcgtgggatgaagccaggacttggagcttcatctactgcttacagagagcatcactgcaaacaaagttcagcaaacccaaccagcacactcaccatggttaaggctgtactgagcccctcaaggcacaactaaccccctcctccaggaagccttcctgatgctgccaccagcaatgatcaccctccctggtactggctttagagtcagatgggcttgaagtcaagccccagcttcctcactggtggcctccagaagctgagcaacatggagagagtgctgagaggagtggctggggtgtaaggaagaccaggcatttcagagcccagttctgtgcctggcacacagccaccctccacctccttaccacactgtcagtgagtcacacagtgacctgcatgctataggaagcagtatgacagagtgggaaagagcacaattgctttctactcggtgcctgaggcaagcagtgtccaccagagatcttagcatctccagcctcagagcagaggccccgggttcacaagcctcattaggccccgcctggcccaaagaaagtgctccatcattgtatcatgggtaggaatctcggttcacaagttcagctgtgcaaggagaagactttaaaatttttctggctgggcgcggtgtctcacgcctgtaatcccaacactttgggaggctgaggcaggcggatcacctgaggtcggaagtatcaaaggacggaatgcagggacttgaatggacatttgcagacccatgtacacagcagcattcttcacaacagacaaaaggtggaaacaacccaggcgtctatcagtgaaggactgaatggataaacaaaatagtattctgccttaaaaagaaaggaaattctgatacgtgctgcaacatggatgagccttgaagacatcatgctaagtgaaataagccaggcacaaaaggacaaacgctgtatgatttcactgatacgaggttctagaacaggcaagttctgagagacagagaggatatgggacttatcgggggctgtggggaggggagaatcgggagttattaatggttacagtttctgtttgaggtgataagaaaagttttagaaaggggtaatggttggacaacattgtaaatgtgattaaaaccaccgaattgtacacttaaaagtggttaaaatgggccgggtgtggtggctcacgcctgtaatcccagcactttgggaggccaaggtgggtggatcacctgaggtcgggagttcgagaccagcctgaccaacatggagaaaccctgtctctactaaaaaatacaaaattaactgggcatggtggtgcatgcctgtaatcccagctactactcgggaggctgaggcaggagaatcacttgaacccgggaggtggaggtaacggtaagccgagatcacaccattgcactccagcctgagcaacgagagcgaaactctgtctcaaaaacaaaaaacaaaagtggttaaaatggcaaattttatgttatatataatctatcacagttggaaaaaataaacataatatatcagaatcattgtatactttcaataggtggattgtatggaataggaactatatctcaataaagcttttttttttttttttttttagtgcaattactaggacagcccacatgggtttaattcccaggtctggcacttactgactgcctgactttgagcaaattacttaatctctctaagccctggtttcctcatctgttttttgtttgtttgtttgagacaggatttccctttgtcacccaggctggagggcaatggcatgatcatagctcactgtagcctcaaactcctaggctcaagcgatcctcctgcctcagcctcccaaagtgctgggattagaggcatgagccaccacacttggccctcagctttagagggggaataaaatacatcagctctctgggctatagtgaaatagcccacatgaaggctaagccggtggctgggacagcgttagtgttcagctgctgttctctattattaggggtgcccagcacaggcccaggatttatgctgcccagctccctacagcccttatgccagcgcttggtgctcagcactaggcacatggagtcaggcccagcttctttccctgggccctctggagccccccaagtcttcacccgagtggccagctccggctagtgtccatggcttggctcgggctctgctgcccccaaaccttccctgaactccagctgcctgatgccgtctctgagctcctagtgcagcccccaggcatcctcagtctcagcctccatctcactgtctgggattatctgtttcccttcctcagcaggggcttaaccatctgagaaccgcaggcacaaaccgagctttgtgggaaaggtcagctgcattgaaaaacagcagaggtggccaggcgcggtggctcacgcctgtaatcccagcatgttgggagggcgaggcaagtagatcacctgaggtcaggagttcaagactagcctggtcaacatgatgaaaccccatctctactaaaaatacaaaaattagctgggcatagtggcgcacacctgtaatcccagctccttgggaggctgaggcaggagaatcagttgaacctgggaggcagaggttgcagtgagccaagatcatgccattgcactccagcctgggtgacagagtgaaactctgtctcaaaaacaaaacaaagaaaagaaaagaaaaagaaaaacagcgagggagctcctagtctgagctgtgagggaaccacttgtcagtaacactgaggccgtgggattcttggagtagggctgtgctggctgccaagtcgataagggatctccctgctccactcaaggtaggagcctcttcctttgtcttctgtgcaaagatcctcttatgtgatgggacgctggacccacccaggatggcctgtgtggggacagagggaccggtgagggctgaggttgtttgaagagagagaaaactggtcaattacagctcctgcccagtacagctcagggtggctggagacaagcaagagtggggccatgtgccagccctctgggtagagaagagcatcacctggtgtccactcaggtcacaacctgcaaatggggaacctgactgcggggctgggggtgttggtatcttctctgtttggtcaagtatttctgaaagctctagctcattctggctgtgcttgggagattcaaggaaaggagggtttgtccaggcttggtccagcccttagaagggctagcaatgccccatggggctagcaaggtggatgcagctcccagaggaaggaacaacctgaggacaggcacaagtgccagcctccctgcctgagtgctgcccgtccatgccttctcactgcttgtctggcactgcgctatgagattctgggtggctggggtgtctcctgtcctggagtggcttattcatttcggtgaggctggtgctttagcacagtgccaggatcgaaggactcattggctcattcattcattctagatgttgttcctgttagatagtattttttttcttgagatggagtcttgttctgtcgccctggctggagtgctgtggcacaatctcaaatcactgcaacctctgcctcccagtttcaaacaattctcctgtctcagcctcctgagtagctgggactacaggcacacaccaccacacctggctaatttttgtatttttagtagagacagggtttcaccatattggtcaggctggtctcgaactcctgacttcaggtgatccacccaccttggcctcccaaactgctgggattacaggtgtgagccaccgcgcctggcctagatagtattttgagatttgagatattcatttatctttttatctcatcccctacccctttgaagacaattttcctgacaccaggggttcccaggctcccaaaacatgagcctgtacctgcctcccaacgtgccaccagccagaaaggaaagaggcatctaggtggacgggcactcggccaccttaccaagcatttcccaggctttgagctgggcacacaagaaaccaaggagcactgaagccatcggggggctgttcagatcaggctgggctgggttagaggaggggccaggtgggccttggggttgcatcagactccagaactggagcaccacctggaggggagctggaaagaggagaccccaaagagggctaagattggttgtctccagttttatagagggagattcactcctaggaattaaggtacattaaataaatttatttttatttatttatttatttatttatttatttattttttgagacagtttcgctcttattgcccaggctggagtgcaacggtgcgatctcggctcactgcaacctccgcctcccgggttcaaccgattctcctgcctcagccttccaagtagctgggattacaggcatgtgtcaccacgcccagctaattttgtattttttagtagagatggggtttcttcatgttggtcaggctggtctcgaactcccgacctcaggtgatctgcccacctcagcctcccaaagtgttgggattacaggcgtgagacaccgcgcccagccagaaaaattttaaagtctcctccttgcacagctgaacttgtgaaccgagattcctacccatgatacaatgatggagcaccttctttgggccaggcggggcctaatgaggcttgtgaacccggggcctctgctctgaggctggagatgctaagatctatggtggatactgcttgcctcaggcacgggacaggtgacaggagagctggagcccagcaggccagcagatggggaggggaggaggtcttaccccttctgagagaacttcatggccgagtggatggggtagccgttggggcccatgatgttgcaccgagcattgcacagcagcagcacgcggaccatctcctgcttccccagctggcaggccaggtgcagcggggtcagcccttggttattcacctggttcaggccagccactgcgttccttccaaggagctgatgaaagaggaagggaagtttgactccataggatgctgataagaacgtaaagaggccgggcgcagtggctcatgcctgtaatcctagcactttgggaggccaaggtgggtggatcacctgaggtcaagagtttgagaccagcctggccaacatggtgaaatgtcgtctcttctaacgatacaaaaattagccgggcatggtggcaggcacctgtaatcccagctactcaggaacctgaggaaagagaatcgcttgaacccaggaggcagaggttgcagtgagctgagattgcatcattgcactctagcctgggcaatagagcaaaaactctgtctaaaaaaaaagaacgtaaagagaagcaccaggaaagccaagtgccagtgtggatgggagggaaggggtcgacctggcatgactgtggctcacatgaaacatttctgagtcaaggaacttaaaaggtagctgtatctcaggatgggcactgggggtccaggtgggaatgattcttgcttttcattctgtcctgactgatttttttctacatgcaggtactatgttttcaatgaaagaacagcagtattaaaaagagagccaggggccaggcgcagtggctcatgcttgtaattccaacacactgggaggtgagaggatcacttgagaccaagagtgtgataccagcctcggcaacatagggagaccccatctttaccaaaaaaattttaaaaattagctggcgtggcctgggtgtggtggctcacgcctgtaatcccagcactttgggaggccgaggcaggcggatcacaaggtcaggagaccaagaccatcctggcgaacacggtgaaaccctgtctctactaaaaatacaaaaaaaattagccgggtgtggtggcgggcgcctgtagtcccagctactctggaggctgaggcaggaggatggcatgaacccgggaggcagagcttgcagtgagccaagatcgcgccactgcactccagcctgggcgacagagcaagactccgtctcaaaaaaaaaaaaaattagcccatgtggtggcacgagcctgtagtcccagctgctcaggaggctgaggtgggaggatcacctgagtccaggaggttgaggctgcagtgagccacaatcacaccactgcactccagcctgggcgacagagctagatgctgtctcaaaaaaaagaaagtgctaggagggttttactgtctcacttttggctcagtgctgtccccatgaggttcattacaaccacagtgtacccatgtgacaccagggtcacctcacagcagtcccactggacctgaaggcaggccagagacacagcaggaagagcaaagggctggcatcgaggccaatgtaaggtcaagccccactctctcagctttgtggccctccctgggcacgcttcttaattaacaacactgaacctcagtttcttcggagaggaaaggggaataatgacctccaccccatgagtgtattctaagaattaactggaacacatacaacactcagttcaaggtcaggcaccaatcagcaccggataaaggacagctgcagtcgtgcatgactatcgagaagcgggtgtgcacacccccgcatggaggcagggtctgcgcggcaccatgctgggtgcgcagaggattctcggtgaaagtggagttcaacagtgggtggagaattcccttccctgagagcaagaagcataagatatgaatccacattttctgggccgggcacagtggctcacacctgtaatcccggcattttgggaggctgaggcaggtggatcacttaaggccaggagttggagaccagcctgggcaacatggcaaaaccccatccctactaaaaatacggaaactacccaggcatggtggcacatgcctgtaatcccagctactcaggaagctgaggcacgagcatcacttcaacccaggaggtggaggttgcagtgagccgagatcgcaccactgcactctagcctgggagacatagggaaactctgtctcaaaaaaaaaaaaaaaaaaaaaaaaaaaggaatccacattttctggtataacgtagttgcattctgatgccaaggcagagagaacatgatctttagaagaattttctaattctagacaataaaacataatccaacatcctgccttttctgttcaatctaatatatgaaatagctatttaatagtatcaccccatctgcttgcccacaattaaaaaatcacatcttttgcccaggtaatcaaaaacgttaacaggagggcctctggcacaaatgcctacaggaactggagacagtttggtttgcttggtttgaattcctgtaaaatagggttgtccaatattttggcctccctgggccacatcagaagaattgtcttgggtcacacataaaatacatgaacgctaacaacagctgatctaaaaaaaaggtccatgcatggatctcataatgttttaagaaagtttgtgaatttgtgttgggccacattcaaagccgtcctgggctgcatgcagcctgcagggccacagattggacaagcttgcaaaaggttaagcccaggtcccgctggcccacgagcccctccaggcaggcatctggctcacagtttgtgctcaggaaaagtggaactgaactaactgactggagctgggccttttttggggtttattttgctgggttggaggccgtccccaggtttatcaagcaaagagactgaggacgtggctcctggaaaagggctgggagggaagagccagggaggggtctgcaccctccatgaaggagctcaggcctcaaggaccaatgggggacagtgagaggcctgagagtgacacctgagcctaggggcccaaagggaaccgtggacaccgggaggtatcagtaccagtcaccctgcccctccccctgctcacctgcagcacctgagaattgtcaccctggacagcataatggaagacggtctctcccttgtagtcggtgacatccatctgagtgtggcagtactgcaccagctccaccaggatctccccatcacccttgcggcaggccaggtgcaggggtgtgcagccctcctcgttctccgcgcaattggcacagctgcaggagagggccagggtgagcagaggtgagcaggtgtggtacaaggtggcagggggacctaagtgcacatgcagggaagtgcactcggaaactcggactttctggtttatttgagctcaagagcattcccgccactcagctagttgggctgatttgaatgtaattatatctgatgtgacctgtatcaggtttctgttcagtttgctcactcgtacaagagatgggccccagggccacaccagcaggaagtgggcagggtggtggcacaggaaagggtcacagaacacggatatctcactagcctcaggcaattcacttaacctttctgggcgtcaatatccttatcgacacaagctgctgtgcctgccccaggaaatggacagagtgatggtgagatgagacagtgctgtccaaaagcacgcctggaaactaaagtgcagtgagggtttttgttttgttttgtttttttgaggtggagtttcactcttgttgcccaggctgtaatgcagtgacacaatctcggctcactgcaacctccgcctctgggttcaagcaattctcctgcctcagcctcccgagtagctgggattacaggcgtgcgccaccacgccttgctaattttttgtatttttagtagagacggggtttcaccacgttggccaggctggtctcaaactcctgacctcaagtgatacacccgcctcggcctcacaaagtgctgggattacaggtgtgagccaccacgcccggccagcagtgaggttttgagttctgggcctgggagcttaactgagctatctaggatagagactcagaggaggtgtggctacctctgcacaagatggccaactggtgccctgtgcaagggtggggacagtgccctcaccaggggcaacagctgctccatctgctggctgaatggattcacaaaaggaggccttcagcttccagaagagcagcctgggcagacaccaaggatccaagcccctctttcaccctctctggctgagtgacctgcacaagtcctgttagctctctctagaatgatgatacctgggccgggcatggtggctcacgcctgtaatcccggcactttgggaggccaaggagggcagatcacctgaggttaggagttcgagaccaacctggccaacatggtgaaaccccgtctctactaaaaaacacaaaaaaattagccgggcgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaattacccgggcatgatggcacattactgtaatcccagctattccggaggctgaggcaggagaatcacctgaacccaggaggcagagggtgcagtgagccaagatcgcgccactgcactccagcctgggtgacagaataagactccgtctcaaaataaaataacataacgtaacataaaataaaataaaataaaataaaataaaataaaataaaataaagtaaaataaaatgacgataccttgtgggggttgggaaaattcaatttcatggtgggtagaaatcagctcccacagacctggcacctggtgagcactccggactctggaaacattacattgtccttcttacattttaatctggtagcaacgcagcacctttttttttttttttttttttttcctagagacaaggtctcattctgtcacccaggctgaagtgcagtggtgcaatcatagctcactgtaaactctaactcctgggctcaagcaatcctcctgcctcagcatcccaagtagctaggagtatagacacatgctaattttttaattttttcgtagagacaaggtcttgctattttgccaggctggtcttgaactcctagtctcaagtgatcctccctcctcagcctcccaaagtgctgggactgcgttagtgagcgaccatgccaggccctgctcctttttaagtcaaactatggaggggaaccgaggcctgcggcccccactgcccacacaagcaggtacacacacgttgtccaaatggtcttgttcccttgctcacctgatgatacggctgtgatggaagcactcgcggatccctagctccacagccaggtgggccactgaccagctggggtggttacggatgaggtcggtcaggtgctgcaggacctcagtgtgcaggacctgaggggagctctcatagaagggtagcagctgggaagaatactgatggaaattcactagggcgtcagcctccaactccagctggaagagtctgtagagccaggacagaggagcaagacccgaaatgagtaaggcgggaccctcggcccacatccctgctggaatcagaaggtccccaggctgcggcctggccagctccagcccgactcccctcccaagcaaacacacacacacacacacacacacacacacacacacacacacacacacacccctatacacatgtaaatgacataatggcgtttaggttagactttctttgttttttagagacaaggtcttgctctgtaacccaggctggggtgcggtggtgtgatcatgactcactgcatcttcgaattcctgggctgaagggatcctcctaccttagttcctgagtagctgggattacaggcatgcaccaccatgcccagctaattttttttttttttgagatagagtctcattttgtcacccaggctggagtgcagtgttgtaatctcacctcactgcgaccttcacctcccgggttcaagcaattctcctacctcagtctccagagtagctgggattaaaggcgtgtgctgccacacctggctaattttttgtgtttttagtagagatggggtttggccatgttgcccaggctggtctcgaactcctgagctcaggcaatccacccccctcagcctctcaaagtgctaggatttcaggcactagccaccgtgagccactgtgcctggcctaatttttttttatttttgttgacagggggtcttgctatgttgcccaggctggtcttgaactcctggcctcaagtgttcctcctgcctcagcctccaaaagtactgggattacaggtgtgagccactatgcttgtctagattttcctttattttgaaaaactttccttttctttggtaatatcatttattatttttatattttattttaccacagccctgccatatccactttctaatttcattgccacatgtgagagctccagcctcgagtacttggcccctcttcatagtaggaactaagtaagtattgtttaacctaaatgtacagcaacaaaatattatataaattatggtataactatgtaataaactattatgcagtcattaaaatgagatatttaaaaaaagggaaacttttctttttcttttcttttcttttttttttttttgagatggagtttcattcttgttgcccaggctggagtacaatggcacgatctcggctcactgcagcctccatctcccaggttcaagtgattctcctgcctcagcctcctgagtagctgggattacaggcacccgccaccatgcccggctaattttttgtatttttagaagagacagagttttgtcatgttggccaggctgatcttaaactcctggcctcaggtgacctgcctgcctgggcctcccaaagtgctaggattacaggcatgagccactgcgcccggccagctttgttcatttttaagtgttgaggttgagtccaagttttgctactaaggtgctgtgtgatcttgggaaatccttttccctctctgagccccatttgaaacatgagactaactgtacctgtcctacctacctcccagaggtgctgtgaggacagatgaaaaaccactataaaagcactttcaaaaccataaccattatatgtcagtgatggttacttaaagttctgaccagggcttttaacataccaaaaggttttgtcttgcatacctctacaagcgcagcagccagccagagtctagtgaaggcagtgcccagagagtgttggctcaacgggaccagcctgttgttccacagagagtgcgttgattaacagttaactactgggcatgtgatctgtgccaaatggaggggtcaattaatgaacaattgcataaaatgctctgccctcctgaagccttttttttttttttttttttgagacagagtctcactctgttacccaggctggagtgcagtggcgcgatctcagctcactgcaacctctgccccctgggttcaagtgattctcctgcaattctcctgcttcagcctccctagtagctgggattacaggcgcttgctaccacgcccagctaatttttgtatttttagtaggcacagggtttcgccatgttggccaggctggtctcgaactcctcacctcaagtgatccacccatcttggtctcccaaagtgctgggattacaggcgtgagccactgtgcttggcccgagcctatgttattatggaggagatcaacaaaatgactaaagtaaaaacatagaataaggaagtacattaaataaactataacgtaatcagtgttacagaaacaacaaaaaccacaacaaagatagggaaggaggaggcggaaggaagccattcctcattgcccttggctgggtttttccttcatctcaccagcctctcaacatcagggtactccacatcaagtgttgccgatatgtcagagaatgacaactgaaaactcatcactggaattagcatcacggaggcatgcacgaccttgacaacattacttttagtggaatggagggaaccaaggcctgattaaagtgggtttaaggacacaatgtgagaatctgaagattgcaaagatagatatttttgaggagttttgctgtggtgaggagcaaataaaggaaaggatagcgaatggggaaagtgtaatcaggcatttgaatgctgacgggaacgatgattctctctcagaacttccactttccattaacagcagactagggaatgtgaaacagaccacctactgaggacagccagaaatgctggacaaattattaaaaaacatctgctggcaggcactggatacctcaaaagacactgatgactcaccaggctggaaggaatgatggaaacccaggaattgcagtgttcaggtggctgttactggagaggatgggcagacgagcagcaccagtaacagcctcatggggctcaggacacagggactggagcccaggcgtctgccaagaggagagccctgatgaacatctcttactttgggttagggtcctaaagaactacgtagcctaggaataagggtgagccatacacagacacgctctcacagagaccacagttcagcctcaagtgatttcagttccagaaactagactgaggttatcctagttgcaatgggagaagcaaaaataaattcattctttgtaaggaaacatcaaactaggctctagattatttctttttttttttttttttttttttttgagacggagtctcgctctgtcacccaggctggagtgcagtggcgtgatctcggctcactgcaacctctgcctcctggttcaagtgattctcctgcctcagcctcccgagtagcagggattacaggaacgtgccaccatgctcagctaattttttgtatttttagtagagatggggtttcaccatgttagccaggatggtcttgatctcctgatctcgtgatccacctgcctcagcctcccaaagtgctgggattacaggcatgagccactgcgcccggccattccagattatttctacgagcatacttgcaaatacaatgaccaacacataatcaaaactcaccaggcatatgtggagataagacatgaaagaaaaccaacagaaacaatatacaaaagaaacatatctgtgaggggactgtaaatatttaagttatccaaaatagactttaaagtaactgtgataacattcgagaggttaaaaaaggaaatttagaattttggtgaagagttttgaatgatcaaaaaagcatcaaatggaaattacaaaattaaaaaatataatcaggaaagagtaaacagaataaagcatggagagacagaagaatacaaaatatagtagagtacataagagacacagactatctaataaaagatctagcatacatacataagtggaggatcagaggcagagtagaaaaagaatcaaatggaagctacatttgaaaagttaatgtctgcaaactttccaaaactgatttttaaaaaacattataggtcaggcacagtggctcatacctgtaatcccaccactttgggaggccaaggtgggtggatcacctgaggtcaggaattccagactagccatggcgaaaccccatgtctactaaaaatataaaaattagccgggcgtggcggtgggtgcctataatcccagctacttgggaggctaaggcaggggaattgcttgaaccagcggggcggaggttgcagtgagccgagatcacgctacttcactccagcttaggcaaaagagtgaaactccatctctgatcacgctacttcactccagcttaggcaaaagagtgaaactccatctccaaataaataaataaaattattctgctgatttaacataccctataagccctccctgaccccaccaccaaaaaaaaaaaaaaaaacacatagaaaaaaacaaaaaacaagaaagccccagaaatccacgcttagcaccttgtaggggttttaaaacagggccccctaaaatcactgatattccttgcactgagcagtgggaatttgtatctctttaccctttaatctggcgatgtaactgcgttaccaacagaatatggcaaaagtgatgccgtcccagcttccagaccaatgccttaagagactggaagtttctatttctcttctcttgggacccagccatcatgcctcaaggaggctgaagcaagccatggtgacgactcttggtcctgggccctgagccctgaatgaactaccagccaacagccagcaccaacttgccagttgcgagttaccttatatggtgccatataaagtaaagctgaggctttcccactgagctctgctcaaattgcagatttaaggactaaataaatgattccttttataagccactgtgttctggagtagtttgttacacagcaataactgataatgatacatatgttgcacaatatgtattgtatgtaa

SEQ ID NO: 4925 - DNA, 4587 bp, Homo sapiens
aaaaagtgaacaaggaacagcaggtgaggcactggctctgggcaactttcagacgggggcttcaagatgatctggaggtttcagaggattgtcactttagagaaaaaagtagcagacttggtctccaaagactggtgactccaaggtgtggctcaacacccagctgaagaggcagtcaatgcgaacggcatcagcccatgaaccgagtgtgtcctacgtgctggcgctgcgctctcccaccagctgctccaggcaggcactcccatccattttccgatgaggaggtggatgtttggaggcagagagtccatgctgagagcctgctgcagacacgtttgaaaggtggaccccagcccttgtcccagaatgtctcttccgtggctgggtctgccccagaggaacagaagcaatggcctggcgtctgtttccagctctgctccttccttgaggcttctggcggctgtgatcaaaaggcagccctcactggggggagtacgcaacatcttcaatgacctaagagctcctagtaaatgggaaccagtcacttgactcgaagactgaggaccacaaagaaggcagcatgcttcactgggacttgcaggctgccgctccagtccctctgcagctgcacaagcaggaaccagtcttttgggtaagaaactctcctttccctaagaactggtgttaactgttgttaaaggtcagagagagcactgtggcctccaccctccctgggcacttggtaggtacacaagtaagctccgctcaccacagtgcccaaaccacatcttgctcggggtatacaaaagccaggaacactgacattaggtaatatcacccaagggataaaggaagaggcatgtgaaccagtagccgcctgaagtgctgaagtgtgtgctatactcactgtaaggttttccaattctagctgtcgcactgtataatatgacttgatatcttcagagatcaatgttaatttcaaatttgtgtcttcaaagatcatctctttttcttctttttgtggccagtattgtgcgcattttaactggggaaacaaataatagtgaattattgtgagcaatatggcagtttttctatggcaggaggcttggagcacatcccacaagcttcatgataactcaaaggcctgggggtttctgaacatggaagccatggtcagcacagatgcctgcctcatggggagatgggggtgggggcacgaagctgctgaccggggcaggttgtgcagacagggctcagacttccaaacccatcggctccccggtcaaacgtggcaacgggatcctgcagggctctgacgctttctcaccgtctacgaggtgaagccagattgaacaaaaggctttgaaactcctctgtgtagccatttcaaacattacccaggacctgatcaggctgctggcatagaatgtaggtgccttaccctgcacagaaaactcacaggcaattaaaaataaaactgggagagacagcaggtgaggccctttggagaggctgagcagttatcaccaaatacagactccctttcagagaaggcttggagacaggctccccagggcttgccctttcattctggtttggttcagttcattcagaaaaatacttttgatgttctattttgataatctcagacactatctgatgttctcagtttaaatgtagctcattaaatttttctttaaaacaagaaaatttatgaaaatttggtttcatttagggtctaagacaaaaactgactcgaatttagtgacattttacttgaactaagtttctgcctcagttacacaaatgtttctgctcatggataactgttgtggacaaaaatggcaggtcagcaggggcagagctaccgggtcagcctgaccatgtgcctggacagagggaagctcaaagcccttatgattttcagcaaaagaaatgtcagcgtgtgtcaacagctctttggcaaatgacactggcagttcacgtgcactgacccactcaatacctcctctggggcaaaggatggtgtgggtgaagggaaccacttcagggccagctgtctgtcagaagacactgctgtgcccagcagtgacaaggtggactatgggggagggctgagggggaaatgctacggacatgcagcaggaattcagaagagggaaatgtttcaggtcagccaaggttacagaaaagagagatcagagaaagctctgtgcaagaggcaggttttgaaggatgactaggatttcctaggcagtgactgcaaataagaggctgaaaagagcagctggagaaggggccagcagaggcccagatcacagacgactggcagcaggcccagggacctgtggcatcatctgggggcaatgaggagccaggaagcacgtgaggagggtgaatatagaaccacaaatgcctattggtcctgctctactggagctggaagctgcccaaaagacaaaaccaaagcaaaatgtgggagaaacaaattaggaaacaccaggttgtggtgccagcatcacagcaaacttcacagtgccagaccagaagccaacagagctttctcaagagtctggacacaagcctgtctgaagtcttagccagtttcatccatgtcaccttcctggatcaatgatgagttgccaaaagtgaactcttgaatggggacaatctgtcaccattgaagcaattctgccacttggcatggaggcgctaattacatggcaagacccccacttagccaaagtgggtgtggcagctaaaagcaggaacttagaagaatgtgaaaagatgaattaatcccacacttctaacaactagatcttataatgcctcaagaccccagaaacaagagactgatctgacaggttccaccccacccgtgctggggtgggcattccacagagtgagcagacagagaaggaagcgaagaacagaaatgcaggaggaagaggccacccttcctcatctcataagcagggcagacgagtcttaaagctcacctccagacagcaagcactcactttcaaaaccaaacctaatgcttaataaccctctgtaatctgggtaaagactaagactttggaactgtacaagtgaggaattctgtcatgcaactaagtgtcaataacccaatatttatttttaaggactctcaggtgtctacagcaacaagctatgctctgtcatttccaatagaaatttttgttttaaacacacaaaatttttaaaaggcacaagatcacatttccagttaccctattacattgatatatacggccatgaaaagtagatggatttttattagaacacagtacttcaccaggcctcaaattgagtcctatcttgggctggtaccagaggaacatggcagtgccaacatgctagcatctctcatagttgctgtttccaccatgaaggcagatgttaaacagtccttggggccttcccaaacaagtgggcaagtggtgtttggaaaacctatgaaagacatctacagtaaccctgtgacgggtaatttggtttcgccaaaaattattaacacagagaactaagtaagtaattcttaacacagagaactaagtacgagagaaaaatgaattatatggaccctgtgatacaaaatgcagtgtcttgtgcatgaaagcacctgaaagcaaacggcagctttagtgaggatttcaggagggagatacgggtgagattctgcaatggccaattaaactcaccttgcttacttcccccttctaaacaacaatcccaacccttacgccatggtgcagcctacactgaggtgtctaaagtcaatccttaaacagaaccagtgagaactctagccatctggatgaccccagtctaacacacacaatcatcttctgcataactggtttccaggaagcccagggtcccaaaagataacaggcatgtttgccaaaaataagagggagcatcctacactatttggtgaaggaaggaaatcagaagacaagtatgcattaaatgaaaactccccaaaagctggttttaccacaagctgtgtggatcatttataattagattagctgagcaaataagatactgtaacttctcatgatttctcccagccagccctctgggagggataatgctgatacagaattgaaaatgttgatcccaaagaaactttaacaatctcaaaccatacattgcttttcatgccaatctgcacgcccaagtaatcctccagtggaatgggatacttaacaaaggaaagcagggactgctggcacagttatcacagtaaactacagcaaagccaaccagccatgttctcgatgccaccacagtaacccaaagggaaaggttgtcacagtggatctgtgggccatttgtggtcagtcttgagtgggagacaatgaagcacagggcctggtgaggctggaacacataactacagcactggacactgctcaaatacataactacagcgctggacaccactccttgctgtaatgtgacaacaattgctaaagcaaaccttgtgctcacagcaaagaggttttgccaaacacttagcaacaaagaaataaataagaagcaaatgct

SEQ ID NO: 4926 - DNA, 1679 bp, Homo sapiens
ctccttccctgccacacaatggtttcttcccatggccccagcccaaagcaatgactcaggacaattccacaggcagggcagggctccttcctcaaggcagatcagttaccatggggacgggctcagcaacagccagggacaggaagaaggatcccagccactcagggtccgggtcctgctccacccctcccactccgccaaacagatcagactcaggaaacaaggccagccagttctctgggcagttcctgctggtcactgctttaatcagttgatgtggtaaggaaaggagtggtgctggtgccaccatgtggctggacactcagggcctcagccacactccacctcggggtcttccacatcggtttccgcggcacagaggtcatccagggctgcctctgagacaaaaaggagaggttcctggtgagggcccaaaggtgccagggcctagggcaggtcccacctctcctcccccaacgtccgcaggaactaaccagtcccttccacacccaggccctgctccctcagctactgcaaacaaagtgatacaaaggcaattcagacacggctatttctggaaaaaccgtggctctgccaggcacactcaacagatagatgcaaaaggcatcccaatatgcttggagaagaactgaggcaggaagataaaagaaaatggccccagtgctggaacaggctgcagtgggcgggggcctgctgaggggacacccaggaatctgacttgttggggaacctctggaagaagccatgggggctgggcaggatggcctctggcaggcttaccttcacagtccgtcacatcaggaagccctcggatgagcatgctgacccccggcatcacctggtcaaactgatgcaggacctccacgcagtgcatcatgaagagcttgtccttctgcgataggccgtgcagcagcagcaccgtgtcccgcagacagcgcactgtccgcctctgctggtcggtccttgggggtccccctgccctccgcactgtcagccactgtctgtgcaacatcaccgtgagcgctctgaccacctgagagagggggggtgcagactgaggcctggtgccaccatggcctgcaccctaacaatccgctcagcctagccacctcacgtgagggggtttgcagtggggcctacagtccttgcacggggcccccttaccaccagagctgccagctgttggcccctacccactcacctccacattacactggcagttggagccagtgactgggggcaaggggctctgcacaccaagcttagccaggagccacaccacctagaacaagaacagattggttccatcctgggcagaaggagaccagtccctgcgagggttttcttaagcttctataagagttcacttgcttcagcaactgtttgtctgcacaaatggggtccaagaagtggtgtgggaccttcccagggaagacccaggacaagcactcatgtgtcaccagcaacccacctgcctccagccccctattctgcccccacgtcccaaagccaagacaggatcagtcatcaggcaactctgccaagtcctgtctgcattgcatctgtgtggtgcacagcccccaaactgagtttacctctttagttgctttatcaactcttgttactaaaatgaattaaagctccgtttctcctcagcg

SEQ ID NO: 4927 - DNA, 3870 bp, Homo sapiens
agggcttgcctgtggagaggctggagtcagccgtcagcgcggaactcctggtcttcccactgccacctctgcagcccccaccagagatatcagaaaacatcagctccagcctgcagcccagacacttgaagtcaccttggctgcccctcctcacacccgtgcccacgtcagcaaaaccagggccggcttgttaaccgtgtccagaacccacccttcccaccctgcccaggccacctccctcagtggcccagggggctccaagttgaagagcccaagacaggtcagagatgggctgggcggcctctgccactcacctccggagagggcagggagcagaggcctcagtcatgaggtggggctgtcctcggcgtgggcctcgagactgggagccactgcccatacccaagagacctctgcgagcactggggtgcagagccagctctgagaaaccaggaggctgggattttgaagaggacgccggtaaacaggctcagctgtgggccaaggaacgcgaaggacacagggcagagcgcccacaggacggacgacgacaagcgacacgaggcccagcgctgccccctcccgcctcctgacagcccggaccagtctctgcagtgccagggccaccacacagatgcctcctccacacactctggtccgagggtttccgggccctctgcccaggcgccgaggctggagagctcctcccgggctacaactggtcactggcgtggtctctatccgcctcgggcttgacggtttggccaggagaaggggcgtggggcgggtgggccacagggggcaggccgtgggacagggacatggcgctggggacgataccttccacagcagctgggatgccagtgggggccacgcccaccacgcccggagggtacctgctgggagagggtccatccgtgaggcccacctgtaggcggcctggccaggccccacctgccctcctagcatcggcagcaccgagggggcctctccaggaggaccagcagtcagggccccgtgcccatggcactcctgtgtccactgagccctgaaggccaccccagcccaggctccttccaagaggccctggttctcatgggcctttcagctgcagatgtcagaggccgacctgagcacagccctttccagctgcagatgtcagaggccgacctgagcacagcccgttccagctgcagatgtgaaacctgaacctggcagcacggaagtcacaagggccgacccaacgcccccagaagtagagtcctgtgtccccggctccacgcacctgcttgacggtgaagtcgttgatgaggtggtggttgtgctcgttgaggccgcagtgcagggtcacgcagtcgctgtggaagagcaggtcctgcagggtgctgacacgctgcagccccagcgcccgctccacgccatccgacaagtaagggtcgtagaagagcacgttgaagccgaaggccttggcccgcagcgccactgcctgccccacgcgacctggtggcgtcaagacacagtgtgagacccttgctcacccgtggccgggaggccggccccgaaagccagggtcggagtggcctctgtgcctcagtttgaccatctgccaaggatgacaccagctgtggtcaagccaaggtgcccacgcacgctccacacgagcgctccacgtccgctccaacgcgcccactgccaaggcggaggagatgcacaggggtggaaagggtacactagcccctcggcccacaccagctgccagccacaccactcccctgcagcctgtccacaggacgtgacatgaaccactcagtgtcaaacggactggtcagtgggtctccacccacccaacacatgtcctccgtgcccaggcccctccgctggcctttcgatccacccatcaatgtttccggcatctcaattccagccaccactacgtggagacggcaaagggggcaggagggaaacttccagaccagggaggccccgctgggctcaggtcctgaccccttcgagtggagcggcagagaaagccatcccaggcagacgtgcctgcccccaccccagcagtccaaggctggcacgggtcccagcacaggagccgtggagcttgagccaccgtgtctggctggggccggctcctcctcggggaagggtctgcagagtgctcgtgcccactgtgagccaacagcatggctgcaaaggacacaggaccccaagcccgcgaacgtggtgtctcctgcattgcctcagagggaaccgctacacaggaaggaagcaggttgagcgccggggcgggtgggaagtgggcgcagtttcaaaggcggcagccagggcaggcctccctgagaagaccaagcttgctggagacataaggggacaggaagggagccagagagctggaacaacacgtgcgaggggcccgcggcggcctgagggccaaggagaccagaccgccaggcacacagggtggccggacgtggcccaaacgcccaggggacccccagtcactctgggaagaggactgggggaggctgggaggccagtcagaagagctgaggaccgtctaaacgcactacatcctagaaagggaggcgcctgttctacgagaaggaacatggtggctccttccatccccagggacgaggctgctgcaggagggaggagggctcggcaggcggaggtgggagcagcagttctgagggttgcagccacggccggagtacccgggcagctccccaggtgcagaacagcccgtctgtcaacgccccctgccagggatcccaccaaatggggaggaagagaacacaggcagacacagagaaaggcgtctcccacagcgcagaaggcggacgacacgctgtttcccactgcgcacaacacaaagccccggaagtcgggctgccggtggcgaaaaccagctaaagccgcgggccggcgccggccacgcctgacacgggagagcagcggctgttcggggcgagaccattcttcacttctgtctctgccattctcttccacatgatgtctggcttaggataagaaattatgatgatgcaggtgaagagacaggaggatgtagtttctaattagaacaaaacactggaagcggacagacgcacagatgaccgaggctggaatcagccagcaaaacctcttaataactactataaacatgctcagagatgacaacaagtgtggatgtaaacagcagaaaaatggaggcttccggaagatgaatggtaactctataaagaaccacatagaaattccagaacgaaaacatccctctgaaacggaactccctggacaaagctaactgcaagaaaaggatcgggagcttgaagggaggggctcaaagtcagcagatggcatccaaacagaagcagagagaaaagaatttaaaaaataaattttaaagaacaggccttggtggctgacgcctgtaatcccagcactctgggaggctgaggtgggcggatcacaaggtcaggagttcgagaccagcctggccaacatggtgaaaccccgtctctactaaaaatacaaaaattagccggacgtggtggcgggcgcctgtagtccaagctactcgggaggctgaggcaggagaatggcgtgaacctgggaagcagaggctgcagtgagccgagatcgcgccactgcactccagactgggcgacagagcgagactaccttccacaaaaaaaaaaaaggcaacacattttcggacaaagaaaagcaaaaggaatcggtcactggtgagccacatttctaagacagtctttaggctacaggaacgtgacgcccgaggacagccagaatcggggggcgtaaacaaggcagaaagggtggatgtgtcggttgatattc

SEQ ID NO: 4928 - DNA, 1414 bp, Homo sapiens
gctcagttagggctcttgccactccccatactggcccccatggcttgtctaaataggaccttgtttcaacttttctacttactgtgaccagccaacaggtgacatatttgtacagcacaaacttgccccagatcagcatgtacatgcagcggaaccagaaggggtggttcttgagggaagaaagcacagtgcattagggatatcacatgactaggcagtttctctcagcactcttccttttcacacttgtggctggctacttcatacctgcctgagtcctgctgccagatgccctcaatagtctggcctgattgccttcacaataggcagagaggaataagcagagggcctggagaatattcattcgcctttcccttggagagcctcaagggcagcactgtatttaacttctctactgtttgccttcgttggcaaagtgtttggaatgagcatttggaatgttaagtacagaggggcccatattggattttaatttaaggagagaaacctgcccagaattactgaactgttttcaagcctttcagctgggcaggagcaaaagccagcacttccccccttcccttggtttctgaattccctagaagtgcccaaatgtatcagtcaagagaagaaaataggatggagaatcagaagctgctgtgctctgaggggtcacgtggatgtgataaggcaagctaggagcggctcctagagaaggcaacgggtgctaaatgtgcacctggcacagccctgtgcccgcgaaggttgttcagtgctggctgatgaacatgtcccagcacggctggcattgacaactcacagatctagagcaaaaccaacatgcacttgtagatgatatttcctacttctctgctatctgtagggatccttgcctgtccattttctagctctggtgcagtcatgctgctgctgctttagtagacactcacgtcatagtcttcagtgaggagatagtcttctgtgatgtgggggctgagcagtgtgtagcccactaggtagaaaaggcccagactcaggcgcttgagagcaggaatgatgctggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttg

SEQ ID NO: 4929 - DNA, 696 bp, Homo sapiens
tatgtggataatatttatttgtatcttatctatagaacaaatatttacagatacaaacggaatcacagcaaagttgctataaaaccatccagacctctcgatggccacttctgaaaacatccacggtgaagggcagggccaggcctggctgtggagtgggccagctgagtacctgggcgtcagccaagggaaatggttggggattatggcttcagcactctgccggagcacattcctgagcgctgacaacgtggagccctcaccgcccccacctaccccaacctcaatggggaaggaaaggggcctgagctgggcagggctgcccgggctcactatgtgcctgctccaggagtccctggcccctgtgctggcaggagcatccctgagctggaccgggaggcctctctggcctggggctgctccctgcccggcaggctgctgtttggcagctggaggtggcaagagctgctggtgctgccagggcgtgttggccaggaatgagctcccagggcagccctgaggaaagggtcttaggaagcgcctcccagctcactactaggagctggggactgtcagtgctgagtggggctggggtacaggagcacctgcctctcctttctttggcttagaagtggggaaggaagggccaggaaaagggaccaaagccgccccagccttggcccctaggccgcctgg

SEQ ID NO: 4930 - DNA, 1141 bp, Homo sapiens
gtagtctggaacctgcggtttgtgcaggggtcggtggcagagacagggtctcactctgtcacccaggctggcacgatcaccgctccctgcagcctcgacctcccgggctcaagtgatcctcccacctcagcctctcgagtagctggaaccacaggcatgcaacaacatgctcgggctaatttttttaattttggaggatttttttgtagagatgtggtttcgctatgttgcccaggctggtctggaactcctgcactcaagcaatcctcctgcctcggcctcccaaagtgctgggattacaggcatgagccaccacacccagcaatttccatgaattttcaatagccgtgtgtgcctcacagctgctgtgttggtgggtaaatggcccccacacaccgcattccccatcgtacagtggagaaataatgacttaaagcagaactttctgagcccaggcggcgggtggtgtggattctgactctgctcagacactggactggacgggactggcttggtcctgggagaaggtgggcgagagctgtctatgagctgcaggtgctggaggcttccggatttacatctgcactgaaactgtggccacccgccccatggggctaccgaaatataaacagattcaaattaaacacaacctacacttcgaaattcagttatctgcttgcaccgtagccccgtggggctggcgtctcccatactgaatggtgtggagctgaaacgtctccactggagtttcacggggcaggcagttgtcagcccctgtggctggcggggagcgtgtacaatcaaccctgtgcttcggcttcagtgattaaactgttttacccaccgggaaagccgaggccgttcatgctgaaggggatgtgagggaagattcccccagcccaggaagccaaggtggtgcctctgccagccccagagagtgggtccccaaaagatgcagaggccagagatggggcatgggccctgccatttctaaaggggaagtgaacaagaagaggcggcattaactgtcattgtcacccccacttcccgcaacgcccagaggttgtccacacacacacacacacacacacacacacacacacactccaccctcacagggcactggcccgtggccctctct

SEQ ID NO: 4931 - DNA, 2555 bp, Homo sapiens
catgagtcagaaattcaagccaccagatgctttccaactaacagggaccaaatgggaccgttctaagatatcctaaaagatttgggagttagaggaggtaaactaagataattatattacaaagggtacaagaccacaagacaacaaccgactccggaattcttggacctccgccttccgtacaaggtgctgggcctgggaacttgggatgggggagggggacacattgcgcggtggccctgaggtgacggggagacgcagggcgagccgtgtccctcaatctaaggggagaaataggagcgcacacatgggtcacccaacgaagcaaggcgtccctgtgaactgtgcggctggctcttgggggcaacaccagggctgacctgaggaaagggcaaccagtactcccagcgatgacttcgggtcggcggaaggaaaagacctgagcgctaagagcttgggatacgggtcaggcccatccttaggggaaaccggctgggaagcgagggggggcgcaggccgagccggaacgagacacagaccgggtaggtcaagggagggggggtgtccggctggggcagttacaagcacgggaatcggcgaggctcagcagcccgcttcccgtcttgggtcatccttctgctagcggctgctccgactgttccaggcccagccgccccgtccactgccaccaccaacgccgccgccatcttacactggccagcggccgccaccaccaccgcctccgctctctgcgcttgcgcctgcgctgccacgctttccggccccgtttgcgacgatgtgctcgagaagactgagggaagagtggtcgcgcgagctcacggctcgcaaccctcctcgaaggacgcacaaggggcggggcttaaggccaacggaaaacagagcgagaggcgcctgcgcattaccgaagaggcaaagttgtttttgtagtttcttcgggcttgcttatcttgtgatactctaaacaaatgcgagttaggggctacccagagttgtgatagaaataaactaaatttccagcggattggcaggccacttcctggatgatggccagttttgccgtttttgaacactggaacgagcaatgattgccacaaggatttcttctgaaaatccccgtttcctttcagggctttgtttccttaagtggtttctatactatcgaggcccattttcccctgagagtccccatttacgtatttttaaagaaggggctcagtagcttgaggtgtagctattccagaagctcttttctgaagagaggtggtgtgggtaaaggttcccaagagtgggccgggtgatgtggggtgacttttgtactctgtttcgttatgacacctacagtaaccctgcagaggattactcccagctgccaggctggggtattttttttttttttcttaccagaagcccagggtgcaaaaatctgaccctttctcacctcccctaccgctactctcctattccaagtcattacatattacttaagactaccgcaatagaaacttacctcgtttgtctacttccattattgccattacagttaaacataaggcagccagagtgctttttaaaaatgtaaggtctggccgggcgcggtggctcatgcctgtaatcctagcactttgggaggcggatgtgggcggatcacttgaggtcaggagttcgaaactcgtttgaaaccaggccaacatggtgaaacccgtctctacgaaaaatacaaaaaaaaaaaaaaaaaaaaaaaagtaatgtcgtattatttccccagtccccaccctgctcaaaacctccaattcccatcacataataaaagtcaaaagtatgatagccttagaggccatcaaaaaatgaattgcctctaaggaggaccctacatgatctgatctagcacctgcctatttatctgattcatctcctcccacactgcctagctctgctctagcctcactagccttactgtcactccagtcaaagcatgtcccagccctagggtttttttccttttcttggaatgtccatctactagatatttactagacttgaggtgtctattgaaatcctacttcctaacacaggcagctcttgactattgtaactaaaatggaacctcatgtcatcctcctctatccccttactctgcactgtttttttaataacattttttacctataacatttaatctaaaattatgtttgtgatccagctatactactagaatataaattcttgagggcaaggactgtgtttttatcatctttgtaatctcaacacctagaagagggctacagcacaaagtagctatttaatgccccaccgtcctattcattctttcattcattcagtcaacaactattgaattcctgctctggaaggccctgttctatgtgctggggctgcaacagtgaatagaaccaagattcttgcattcatggaacttattagtgcaagggttgggagcataggaggaggggagagacacacagataataaagttataaagagtactgtaaaggaaaataaagcagaataaaaatggg

SEQ ID NO: 4932 - DNA, 1307 bp, Homo sapiens
agatcgaccggagatggccggactgcggggaacggagccggggagtcgaggattgaagaacccggggaacagggtaaaaactcggccactggcgaagagccagtggcaccggggggcacatcgggaagggctgcggtggcaacgagcgcggacgcgaggcgggcagggagcctccgcggacggaagggccgcaccgggggcggtgcggggacgctgcggccagctgccaggagtaggggagccacgcactcaccgctttgctcccccaggaacaccagcttgaatttcctcagcggattcccgaagtctccgcccgtggacattgtggaactagaggagcggccgccgcctcagcctagagacctcccggaccgatgctgctccagccagctgacgaaaaaggcgagcggaagggcgggcaccgagctctctcggcccctgcaaggcccggtggaggagcccggctggagggcagcaggactctccacagactggcagccgccgccgcctcccggcagagtagcctagcaccgagcgaggcccgcggctgggaagggaaggagggcggtgtcggcaggagccaggggtgtcctctggcttcccaaagctagggccgttccctccttccgcactcggctcccagacctggggaagagaagctgagggtggcggagccggaaccgcagacgtatctgggacctctcacgcgcagcgcctgagcttccacagctgccgccgccgccgcagcccaacctgctgagtgcgcgagcctctggagcggcgcggggcgagcccgggcgcgagcctgcggccccgccggccgctggcgtgcgtgcgtgcgtgcatgcgtgcgcgccaccgccatcgccatcgccttcctggtttggacagctctaccggctcctcccgcacggcggcgacggggcaggaatgttataactgccagaatcatggcctcccaattttgcagatgaggaaactgaagcttagagggagtaaatgacttgcaaaatccataaagcgggctgggcgcggtggcccacggctgtaatcccagcactttgggaggcggaggcgagtggatcacgaggtcaagagatcgagaccatcctggccaacatggtgaaaccctgtctctactaaaaatgcaaaaattagctgggggtggtggcgcgcgcctgtagtcccagctactcgggaagctgaggcaggagaatcgcttgaacccgggaggcggaggttgcagtgagccgagatcacaccactgcactccagcctggcgacagagcgagactccatctcaacag

SEQ ID NO: 4933 - DNA, 7517 bp, Homo sapiens
aacagcaccagcaccacgagcaggcagagcacgaaggcgaacaccgtgcgctgctccgcgtccaggcccgcgcccaccgggggccccgtcgacggcggcaggggctccggcgacagcgtccacgtcgcgctcatggctcacatcgccgcgcgccctgcggaggaggggacccgccccgggcgccggggatgaggctgcgccctccctcccgcgcctcctccgcttcgccccctcctgccgccgccgccgccgcctcccttaacgtgcccgaccccatcccccgcccgcgcctcggtccccgggctacgcccatgcccggcccgccggatcgccgccaccaccacgcggggacccaactctggccgtgcgcgcaggtgggggcgctgagagccgggaaacggagccgcgcccggcctgggccgcacacaacagggtccagccctgggcaaggcgtccacccactgcggctgcagttcctcactcgaccttgaccgcctcccacagcagccgcctgctcccacccccaccatcgcctcggccactcccgcgccagagaagacacttcagactccgtagctgctcttctgcaattcggtgttttattctttccaaatctcaggcttatgcacaagatggaagagcactgttaaaattaaaaaatggacctaaagtggcttggctgacgtggctagcgggccactgagccgcgggtggtgttgcggtgcctctgtgcctgatgacccaggccggggctacctggctccggcaccacactcagagaatctgctcggtgctggaggccgagatgtccaggagccgccaggccgcgtaggggttgagctcgtcctggtctcggcagagcgcccacacgtacagcatccgcagcaccttgtcctgcagggtggggtgggaagggcactgttgagagggttgaggtgacccaggcagctctgggggggggccaggctctgtggggcaggagccaccggcaacttccccaggggctgggagcagaggccagcacaattgcctagactcaggaaccactcagccttggtaaaaacagacaggtctgctggtctccgacctccctcaaccccaaactctggcccagaggtttctccacatccccacccagtcccagagcttcagggctctgagctggggtctctgccaggtggccacacacagatcttggggacaggcggtgtcatgtgcctgccccatcccactccctcactcaccgggtcaccctccaccacctcgcctttggggttcctgaccaccatcaccagctgtgcctggaaggtgatgatcagcaccggcccctgctccatcatcttgcccatggccagctgcagaggggccgagaggggggatgtgcctcagaggacagcccggctgctcccctggaggtgaaacccctgcgcctaggccctgctaggagaaggctccagcaccaggcccagcaccggtccctccccgtgggccttgcctctcaggccaggaccaggcctccctcgagaccctccccttggacaagcccaagacctcttggatcagcccatggcccccagcccctggcaaggccacctcctgggccttgtctgggccatagttcccacccccgatggtggcccgggcccccactgcgaggtgcttacgtcgacgttgtcaatgtctaggatgcgagaatggaactggagacccagtgccttggcctgctggatggggtgggccagctggctgtaagtctgcaatgagaggccgacacgcctgcgtgatgccacccagggtgggcaccacgccacacagagctgctgcccacacaccctggcgcccaggtgccctgccgccagccagcaatggcagaggccaagaacccaggtccaagtggggaggcaggtgccacccacttactggcccagatcacacgcttcccactcctgggaacaacactctatccagatgacccaatgaaaacaggattaatcagcaaagtgggtgattctcttggaacaaaatcccaaatctactcccagggctaagctggcggccccttggctgatctttaatacttccatattcgccgcactctgaatcttggcctgagatcaaacgcctcttctaggatctgtcctcagcctgaggctgcctctgtcactgaccagcccccagtgtcaccctcaaccccctgcgcctgtgccaggcacaggaagcagcccccgagacacgttttcgctggaggtttctctgggcttggcatgaaaccatgagagaaaagatgttctgatagcatctactttttatggaaatgactgatccgcggaggggagagaaaaaaaaaacagagccaatcctacttgttcggtttcttaaaggtgacattttaaaaacacttctgtggacgtggctggaacttcagctgtgtttccagggcaccagcagctccctggcaaagcgagtcagctgtggcgtaatggtcccaaggtaaaaacaaaacaaaaaaccaaaaaaaaaaaaaaaaaaaaaaaaatccacatcgaaactcataaatgcctgctggattagtcaccatgcaggggagtatttaaaaagaaaatctgacatcttctcctctgctttttccaagttgtttatgagctgggtgcagaatagaattagccaagaacgattctggatcgcttaatacgaagaagccaggggaaagaaacacacaggtcggggagcgaatagggtgagatgaggtggcctgaggagatgagagctgggagccccacagggatggactcgggcagggacagggaggctgccagggatggggcagacagctagaccagaccccaggtacgcggtgctgctggtggcccccgaaccccaagctttgactctgagaagcagctgaggcctcatcaggacacagctccttcctggtgtgggaagactatcgatgttttgtttggatctatgtttcaggatcatgtcgtgaggacagctagaggctcccagggcctggggaggggcacccactgccgcaaccccatccgtgccccataggtggcggccccgggtcaccgatgaaagctcccccaactcttccaggggctgtttggttaccagggttacctctgtgggttccctctggcccggggccagcactgccctggtttctgtgatcacacttcattctcacgacccgtgggaggtgagcacagggactctgctctggcctgggaagtgggatgggtgacaccttcaaaccccacttgactcccagcccccccccagtcatgtgggagacccacactgtccctgacccccggccccagcctgcaccccaggccactgcagccacctgaaatagggcagtcggcccccagacacctcattttacttcatggctgcaaccacctctcctgggactctccttccctaaattattatttctttttttttaagacagtctcgctctgttgcccaggctggagtgcagtggtgcaatctcggctcactgcagcctccgcctcctgggttctagcgattctcctgcctcagcctcccgagtagctgggattacaggcgcccaccaccaggcctggctaatttttgtatttttagtagagacagggtttcaccatgttggccagactggtctcgaactcctgacctcaggtgatccgcccgcctcagcctcccaaggtgctgggatgacaggcgttagccaccgtgcccgacctatttccttagtgacagtgtcttgatctgtcacccaggctggagtgctgtgctgcgatgactcactgcagccttgacctcgtgagctcaagtgatcctcccacctcagcctccctaatagctgggacaacaggtgcctgcctccatgcttggctcttttttttttttttttttttttggagacagaatcttgctctgttgcccaggctgaagtgcagtggcgcgacctcagctcactgtaacctccacctcccggatttaagcaattctactgcctcagcctccccagtagctgggattacagacatgcaccagcatgcctggctaactttttattttagtagagatggggtttcaccatgttgcccaggctggtctcgaactcttgagctcaggcaatcgcctgccttggcatcccaaagtgctgggattacaggcatgagccaccgcaccctgccacttggctcattttaaatgtttttgtagagacgggatcttgctatgtttcccaggctagtcttgaatgcttgggctcaagcaatctcccgccttgggctgctgggattgaaagcataggccaccgtgcccagacctaaccaaaattattttaagattggagggaaaaaaaaggcccagtaaaattggcagctttgtgatctctcacaggcccaggggacacccccaaccagccatctcttagacaccagcccagagaaggattctccctaacaaagtttacagtctgggagcaaaggactggcgggtgacccggtgtccagcctgagagcccagatgtgtcacatgctgaggaatggaaaggggcagggggggatgtcaggctctcggagggtgagacgtgaggattcccccaccgggagcccaggtcctgcctgttgggagctaccccaacggagccaccgaagtggaacttctccatggtgattttttaggccttaaaaaaaaaaaaagaaaaagaaaggaagtactcacagcttcatagcaccagtctttgagaatgtcaagctctccagaaatcatggcctaaaaaggaagggaaaataagcaccagaacgagagtgggcttttcaggcagcaggcgaggtcctgggaacattctccagtggtgcggggtggggagtttcctcagacacccccggctgccacctgtggggcgcgggtggagctgtggcactgggtgtcccccccaggcccgtccctgctggtgtcagtgcctggctctggcctaggcacaggcggagggcggcctgcgggcgaccacccaggaggcaccccacagggggacccccctggaacctggtggaggaagagaaaggtggctggggacccagctttcagcctggtcaggaatccaagccagggagatgaggacccaactccggctcccgcagtgagcccatgtcctctgtccccccaggggaccacatttcggactgcaaggcccaccatgggaccggctgcctcctaactgctgggggcagcgagagggaggggtgggctgcagggggcgtgcctgggctgggagctgcttccacaggatcctggagcctgggccggatccgatgagggggagggaggtgcctggagcggggagaagagcgggaaggagccggatgctggtggtgaaagctgtgagcggcagggggcgggtggccagaacacttggcacccatcacccatcccggaaggcactgcggtgctcaggctgctgttttggggcatggcgcccatccgcaccacctcccagccctgcccgaagtggcgggaaggatacgggaaactggaggaggaagaggacgttgggcggaggccggcggggccaaggatggagagtcccatgaagggccttccagaggcctggcccgactgggccgaaggtgtccaggctcctcctgcatcctgggggctgcagagaggcagaggcagcagggaagacaagaggccaccaacctcagggagaggcttatagggggcaggctgcagcatgaccttgagcaagataccctcatctataagcccaacaagggtctggttgccagggacagcaccgtgagggaacctcacggctgcagctctgggtcagacgtggcctggggccagctctgatgtctgaagacagacgcccacttctcccaaggggtgaggggctccaggcacctgagacaatccctagcctccagcagctgctcccagcaacctcaaaggaacaacagcctcaggcaggaggagtgagggaaacagacctggaggtaccggaggtgccggtaaggcccaggaagggcttcgggcacagctcatggggcagctgcagccgggcaggagcccgtgtgcaaccagcctcctcagaaaacagcctcggcagcagagttccctggcagcacccagggtgccggctgcggcgggggaggtggtggagccaggacctgccgcctgggaggggtcctgggggtgtggcacccacctccaggacattggggatgatgtcgttctcgcactgtttcagaaaccggtccttgtcaaaggccgggtccacccggaggatctccgtgagcacctccgacatctctgtcttggagaacaggccccctgcagggagcagagccgggagttcggggggaaggccggggaccccgccccaccaccagcctgcgaggtccagggatgactcactcacccagcaagtcggtgaccttgtccgtaagggcccgggatgcccggatgaacgcgttgtcgctttcgtcatacttcatcttcatctcgaagaaccctgtggaagatggggtaggtgctggagaaggggccccttccagaaacacaaccctccctcacagcttctagaggctccctgtgacccctgcgggatccaccctgacacgggtggggtcagggaggggacggctgtggacctgcatcctcatctgtgcttggggaccgctgcctgcccacctacctggccaggcgcagaggcccctcagctgcggccctaatggggctgtgtaagttatgggccgccaccccactggctgttgctttcactacaaaggaaacacaggcctctagcagtcctcacaggacaagggacaggggcctgcggctcgtttcggggccctgactgtgcttatgagggagcacctggcttctggcggcagaatctacagccccaccatcatgtgaccgcaaagaagtgaccggcccactctgaccccgatctcctcctctgcaaaacggggctgtcttgtgcccaatgcagggggatcaccttgcggtccaccaactgcccgggacacagtcacctgccctccaagacaccttcactcacggttaaacaccacgttgttctccttgaagtccttccactgctggtaccacttggagtccttgtgcagcacgacccccagggcctccctggggaagagggtgggccctggggtgagcggcggcgccagggccaccctgtgccctcctgcggctgcaggcagggggcagtacaggacagcaggcagctgagacctcaaacctaggggctctgaggaccccgccctcacctctcaccctcaaattcgagggagccgggaaccttgggcagaaggcaaactcaagaaacggactcaggagggaaccattggtgggctcccgaaatggacagcagtgaaagctgcccaaaatgggggcagcgagggccacgggctggtacctactcgtttggctcaaacactttctcctccttgaacttatctcccgcaaactccgttctcttccggagt

SEQ ID NO: 4934 - DNA, 1005 bp, Homo sapiens
atgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatcctggaagagaagaacagctgccaggggcctctcccttagagccccagccctggggctgagcatgtggacatgagagttaagggccagttcaagaaggcacaggagggacatggccaagaggaaagcacatggtgccagaacagatgctggagccagagggcaactccaaatattaaccaccttgtgcctcagtttcttcatccgtaaaatggggataagagtacccacctcacagggtggtcatgagaatcaagtgagctaacgtgtaaggtggtacctggtgaatatcacgtaagtttgtaaattaaaaacaagcagagggctccatgtagcctggagctgaagggagggctgctgaggggaaacaggatgcagggtgggctatgttgggtgttgcggaagcctgcattctccacataaaagcagcttcaaccc

SEQ ID NO: 4935 - DNA, 1882 bp, Homo sapiens
aaaaaaagcgcctaacaccaggggccacttggcccaggtggagcctccattaatcacggggctctctgtgttgtggccccaaggcgggcagccgatggcctctgcccgagccaatatgagctgcagcctaattacaggggacggtgaccccagggagcagagttcaggctccggtcacagctgcacccaggagccagctgcttcccagacctgcagagccaggggagaggtttggaggaccggcactgaatgacatgatccaaagcgcgccaagctgggctggaggtgacggcagagccacagtggccacagagcccccacgtgaacctacacggatctgcctggtttaggttctgctgaactccagggtgaggaggacctggtctccattctcaaagacatgaagaggttgacaaagaagagtcacagaagtgacaagtgtcctgctcccagccccgttcacacactcacccatcaagtgtggcagggacagccgcctcttaccatccaccttgggacctggacctaagtggaggtttctggaggggcagatccaggggaaagggtctcctcagaagcagccgccattcagaggacctgagatgagaacctcatcacgccctcatcagacagaggagatccgcggtgtctccgagcctggtctcccactccccacccagcagcgttccctccgctcaccccaagcttagaacattctgcttcccctaagatcagctgccgcagtggactgaatagtgacccccaaaagacatgccagagccctagccctcggacctgtgaatgtgacaggagttggaatagggtctttgcagatgcaataaaggatctcaagaggagagtatcctggatttagggtgggctctaaatgcaatgacaagcatccttacgagacacagagacacagagaaaaggccatgtgaagacggagcagggagtggcgtgacgcatctacatgcccaggagcacccgggagccaccagaagctgggagagaggcctgggccggagcctcccgcagaggccccaaaggatcagcctggtcgacaccttgattttggacttctggcctctagaaccatcttcagcccccaaagttcgtggggctttgttgcagcagccccagcaaactgtcacgggggccctcctcccctgctaagcctggtacccaaagctccccagctatctggggctaaccacactgaccctgggactttcaggtcacccgtgtgtcccactcttctgcttaaccttcagtgcctgtgtggtcacagcttctctctcgtgatatgagtcctctgggcctctgagtgctcatctgccctgcactgaaggctgaagttaaatcctggagagaactgacccctcttgtgggcagggcaggcactgtgcccccagcacagccagagggtactggctgaaatgtgtccctgtaaagtgtctcccctatgcccgtattttccttccaagtggggaagccagagaggcctccccgatctttcccccagccccctggggcaggaagcctgtggtcacctgtccgcaaggatcaggtggacagacaactagcccctcccaggccacacctcatcaacagagggcccctcaattctgctggtggcctatgagagaaggaaaaactgaaggagttgtttacagtaaactccaaacccttgtgccagagaggcccatggctgagcaaggtacccccacccccactgccctgagctgccaactcagcccagctcagcactgtgacctctgacctgcctgtgggccacgggagcctggcctgccaatcagcatctcccagatacccatcttgtgaagtccccagtggctgagtgcttccccgcccttcccgg

SEQ ID NO: 4936 - DNA, 2550 bp, Homo sapiens
gttgttgttgttgttgttgttgtttttgagacacggtctcactcccgccgcccaggctagtgtgcagtggcacgatctcggctcactgcagccttaacctcctgtgttcaagcgatccacccatctcagccccgcaagtagctaggactacaggcacgtgccaccacacctgggttttgttttttgttttttgtttttcttatagagacagggttttgccatgctgtccaggctgacatggtgaaaccccatctctactaaaaatacaaaaaaggccgggcacggtggctcatgcctgtaatcccagcacttcgggaggccaaggcaggcagatcacctgaggtcaggagttccagaccagcctgaccgacatggagaaaccccatctctactagaaatacgaaattagctgggcatggtggcacatgcctgtaatcccagctaccagggaggctgaggcaggagaatcgcttgaacctgggaggcggaggttgcagtgagccgagatcgcgccactgcactccagcctgagcaacaagagtgaaactccatctcaaaaaaaaaatacaaaaattagccaggcatggtggcacacgcctgtaatcccagctacttgggaggctgaggcatgaggatcacttaaacccaggaggcagaggttgcagtgagctgagatcgcacaaatgcactttagcctgggtgacagagcgagacttcatctcaaaaagaaaaaaaaaagaaaaatgctggaacccacagaggatgccggaaagggggcagtggtccccagactaacccgtatgccagccaagcaccctcaagtgatcccagctggtggcacagaactgaagattaaccctgccctcactgtccagattcctaacccacaacgctgtgagatataataaaatggttgtgttaactgttttaagaatggtgtctgacttgaggtgaccgcgacttttacgtagcagtaggtaactggaacagatgtccaacctcactagaaattacagaaaacccggccgggcgcagtggctcagcctgtaatcccagcactgtgggaggccgaggcgggcagatcacgaggtcaggagatcgagatcatcctggctgacacggtgaaacccccgtctctactaaaaatacaaaaaattagccgggtgtggtggcgggcgcctgtagtcccagctactcaggaggctgaggcaggagaatggcgtgaacccggaaggtggagcttgcagggaaagcccaaatgacctaccatttcaatccatcagattgacaaatattaaatgtctcgacacagctgggcgcagtggctcacgcctgtaatcccaacactttggggggccaaggcgagcggattgcttgaggccagaagtgtgacagcagcctaggtaacacggtgaaaccccatctctaccaaaactaccaaagattagctgggtgtggtggcgcgtgcccctggtcccagtcactcaggaggctgtggtgggagccccggaggaaggagttgcagtgagccaagattgtaccactgcactccagtctgggtgacaaagtgagacctcatctcaaataaaatcaatgtcttggggccaggcacagtggctcacgcctgtaatcccagcactttaagaggctgaggcgggcggatcacctgaggttcggagttccaggcccgcctgaccaacacggagaaaccccgtctctactaaaaatacaaaattagccaggcctggtggcgcgtgcctgtagtcccagctactcgggagtctgaggcagaagaatcacttgaaccagggaggcagaggttgcggtgagcagctgagattgcaccactgcactccagcctgggtaacaagagcaacgtaaataaataaataaataaataaatgtctcaacacacgttggagggaggtggaacacaaacaccccttattccagtcaaactgcagacaagtacgaggttctggcaaagagtgggacaggtctactgtaattttacctgtgcataccaggagacccagaattccgcttagaatctcatggtatttaaccgggagcctcacacgccactgctcctactagcaaagcatcgcgaaaaccgtcatgggacattgactccacaaaaacaaacagtatgcaactgacccttgggtcatcctaagggtccaggttctgtgatcttcccaacgcccatgcagatggccccgttttgcacatacaccaaggctctttgagatgactctgccagagtaagcagcctccaaccactgtccaaagtgaaacctgtcccgagctgccccacacactcctcagtaagaacacgggaggcaaggggctcccgcacagctgccagctgcttccctgccaaaacacctggagctgctcctctgcctctcagcaactgcttcaggtcaggctgggtgaatttcccagggagcccgttttcactggccaggccaatggcagcggccatgtttctgccttttcaaatcatcgaatcaggcaggaccacaggatgcagttctgcccacggag

SEQ ID NO: 4937 - DNA, 876 bp, Homo sapiens
taattgctatagcattccttacacttaacagttacgcaaaggacctgataccgtaggcccctgtggactgcttcaaccatttgctgacccaataaaacttttcaccagagaacccttacgaccctcaacgtctactgttaccctttatatcattgcctccaaccctggccctttctatcaccctcctcttctggactccccttcctataccccatcccctaattaattttaatataggcctcttatttattctagccacatcaagcctagcagtctattccattctatgatcaggataagcatccaattcaaattatgtactgatcggcacactacgagctgtggcccagacaatttcatatgaagtcaccctagccattatcctgctatcactactactgctaagtggctcaacttatatgcatgcatcacaatgccagaattactctgaccgctcctaccatcatgacccttagccatattatgatttatttccacactagcaaaaactaaccgagccccttttgacttaacagaaagagaatcagaactagtttcaggcttcaatgtcgaatatgctgcaagttcatttgccctcttctttatagcagaatatatgaatattattgtataaatgccctgactactactatttttctaggagtactacacactatgtattcaccagaactctgtaccataaatttcattaccaagaccctccttttaaccaccgtttttatgaatccgaacagcatacctccaattccactacaaccaactcatataccttttatgaaaaaatttcctaccacttacattagcattctgcatatatctcaatgcctttcctaatttccagcattccaccccaaa

SEQ ID NO: 4938 - DNA, 990 bp, Homo sapiens
cagctccatgccaggacccagggctccaaagccatttccaggatttagcacacaaatgtccatagagcatttgcaaacaagcaatgagagcagaggtatccggtgtatcccaaccaccctcctgcggatccccacgcctcccctgcgcatcccatgcgggcagcagcacacaggagaccacaggctaagcctgaaccacaggcagactcaccaggcacgccccatggcctgtgctcatgccctcaggtggtgacgaaaggtaggggaagctcaggccggggaaggtgtggggggtgagtgcttcctgcagaagcccctccggactgcagcacaggtggtcccacctggttgtagggcaggtcactcacttcggtggcaggggacacagccagtggggggttgcacgcctttaacccttagtgagatggagaagtaattcatggcctatcaatcttttgacaattaaattagatgagtacttggaaagatgcctttattttcccttcctcccccccgcctcccttttatggcagcattaaaacacttttcattttaaagcctggccagcaggcagtagattccaaggctctggttaactaggaatgctttgctacattgaaaggaaagttcaaaaccaagcccaaactccctgccctcttctttgtctctgaggatggacgagagcgacggggctggctgggacgcatccataggtggctgcgcacctagacggtcctgctgaaggaaggcaaggcacacagatctccagcagccgctgccccaattccatccacagggttatttctaggctcccacattccaaggacatccaaaacgcagagggtgcacatcgttctgcagtgtctggggtcacctcacagccaccctctttgtgaccacttgaagcccattcaccaggactgtctttctaaactccctcccagggcctgcctggctgtcctctgggcacagctgggccaccatcattag

SEQ ID NO: 4939 - DNA, 2849 bp, Homo sapiens
agcaattggctggggtgtttttccgctctgtgggagatttgttctttcgctttttgggtccacgctgcgtttgtgagctgtaacaccgtgaaggtctgcagcttcactcctgaagtcaggcgagaagactacgaacccacctggaggaacgaacaactccagactcgccgcattaagagcggtaacaccgcgaaggtctgcagcttcactcctgagccagcgagatcacgaacccaccggaaggctgtaacatatctgaacatcagaaggaacaaactccggacaggccgccttcaggaactgtaacactcaccgcgagggtccgtagcttcattcttgaagtcagtgagaccaagagcccaccaattccggacacaacaggacacactgcggcttctcctggctttttcaaagttcagcccaagaggaagagagacctaattaatacccaggagatggtggtgtttattttttccagctgggacaactaaggccccgagaggagaaagggactatccggggtacagaggccactgagtcagagctaggaccaacatatcaccagctctccctcttcagcgcagaccccaactcaccagcggtggcttcctgaagagctgggttaaggaggattctgaggtgcagcagagctcgctaagaggctgacgggtaaggggtgctgcgctgtgagcacaggagccagacagtcctacagttcaactccaacatcagggactgagtcgtacacaggaagatcactgagtaggttctgtggagacgcagtcggcccatatgcacgtcaccactcggctcccagctcaggtgcagaccaacggcgaccacttgctccactttgctctgtgacagcagacgaggagcccacccacccctatccgagccgacccctgactgcccctgccattgctccctgctgagttgcagacattgacttcttgccaagcctcaggccttgctcacatcgacacctcacagtgaccctgagaggcagatgctgtgaccccatttcacagatgaagggcctgagccacagaggaggaagactgcctcagccacgccgctagtaagtggtagttcccaactctagagtcccaaaagaattctgtcctacttatgaaaagtatatccaataagcagtacctccctgtgtttacaacttatctgctgatcccaaggatgggaaaagctgcactcagaaacttgcaaattgtgcaactgttccccacgattcccttggggccagtgccgactgaggcatctccaggaggccccagttgggcttggggacatgctgagaggtgacagcactgctctcaagtcatatcctctgcttctgcaaaagctgtggagctcacccatcaatagcagctccatgccgggcgcagtggctcacgcctgtaatcccagcactttcggaggctcaggcgggcagatcatctgaggtcaggagtccgtgaccagcctggccaacatggtgaaaccccgtctctactaaaagtacaaaaacttagctgggtgtggtggtgtacgcctgtgatcccagctactcaggaggctgaggcaggagaattgcttgaacccaggagggggaggttgcagtgagctgagatcacgccattgcactccagcctgagcaacagagcaagactccatcgcaaaaaaaaaaaaaaaaaaaaaaggctctagcattgccagatcccaggccctgtggaaggtatttccctccctcttttgtccttgcttgtctcagagcccttttcacagtctcttgtgtgcttctttccctgttaggaccaatctttacaactccagcaagcgcagcaaataagatgcagaactgggggagatgcaacgtatgactcaattcccttgagccgaaaacactcacttattaacaatatttttttcttttttttgagacagagtctcacaaaaacaggcacacgcccccacacccggctaatttttgtatttttagtatagatggggtttcaccatattggtcaggctggtctgaactcctgccttcaggtgatccacctgcctcagccttccaaagtgctgggattacaggcataagccaccacgccccaccaatgaaatgttttctaaaggtgttttcatcccttttgtgatctcctaaactcccaaggtgtatcacacacttcgctgggctctgggcaaacaaaacttagacaaggtccctgattctagaaaccctcggtcgagggaaccacaaaccaaccagagtggagggcagggagaggtcctaggttgggagctgggagcctggagcacgtgccaggtgctctgcagcccagcttcattatggaggctcaagcgctgtgaatttccaaaaacagtgaacacacccctagctgattgaaatacaaaaaacatattccacagccaaatgaaaatgacttttggatcctccacctaatttgggtgtttatgccgcctcgcccctcttttggcctggacaattgaaatatatctgctctcaggggagacgcccacggtgtcagggctggagttggcaagagacagggggaagaggactagacctggagtcagagatgaagttcttgtctgggatctgtcactaagtctcagcggggacccaggaagtcactccacctctcatagttcctcatccacaaagtggaaatacaagcaagtttaattctccatcgtaaggttggagctcctgtctgtgaaaggactggaaatgtaaaatgcgctcttcaagtacaaaggcagagaggatccataaacaggcacaggctgccctttggtataaactgttcacattaaatctatgttatgtt

SEQ ID NO: 4940 - DNA, 3253 bp, Homo sapiens
gccagagattcagagagggagggagggaccaataggtgcagcacaggaagtttttaggggagtgagactgttctgtgtgagactgtaatggtgaatatatatcattacatatttgtcaaaacccatagaacatacaacacaatgaatgaagcctaatgtaaacccatgggcttgagtgaataatgtgtcaacactggctcatcaattgtatcaaatctatcacactaatggcagatgttaataaaggacaagtgaggggtgaggtggaagaagaagtctctttgtacttctcatgcagttttgctgtaaatctgaaactgctccccccgaaatctattaaaaatgtaggaagaaaagaaagcaattcaaaaaaggacaatccagtttttcttaatgggcaaaagatgtgtacagataattcacaaaggaaatatatataaatggcgtaaacacatgaaaaggtgcttaaatcaccagtcatcaggaaaacgcagaatgaaataagacaccattactcaccagaatggctaaaattaaaaagactgaccagaccatggatcagtgaggatgtggaactgggagtctcataattactggtggaagtacaaaatggaatgatcgcattgagaaaaggtctagaagtttcttacaaaactaaacatgtatacatctaccatattacccaacaattccactcctaggtatttacccaagagaaataaaaatccacagaaagacttgcacatgaatgttcacggaaactttattcataatatccaaaaactggaaaaagccccagtacctatataatagaacggacagattttactcaattcatacaagggaatactaagcaataaaaagtaactaatcaccaatctattcagcaacgatggatgcatctccaaaacgttatgctgggtgtgtagaagacggacacacacaagagtagaaattataggacaccatttatatgaaattctagaatatggaaaactaatccaaaatgaaaaaaaccatcagcattggctatgtctgaggatggaggacgtggggactgactaggaggaaggagcaggaggggactttctgggttgatagtagtgttccatatattgagaggggtctgggttacacaggtgtgtgcatttgtcagaactcaaaagaatgcacactgaagatgtgtgcattacagtgtgcacgtttaaaataaagtttacattaaaaacacaaacattgacctataatgaacagttgtatgcccatgtatttagaaggaaatgcattgatgttgccactttactcagaaatgtacctcaacagtgcaccatgaaaggatgaatggcaggatgggtgaagggacggggcatgggtagatgggacgctccaaggcgggtccagtaaaatgacatagacatttatgccctagaaatgatttcaacattgccgtatgtttgaaatgtgggaccagtcgtttaaatcaatagaatgtaagtagtttcaatgctaacatgacagtcctacaacaggaccagcagctgtactttttttttatttttatgagacggagtttcttgttgcccaggctagagtgcaatggcgcaaatcacagctcactgcaacctccgcctcctgggttcaagcaattctcctgcctcagcctcctgagtagctgggattacaggcacgtgccaccacacctggctaatttttgtatttttagtagagaaggggtttcgccattttggccaggctggtctcaaactcctgacctcaggtgatccacccgccttggcctccccaggtgctgggattacaggcgtgaaccaccgcacccagcctgtactctttcataaacgtcaagacagatgaagaaaggtaaaacaatttgcctaagctgtgatttctaagtgaccctcttcactttgtcaaagcattcattcatgagaaaactatggaactcctgtgttcttgagaggctgcagtccggtgtgggaggcagagcagtggccagcacacagcatggtgaggcgacagagcgtgggggctctaataggaggtgagcagggcactcagccaggcgctggcgctcaaacctagcggaaggcagaaagagccatgaagaagtggacactattttactccagtaatagttcatttttattgtgtcaaacagtggacttaagtctcacccattcttaggactgtcagtgtgaccaaagctgccacctgcagagcccaggagaggagtcctcgcctttaccccctttcccatctccatccttctccccgaagcccacagctcagtgccctctcctgaggaagcctctgatcccacagccaagcacaagatctaggcctgtgggcaccaacaggatggggctctgcagtcagggagcgtcagctcggtgcaggtacaggtgccttagtgacctataggtcaggggcatgacctatggaccgaatcgagccattcacagtgaggcctcacctgtcctgggatcgcaggcacacacagctccccacaaccactacacacacacacacacacacacacacacgcattttaaattcccatgaaaaaattaactttgcatatatgggccacatgcccttccacatcctgcttaaagcacctcaacagcccctaagttcctgttttgtcaaaatgacttgccctggaaccgggcacaggcaaggctgcttaagactgcatccccaatatatttgtaaatatataactgtgttacataataaaacatgcaaaaaatttaaaaagaatgaagcaactataatattaactgaagtctggacatttacttatttaaccaatatcgtggatcacagtttacatggaagattccaggtaactcaatctaagaaaaatattcgttttatgcttagtaacaatgaggaaaatccttgatagctgccaagaacctatatcaccccagagaaccaagacgttcacttgcatttcggcttccttaccacctaagccatctgttttctcaaaactttacaggtgacttttcaatctcttatcctgaatgaagcctatttatattctgtgttctccttgcaaaagtagtacattattcaaagaaataatatgacattaactccccattcgttagtcaatattaagatattaacattattgaaagaacactgccaatcatacgaagcagtcaaacctccctaactcaaacaaggaatagtttgacagtaaaaatttgaggtatttaaagca

SEQ ID NO: 4941 - DNA, 498 bp, Homo sapiens
tccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcagtgttgctttctcaaagaaataaacatgtggctggaagtgtttaatggctgcgttttgatcgtctacaacaaggttacagtgccctctggtggcagtcatcaaaatcgcttctagacttgtttttatttttaaataaaagatctaattatattggaaa

SEQ ID NO: 4942 - DNA, 2015 bp, Homo sapiens
gagagtaagagggtcctggagtttggggtcgcctgggcgcccgcttcccccaggattggagcctgggccaccgtcagccaccagattcctggcaccagcccagcccaatgtttctccaaccgcctggcttcacggagcagcagcagctgctgactcatggccccacagaagtgaccactggcagggggacactcagcaaatttccatgtgtgtgtgtgcatgtgtgcgcatgcgtgcatctgcttgctcgcgcgctaggacaatcaggaactggccagtcgggaccaggcacacggcgcctggttccccccagggcccccctggcccagtcacatgcctgtgagtcttgggcttcctgtcacagccaggactcgggccaagcaggacagagggcaaggctcccccacagtgggccagagccccgaggctggacagtaggccctggcctcgaactgaccccatagagctgggaccaggctgaccaagccccagcttgctaggtggcttccagagtgctccaccttggatcctgcttccccctgaaggagtagtgggcacaggaggggctgttgcgagaggaagaagatggggaggggctggggaggccacgagtcaccacaggcctcccagcaggacagcagtgaaaggctccaggtcagccggccacactcaggcaggcccaaggaccgccccctcaggcgagctggcaccaaggcccgaggccactcccaatcaccctcccaggccctagcaggaccaagaccctgcaatgacaggggccagtggcaggaggttccagaatggggaagaaaggagtgtggctgagccgggacgccaccgtggccagttcttgagcacctcgggaatgggcccctcggtcacggctggcaccgcctgggagtactttgagacggggcctttggcaatcaggtcctccacagagcccccaacctccgacatggtccggcggatggacgtgaacttgtgcagcgggatcctgtcaaccacgggtcggggcatatcagggaggccctcccgcctgccggccgacgctgccaatgctgcacatccacctggaggcccctggggaatctcagagtcgccacagccaaaaccaaactcctgcctgtcacctggaaactgctggcccagctcccccaagtcagtgaatggcaacccattgccccccgccaggttgcacaggccacagtcctaagaagtggtcacccgccacccacctcagccccacacacccaacctgggggccagtgtgcccaaccctcctctcctcagccattctggaggctccaaagcccccaagggtctcccgtcctccctctgcacctgcgctggtctcttccaggatggtggccagcatggctgctcagggtgctggcgggtacctgtcactcctgcccaaagtgctctgaggcagcccactgtacccagcccccatcacacctgctctccacccccagacacctgcacgaaggtggccccacctccaggctggcactggcagctctgcctggcctcctctggccatcagatgggccctccacaccacctccagaagccctccttgactacctgtcctcctccacatggaccctgtggctgcccagtgccctcatcccacatctgtttctgggcatccgcacctctcctcactccatgcggctccacgaggtccaggactgcacctggggccttagaggcttctgtgctgccccccccaccgccctgcctcctccgacagctgcactcagggtacccctccagagtcctgtcacccagcacaccgccagccagggtgcaggagggagctccagactgagatcggggtcctgagttctaaacccaggaagcgagtaagagagagaggggtccctgctcctcccccagggccactggccttccccttggtgtgaacccactccttgttccaaggaagctcccctgggcttttaatcacttaaataaaacctcttccctgccccagggacttgagagta

SEQ ID NO: 4943 - DNA, 2729 bp, Homo sapiens
agtgctcggcccccaggcctgcgttcagtgaggcctcccgtggcgtcagcatgttcgtgtggaggaatgtggaaggtcactctgcggccgtgttctcctggtactccatccccttcctgacccctccctgcagccacacgaggcccagcaacctgccagtcactcagtggcctccaaccagagaaaacaacctgccaagttggcagccgttgctcatgagcgtccaccaggtgggacagggagtgttgaccctgggcagccccctggagccacctgccctgaaagcccagggcccgcaaccccacacactttgggggtggtggaacctggtaaaagctcacctcccaccatggaggaggagccctgggcccctcaggggagtccctgctggacagtgagacagagaatgaccatgatgatgctttcctctccatcatgtctcctgacacccagttgcctctaccactcagatgatgtcaggcccagtccctcagtgccctgcgcaaggaacaggactcatcttctgagaaggatggacgcagccccaacaaatcagacaaggaccacatccggtggcccatgagtggcgctcatgatcttcagcaggcggcaccaggccctggcggggcgcaccagggtcatcccaaccaggataaccggaccgtcagccagatgctgagcgagcggtggtacaccctggggcccaatgagatgcagaaatacaacctggccttccaggtgaaggtggcccacttgcaacaaggaccgaaagaagtccagctcagaggccaagcccacaagccaggggctagcaggagtgtaacaagggctcgtgggagcggagcatatcagagacgggcactgccactgcccctggggtgtcctctgaactcctgtcagttgcagcccaaacactccagagctcggataccaaggagcagcttctgtggggcagaacggctgcacacagtcagggaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctggtgagggaggtgacccgtgggcagccctgctgccgcccacgtgagctgctcattcccagcacatggccagcgaggtcatagcgagtgacgaagagcacacggtcatccatgaggaggagggggtgatgatgtcattgctgatgatggctttagcaccaccgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcagtctatggtcacaccctgtcctcctcctacacatactcggatgcttcctcctcaaccttggcacccacctccttcttactgggcccaggagccttcaaagcccaggagtctggtcaacgcagcagagcgggccccctacggccccaacccctggggatgggggcccagggacgccttccaaggtggcctgtttcctcccaatggatcctgccaccttctggtgcaagagacctgaaagtgtgggcgacctggagctaccaggctcctcagtcatcagggtccctcccagggcagagggaaccccacggacatggatcccacactggaggaccccaccgcgcccaaatgcaagatgagaagatgctccagctgcagtccaaagcccaacacccccaagtgtgccacgtgtgatggggacagcttcccctttgcctgtacaggtggagaagccgaggacaggctcagggaaccggagaccgagaaggcgctgtcctcttcactgcacgtaccctggaccagtgccggccctgatcatgcagctcttccaggcccactgcttcttcctgtccactaggccacagccgccctccaggcccactatgcacacatcttcccctccaaggtttgttctgcccctgccctgactcccagccctgtgggggtcctgaccgcacctcacctggctcagactcttgacgctgccctggctgccccaccactgcttctgcccgagagtcacgtgaggctgagagtaggggcaggggcagcagtggtgccagttggggggcggtccagtgggaggagcctcagcctcgcaggctgctccgtgggactgatgactgcatgatcttctgggcacctcacggatcttcaactgcaggtgaaacggatgctggtggtgggtgcagggccgctgggagctgctgcatggttcccagaggctggactgaggcaggtgccaactgaagctgctggggcagcatgggcaggatgttctgcacacaaaccttggagaagaagatgtgtgcatagcaggtccactgctgctgcccctgccctgactcccagccctgcctgaccccacctcaacctgctcaggctctggcacaaccctggctgccctgccactgcctctgccccagagttggggccttgacagcctggttggaaggggacaccccagccctgcctcaacacctgggggtctccataactagcacaggcagg

SEQ ID NO: 4944 - DNA, 767 bp, Homo sapiens
ccacagaccacttcctctgctccccagcgccggatggatgcagatctgtgagtaaggagccagctgcaggcaagcagctcgagggcaggtgggcatgatgtctggctaccactcgcactggacgccacacacacagccagggtggcagaaggccccacctgccatgtgccagtgggacaccaccctcatggtctgcgtttccaggtttccaactaaggactgagcacactctcaacatggacctcctaactgctctcgaggatggacagctggcctcaagggaacactgcaaagtggctctaggaagaagccactgtccctccagaccataaaaatggctaccaagggcagagccagcagctttcgctgtaaagtttctcaagaaaatcacagatattcccctctgtgatgttcagctcagcctggaaaggaggccgctggaagacctggatgcccgtcgtgggacaagagccagaagcactcacccagtgccaacacctgctgggccacaaacagtttctgcttgggatcccaacacaggcagcagagtcagcaaaaactctaagatatcaagaagtcaagcatttcttaacaacagcagcaaactcttacacagggctgtggttaccagacactgctctaaataacttacacttgtttacttatttcatcctcacaacaacgggtaaatattttaggtctctgccaatttgcctgattactgaattaggttgaatcattaaaatgaataacttgataatacccaa

SEQ ID NO: 4945 - DNA, 3017 bp, Homo sapiens
gcagatctgtgagtaaggagccagctgcaggcaagcagctcgagggcaggtgggcatgatgtctggctaccactcgcactggacgccacacacacagccagggtggcagaaggccccacctgccatgtgccagtgggacaccaccctcatggtctgcgtttccaggtttccaactaaggactgagcacactctcaacatggacctcctaactgctctcgaggatggacagctggcctcaagggaacactgcaaagtggctctaggaagaagccactgtccctccagaccataaaaatggctaccaagggcagagccagcagctttcgctgtaaagtttctcaagaaaatcacagatattcccctctgtgatgttcagctcagcctggaaaggaggtaagaaagaccagactacctgatctctcaaggtcaccaaattcaaccactgtcctgtttaaaagcgggtagtacagaggccagtgtgggctctggaatgagacatgtgaagcccgggtctgctgggtctgctgcacggtagcagtgtagtcttaggcattattgaaactctgtttctaaatctggttatgtgaatgaaaggggctaatttatgtaacacttttagtatactaagccctcaatatagtttagctacttaactattgtcttctttgaaggacgctgaactaaacagaagagaaacagggaaataaacagcatggcaacctacatcaacagaaacttaattattcaccctggataactgagtgtaggtagaaactgagagttgaagaggctgaataatttctcaagcacactcccaactcgaccacccacaagcaaaaaggcagagctgggattcaaacacaggtatgactgtgtgtggacatctcccctgtgctatgctccctgaaggaaaattctaagtggtgttgtttctgggagaaatctacctgtgtggtctttaaacctactctgacaggagcaagggccaccactctgtatctaagaccactgggaacagtcttcaggcaacaaggtgaccagggcagctgcagagggtatctatgcccctgccccctagcgcaaaagtctgtttctctttccaaatggcccgctgggagcaactatttagggagaccatacctcctcccacactcagttcccaggcctgagccacagagtcctgccacaggagggaggacctgcctgtcctgctccctccccactccaggttcctggaggcctctgtgatgattccccaggaaggactacaggatctggcaggcagcaggtggcggtgggaggaggagagtcctgggagcacagcactcctaaccccctctgcctctcacagaacaaagagggagtcatgccatgtcccctgctcccacaaatgccccacccagaggggctaatgcctaggattgagggtcttgtgtgctgaggaagtcctgtcccccaatcccctacaaaagccagaaccagctactaaggggttagacacagacagaactgtctatattaacatttcctcctaaaaaacaacaggaatcctggggaaagaccactggcctgggactccatgagccctggcttctatctctggctttatcaggtgaccataggcaagtcacctagcctccatggtctaggctctcctgcctgttgggtgggaatcattacatatcacaatcattacagctgaccttcagggaggctgtactctgggtcaggaattgtgttgggtgcattatcatatttattctcacagcaccctttgcagtagctactattttcatacccattctcagatgaggaaactgtggaacaggctggttaggggacatgcccaaagtgacaaacttagcaaaggtggacctggcactcagtaccacatctgtttttccatgctcttaaccactgtaacatacagagcccttttacagagatcaaggacagaggtaaaagtgttttgaaagcaaaaaaaaaaaagtggggaggatgcataaaataaacataaatcaccccctgccccgcccagacataattcagggaagagtcctaacccccaagaaccttctgtggaacttattcgcaacatcagagacctccaacatagaaatgaccctcaataagtcattcctctttcccttcaggcaggaataatataactaactgaattatacaggtgagaccacgaaggtcaagcaagggtgaccagcttaggcccctggctggcaggtaaggaggagactgaccccagcctcctggctcctaggggaggaaacagtgatgacaaaggcccctttgcatggccaaggtggagccctttctaccaaagtttaaacgttttagtataatatccaagtgcatcttttccaaccttaaaaacatatttaatttccttataaagctggttggcactctcctcctcctccaaagctctgtattaggcagggttcatagttgtagacaacagaatgaacagtggttagttcagccagaaaagggatgatataggaggatactgggttgatcaaaggctctctgggagggctgcagatttagagccagtcagccaggaacgatgcctgaaacataccttagagctggagaaagaacaaaaccctacctttcttcaatagctggcaaggtggcaaggtctggccccatgcagcctgggctcttcccactctcctctctccctaatgcgttgccctactcgctgcttcccaggcaatcccacctcaggtctatgaacttgccattccctctgcctgcaacctagacattcacattgctagctccctggctagctcaaatgccaggtttctgcacaaatgctcctccttagagaggccttcctggacctctaggtctctggccctagtactctatcccctctccctgctttcctcttctacttcactgctccttaacattgtgttatacattgtctgtctccccaactggaatgtaagtggcaccagggcagggacttgggttgttttgttccttg

SEQ ID NO: 4946 - DNA, 2179 bp, Homo sapiens
cagagggtcgtgacatagcgtagaccagggatgcttaggtgaggaggtggaacccacaaaatcccattgcttttcacactgcagggctgccccgttatttcctttgcaggttggtgtgcgtgcgtgtgtgcgtgcgtgcctgatacacatggagccgggctgcttcacacatctggtgaggtcgttagaaggtcagataaagaagagggcggagcttgctaaccaagctgttagaagaaataatgggagagaacattccttcatttcaggaggacacagagcaggctaggtctgccgcgaagactcctatagagagaagagtattcttaaactagattctgatggacgcaacaccagttgcataatggttatgacaatcagtgcccgggtttttgaccaggcatttcatggtcacccccacgctaatggaaagtttctggatcttattttgttatagtgagtgatttgtagttttcagaacggaggccaggccaaacgtattccaaatgaaaagagaataggtgtcaaatgctaaaccttttatcttcgtgttggcactgttgccatccccgccctctcccgacatccccgcccttgaccagcatctctggccttgcccagcattgtctatgtattggcactcttgccatccccgccctttcccagcagagtctcactgtgtcaccccggctggagtgcagtggcgagatcttggctcactgcagactcactgcaacatccacctcccgggttccagtgattctcctgcttcagcctcctgggtagctgggattacaggcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtatttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctgcgtgctcaagagtctggtttggggctgggtcttcccatcgccctggaggaggcttttgtctcatctcatgattcacattaaactctgtgccatgaagctt

SEQ ID NO: 4947 - DNA, 1878 bp, Homo sapiens
ttttactcaaccttttatagtacagggttcttaaaaaattttgaaaagaatgtccacaaaaagtttgagttataccctttacctttagtaacaaaaggttagtagaaagcaagacatttaagtattaccaagaatctaacttatctccataatttctttcatatattcatttgcttacttgtgacacagagtcccactaactcagaagcattctctaagctggcctctcactggctctgagactgttgctgccccacagttctaattcccatttggaaaggaaagaggaagtacaggagaaggagggtcatgcagggccacatccagtcaaaactctcacaaaaccttgagaaacagggcaagatatcccttccaggcaagatatcctttacagaagaaaagttctggagaacttaaggcagctctagaagggaagggagcaagggttaaggcggccctcacagcacagcctgagaacaaattacaatgcactcatccatgaacagaggtcacggcaatacagatcctcttcaacgcgcatgcacacgacacccctcctagcacccatcaacacctacggcatgcacacactgcagtgcccacgcacacactgacttgtatatggcctgcccagtgacagccctcggaaggcacccagtgacttgggctcccctgtgctgaggacctaaactgggaaggtggcctatagctgcaggcctgtccaggctgcacagctcacctggtggctccaataaagactctgatgggtgtggggagagtaactttcctcttaatttcagagaggcttttgctgtttcctgtctttttggttgagacaacctgctaccaattaatgcccaaacagagtattgcatcctcccagagagcactgattcatgacagaagtcaagctgagttatagcaagtaactatgacaaaaaagaaaaccacctggcgctgagcacttggtctccttaaaacaagtaacttggtacgcagcacttgctcggttcccacatgccagctgccaactctgataaaaaagcaccccttgctggccaggggcattccacacgtaccaggaggggcagcacgtgacctcacgacatttttaaagtctcctgcatcacaggtgcccacaccaccactgctccatatgggaaagcaggacagccagagggctgtgcgacatcaggcaagtcactgcccctatctctattcccaagctatcatcagaaatgattgtagaagcgaccccacctaccgtccatgctgctgtgaggatgaaacgaggtaacagaggaaagcgccgcaggaaagcatatctggacccaggccaccaagagaggttaattcagacccccatctggagctctgggtagacctgggaggaagctggagccctggaatagcagaacctttgtgccaccatcgctgaacaggagaaaccaccaagggcagctgtaggagctctggctccagcacttgacaggacaaagacaggagatgggagagaagggctcagaccacagcctttctttcatgacgcttcagtacatgagctgtccggagtaaaaaaaagggctgcatggcagtgacagctacagcatgacctggaagacctgagaagattcagggtgcacgttgagtcgtgctacacaggatgaagctgggggaggtctgggagatttccagggctgaggcggacagcctgtaccacgttgcattttcttagcaactccccaacttacagcctatcggatgctgttagattctgacacatttggtacgaaccaaatggctatgacttaattgtgcattgaaaaccgcattgacaaccaggaaaaactgggagaatttgatgcaattggtagtgtt

SEQ ID NO: 4948 - DNA, 688 bp, Homo sapiens
ggctgttgttgctgagcggagacatggcgatgccgatctgggccaggtagtacagaaccctggggtcagaaccagagctgcagctggatgcgaagccggctgccctccccatacccagctctgcgctgcctgctcacgtgctctaagaagagatgcagttccgggtggctggcagggtgcacagtggcctcgaacagtggcaggaagatgttctccagcatctcctggaagttggccagctggcccttggtacggtacacatcactgcaggttcccctcccactccagggacactcacaagaggcggggcacctgcaccagccagcgcacgttgggggagtgcacgcggtgcatgacggcccagcgcgccagcttgtcccactcatccctcgagcgcccgtaaatggagagccgcagctctgcattctggtatttgctctcctccaggtctgacatcacctcctagacatgaggtgagctgagtcagacatgaggtgagctgagtcagagctcttcagggggtcatctgcctaccctccttgagtctcaccccctaaaagcccccagatcctcaggctcgaggcttggcagggaaggctgcctccttaccttgatgatgtgagcaaagtacttcccagataccctgttgtccgtcttgatgaagatctctcggaggacggactcccca

SEQ ID NO: 4949 - DNA, 514 bp, Homo sapiens
caggtgcgccagaactaccaccaggactcagaggcggccatcaaccgccagatcaacctggagctctacgcctcctacgtttacctgtccatgtcttactactttgaccacgatgatgtggctttgaagaactttgccaaatactttcttcaccaatctcatgaggagagggaacatgctgaggaactgatgaagctgcagaaccaatgaggtggccgaatcttccttcaggatatcaagaaaccagactgtgatgactgggagcgggctgaatgagatggagtgtgcattacatttggaaaaaaatgtgaatcagtcaccactggaactgcacaaactggccactgacaaaaatgacccccatttgtgtgacttcattgagacacattacctgaatgagcaggtgaaagccatcaaagaattgggtgaccacgtgaccaacttgcacaagatgggagcgcccgaatctggcttggcggaatatctcttcgacaagcacaccccggggagacag

SEQ ID NO: 4950 - DNA, 1797 bp, Homo sapiens
ctcgtctcaaaaaaaaaaaaaaaaaagtgactgtggtggtgcacacgtataatcccagctacttgagagatgacgagggaagatcacttgagcccaggagttaagaggctgcagtgaccgatgatcatgccactgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacaaagtctcgctgtgtcacccaggctggagtgcagtggtgaaatctcggctcattgcagccccttccttccaggctcaagtgatcctcccacctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcaccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaataggactgcggaacaatttaaataaaagcacacaccagcctggg

SEQ ID NO: 4951 - DNA, 2410 bp, Homo sapiens
gagatggagtctctctctgcagcccaggctggagtgcagtgggacaatcttggctcactgcaagctctgcctcctgggttcacgccattctcctgcctccgcctcctgggtagctgggaccacaggcacatgccaccacacgtagctaattttttgtattttttagtagaggaggggtttcaccgtattagccaggatgatctcgatctcctgacctcatgatccgcctgcctcggcctccctaagagctgggaggctgaggcgggtgatcactcaaggtcaggagtttgagaccagcctggccaacatggtgaaaccccatctctactaaaaactagtcaggtgtggtggcgtgtgcctgtagtcccagctactcaggaggctgaggcaggagaatcgcttgaacccaggaggcagaggctgcagtgagccgagatcgtgccattgcactccagcctgggcaacagagtgagactccatctcaaaaataaaaataaaaatgtagaaaaggtacagtaaaaaatatggtattataatcttttgttctttctttctttctctttttttaaaagaccaaggccttgccccgttgcctaggctggagtgcagtgtcgtatttgcagctcaccacagcctcgacctcttgggctggagcgatcctcccaagtcagccttcctagtagctgggatcacaggcatgcaccaccatgcctggctaatttttaaagtacagttttctaatcttatgggaccgtggtcatatacgtggtctgctgttgactgaaatgtcattatgtgttgagtgactagctaataaaagtcacagcaaaaggagaggcttcagcagggaggggaagagtaatgtttatcccaacaggacgaggtactgttgataggataaagtcaacagaacagaagctactatttctttttaagggaaacaagatggcaaacgaagggtgggtcaagaggcatggctttctcttcaattctacctccccttgctcacacgaccaacatcaaccccaaagaggccagtggcatttaagggcagaagaagtaaacttcaggccgggcgtggtggctcacacctgtaatcccagcactttgggaggctgaggtgggcggatcacctgaggtcaggagtttgagaccagactggccaacatggtgaaaccctgtctctgctaaaaatacaaaaattaggccgggcacggtggctcatgcctgtgatcccagtactttgggaggccgaggagggcagatcatgaggtcaggagatcgagaccatcctggctaacacggtgaagccacatctctactaaaaataaaaaaattagctgggtgtactggtgcatgcctgtagtcctagctacttgggaggctgaggcaggaaaatcgcttgaatccgggaggcgaaggttgcagtgagccgagatcacgccactgtactccaatctgggcaacagagtgagactctgtctcaaaaaaacaaaaaacaaaaaacaaaaaaaaataaattagccagggatggcggtgggtacctgtaatcccagctactcaggaggctgaggcaggataattgcttgaacccagaaaacggaggttgcagtgagctaagatcacgccactgtactccagcctgggtgacagagcaagactctgtctcaaaaaaaaaaaaaaaaaaaaaaaaaaaaaccacaaagtacactgcagagatgtttgctgagaggaggaagggaatggggctcccagggaatacccattgtgggagaccaggtgaccagggtgcctggttctggcacagaccctgattgacacccacagatgaatcacaccctccctgagcctcggtttctccacctgcagacaggcttcatctgctggaggggggaagggccccgggcagtccctgggagacggggcctgcccaccctgccgctctccttaccaacacctgctcgctccgaggccacgatcccaacacacagccggtcattgaacacggctgccgccgacagggtctgcttcgggacccggtagtgacctgccaggtaggcttggatggcctcgaggggtgcctggggggtgacgaagaccttgtgctggctgaaggcagaggggaggtagcagtgctcccagtccccatcacagaccatgacgagctggtagtcttctcggtgctgctgcgtgcacagattgtggaaaagctcctccgcttggcgtgccacctcgtagctcagctgatctgcgaacagcaggctgtagaccttgtgccccagggagcccagggtcaggcagcggcgcagcaacagtgccacctcctcaaaggtggttgccggggtgcagagcagcacctcatcgtaagtgggcaggggctggcttggggtttgcatgtagacagccaggg

SEQ ID NO: 4952 - DNA, 4063 bp, Homo sapiens
gggcgacttcttccctcatgtgagctgctctgtttacatttgctggtcgctggaagatcgaaagactggacaaaatccatatggcggccggccggcgcggtggctctcgcctgtgatcccgcgctttgggaggccgaggcgggaggttcttctgagctgaagagttcgagaccagcccgggaaacgtagtgagacccccaccatctctacaaataataacaaacaaacaaaaggtccccccgccccgccggccgcgggttgccgtcgcacccaggcacatttgaagggcggcaggagccaaggcctggctgtcactgctgtcccggacccctttgacggcccctgggggttcaccagagggctggcccgtggctcactgcccagtcctctatgaggacacttcgccatagacattttgttattgcagactgctctgggaacacccctgactgggccctaaaatgaattccagaaaaggaatcgcaggtcaaggggcggttctaaaaggcttgggctagggtcagccagagctctgtgcagcagatgggggcctggaaaagtctgcagaagtggccttccgcccaggccctgcctcccccgacgggggcacgttgtcctgagtgcagagctgcttctaggagggagtaggggtcctgtgtcccctcctgcgaaccaaggcataatgagaactggatgacttgggcccacttttgggtctggtgagcagcctgggcaggagactggaggaggtgctgctggaggatgggcagaacagggaagcgggagtggcgttctgtctcagcaacaccattcccagctggctcctctgtggagtgtgtgtgcaggggagcgggggcaggggacacggattttcttcctccagctcttagctctcaggaccagagcttggagaggaacagagacccccctacccagcctagggtttagcctgcgcccgaacccaagccagttagcaatgaccctagggcaccctccccagtcactcagccactccagcctggtaagatgaggtggccaggctcctgcagagcgagctcccctctggagccctggcagcctgtagagcactctcaactctctcgcctctggggcaggccaggccaggctgtttgtggcccttgcattggcttctcagggtccatcatggaaacctaggggtccaacctcagcccctctgtgtccctgccctagctgcggctgagagcccccaggagtaagctggtgagaggccttccatggcctcccactctctgtgggctcctgtccctgtggggccaccacgctggccaccagctgcctctacttctgccttacagcctccctgccttctgctctcaacgttgaaacagccccctccacagctcccgaacctgtgttccagcggatgcttctctcccttgatgatgcacccgcctgagtcaccccctaatttctcccctgggggattctgactttccacttctcttgggtttctcttccccagcctctcagctgtggttggtgtggagtcagggccgggtgcctataagggcctaaggtaggacttggtgactcggcggtggtttcccttggttccgacttccctcttgcctctctgtctattactggctggtcaactcctccagtgccccttcctccaggcagcctcctcagccctgcccacctgctccatctgagcctgccccagtccccagcctgagtcctcaagcagaaccaatcccccctacctcagctgatgattccctgtgcagagtttgtattggggctcccctaacaagagctgatgctgtatatgcccagctgtgccatctcattgacttctccccaggatcctaggagggagggaacactttacagatggggaaactgaaactcagagatgttaaataacttgcctgaagtcacagccagtgaggtcaaagtgggattaggatttaaagccaataaacccccaaagctcagcactgaggaggctgaagagggaggactgcttgaggccaggagttggagttctgcctggacaacatagcaagaccctatctcttaattaagaattaaagccagtaaaccggcttcagagaaccaatggctgatttgaagaaaggtgggaacaggcaggaaggatgcccactggggaggctgctgtgcccaaatccctggcagggaccacgtgactgcagtccctcccctctaagcagcacagcctcctaccccactgtgctctgtgatccccagtcagcccctgtccctctcctgacctcagcccgcttcctcttcgggctctgcagaactcaggggcagggcactgggaggaagcaatgctgcctctggctgcactctgcagaggagcagactacaaggatagagtccagtgccctgcctggagtctgccctgtgcctgacctgctgagccgggtcatgttctgtggataaaagacctgggcctcctttgaagccccctccaggcccagtggttcacgtgtaaccaggtgtgatttctgaggaacctggaccaaacactggcctggtaacgtcatgcagcctcctgcctggatgctgccaaagcagcccctgtgggccccagggagagcaggggctgtggacaggggaggtcagctggaggggaggctggcaccttccaagcccctctccttgtgcacctgctctgggggacactaaggctcccaatcagcccctgcctggggggtctcaccctgacatttaggtctgaaggccttgagggccacctccccactgttatctgctgctgctgtccccgtcacagctgcctggcccccgtacactgtcattttgccccaggcaggctcgcacagggccggcgctctgggagggtggaaggattgctgggcccatgactggacacctctgtcacccaacttctgatctatctgcacgttgagaccagcctggccaacacagcaagatccctgtctcaacagaataaaaacaaaaataaaatgatcttctgtctgcacactggggacaaaaacacccacctcagaaagctgagggttaccagcggcgccaggccggagccgccccagtgccaggctcactgcttgccataggcagccctgccctctggatctcatatctgcagttctgaccttgcctgtggagggaaagtgtaggggaaagaaagagatcagactgctactgtgtctatgtagaaagaagtggacataagaaactccattttgttctgtactaagaaaaattcttctgccttgagatgctgttaatctgtaaccctagccccaaccctgtgctcgcagaaacatgtgctgtgttgactcaaggtttaatgggtttagggctgtgcaggacgtgctgtgttaaaatgtgtttgcaggcagtgtgcttggtgaaagccatcgccattctccagtcttgagtacccagggacacgatgcactgcggaaggccgcagggacctctgcccaagaaagcctgggtgttgtccaaggtttcccccgactgagacagcctgagatatggcctcgtgacaagggaaaaacctgaccatcccccagcccaacacccgtaaagggtctgtgctgaggaggattagtgaaagaggaaggcctctttgcagttgagataggaggaaagcatctatctcctgctcctccctgggaatggaatgtctcggtgtaaaacccgattgtacattctatttactgagatacgagaaaactgccttatggctggaggtgagacatgctggcggcaataccgctctttactgcactgagatgtttgtgtaaagtcagacataaatctggcctacgtgcacatccaggcacagcacctttccttaaacttatttatgacacagagacctttgctcacatgttttcctgctgaccctctccccaccattaccctaaagtcctgccacatccccctcactgaaatagtagaaatagtgatcaataaatactgaaggaactcagagaccagtgccggcgcgggtcctccatatgctggcaccagttccctgggcccactgttctttcgc

SEQ ID NO: 4953 - DNA, 5344 bp, Homo sapiens
atctatcacatggcagagatagaataaaaacagaaaaatggcgacggtcacgttgtggcgagccttgctgcgtcattagataatcctcatgcaaatagcgggaagaacaaaggaaggggagcccgggacccccgggggcgcagagcctggatgttgtttacatgaaggatccggcgggaggagtctaagaggaggaggcggcggtgccggaggaggaggaggagggagggagaagagaggaagaccggagtccccgcggcggcggcggtccggagagagggcgagccccgcgcggcgccggggaccgggcgctaccacgaggccgggacgctggagtctggggtaggagggagaacgggcacggggcgggaagaggggtccgtcagtggcatttttagcttgcaccctgccacgcagattctccccggccggaggggaggagggtggagggagggcggggaagcctcggtttctctgcacgttcgggaacgccttctcccccttcattctcccattcccagtgttttcccgcttctccccgggctcacctgtttatttccatcagctagagctcgtggttttttaatataggcatgagagtctgtttcttttattagaaacattattggggagaggggtgctttgctgtaatttgtgctggtccaggtcggttttcaggaagggggaggggacttggcggagacgccggctcctggccgcagctgaccccagggcttctccctgccttcctgtgcgaggaattctttccctcactctgctacccgcacgccagctgccaccttcctggagaaagaccacacctgtgcttatccctgctttgaaggagaggtgagctgagaaaccagggaatcccctgctctccagggttcttagttagtcctctccgcaatcccagcattggccaaaaattgctgctttcacctgctgatttaatttggcatgtctgtccccagcccccctttcccccggcaagttgtgatctgcagatgttttgggattttctcttccctctggacctgtcccccaccaaccagcaaatagctcctgggcctaggttgagggagagagagaagtgaccccctttggccagtgcgctgttttttattcccctctgggtcttctaatggaatctgctgtccctccgtagccccctttattttccccttaagcttaacccagagccaggcctaagcagcctgtctctggctttctttccccaggccccaccctggccccttttgcttttccagcgccaaaaaaaacgcctcccaagcagaagacacacccagcccaagtctaaccattccaaaagggaggaaaacacagaggaagagcagggacccaagggtctcctgtcctgaatattccaacagcgtttccctctaaaagcctcctagctttataatccctttattctgcttaccagtcgaccctcccctcctctttgccccttgttctgtgatagatatttggggagaggggtggagaaagaggttgtcaccctctgttccttacagtgaggcatttttctttttctcagtcttttcatttattagatgtttagcatgtaaaatatgtaaatctgtttgcaggcttatttgaacttgttttcttgctggctaaggaatagctgatattctataaagggaaggaggggggaaaagatcaaaagtaacactctgagttttccccatttgagcatccccagagttgccagagaagaccctcctataaaaaccaacagtctcccttccatgacatcaccacctaagcccttccaactttagcttcagaacaggaagaaggctcaaaatagaactaccttaggaatccagctccttgaaaagatcaacttttaaatcagctgcaggaggaacacaatgaactttgacatggggagtgagaagggagagaagactgtatagtgttcataattggttcctttgagggagggttgggggatacttaccgtgtatttcagaaaagctttcctctagagttgggtacctagaccactgaatgataaataggatggttcaagattcatttattgaattattcataagtttttgtacgtcaacaataacaagcacgtttcagaatatgaattaaagaggggcctctctgcagaatctgctctagatagagaaggttgtttcaggaagctaggagggcacttgaagacagagaacctgaggatgcagtgacagctgctgtgagtatgtaagttgagaggctcataaacaataattgtgataaacaataattgtaacttttgtaggtgactgataccctggacaaagaagtaaggatgtcaggattttccacctctaccttggaaattaacttcttgtctttgaatctcactcagtgtctccattcagtccctgaattgagatatgctttcctctctgagctaaaatactcagtcttttggaagggctacctaataaacgataatcactgaagtgttgacaacttaaagattggaagtggagcagaaaatacttggtataatttgagcacttggtgggtgctgtaagatgactttctggttgatggggtaacatcttttactctggttcgggtttaaaagaatccaggtgacagagacaggatacctgccctaatatggtagccactagccacgtggctattaaccacctgaaatatggctagggtgaggaagagctcaattttaaattttatttaattttagactttgataacttgatttagttattggaaagcttatttatatttggaaacatacttgagcttacgcatctacttttgaaactaagtgttttgaaatccaaacgcaaattaagtattttgatgaaaatttagaattgggatatgtaagtgcaaagtaatcttcagatttcaaagaatgcaaaaaaagtagaatagcccattaattttatgttgattccatgttcagatgataatattttagatatattgggttaaatgaatatgctattaattccacctgtttattagtgtggctactagagaattaaaaattacatgtgtagcttgcattatatacttcattggacagctcaggcctgcattactccttttcatctatgaattaatttcttttctttttttctttctttttttttttttttttttgagatagagtctctctctgtcttccaggctggagtgcagtgacgcgatcttggctcactgcaacctccacctcccaggttcaagcgatcctcttgtctcagcctccagagtagctgggactacaggtgtgtgccaccacgcccggcagattttttgtatttttagtagagatggggtttccccacgttggccaggctggtcttgaactcctaagctcgggtgatccatccgccttggcctcccaaactgctgggattacaggcatgagccactgtgcctagccccatggattaatttcaaaagtggtgactgtatgaaatattgttatttcatgtttgtgtttctattttccactgctgtgttccatgtgatgattggggaccccaagtattacattattactgttatattagggagattagtgtaaaagtccagggttctagaacggctagcaggggtgtcatgggaaaattgggatacccacatacccggctattgctgcttttgtaaaaggatcctgaacatagcaaaaggtaccggaaaacaatgtgtggcaaagtaacaattgtgacacctggtggcattttagtgattctactcatctgtcactcacttccatttattttttctttgcttcatctactttctgtccccctccccaccaaatcacggctccactcgtggcatttgggcccacaaggctgctgactcctttcctccaaaaaaagtacaatgctaacgtgaatagaggtagtgctgtctttgggttttgttttgtctaatgagattcagaaattgcactggaaggaacttaggagctattcggtgctatccctttattttatagatgacaaactgccaaacacctcacctaagaccatatagacagagactggaattaaacatactcttgttgataactgtttagaggctccctgagaaatggagaggttcatcaattaatcaatcaatcaagtatctgttgagctagcattttgtggaaatgaccactaagtgttgtgaagggacatgagtaaaacagtttctgacttttttagaaagagtcctgttgacttgaggaaataagatataaacagcaccaaattaaattgcagtatacaacacagcacttaatgagtgcagtgccactgtggcatgtgttactagttagtagaaatgtgttcattttacagatgtaggaatagaagcttcgagaagggtggaacctgcagggaagtggagtgtaattgtgttcctggaacagcccaaggctgtagaattggaggtcattgcaagtctttggtattggctcctttagctgtccattaagggaatttgaaaatctgagacccagcattttcaaatggcagtgctgtagtaataaggcaatcatagattaattggagaccatcagggtttttagagatgtttagccaggggtggatcattccgaagttagctggcatataaaactgacttgtgagcaaaccataaaatctaaaatccggggggtgagagtggtgaaatgtgatgtagagcaaaatcagaaagtaaattaactgtggagtatacagttggactaaaaatatttgtgctgagtacatgtttgaaggggagaggcccatataatgtaatatatgggccagtcatgtatttataaatttttagtctcctggagcctttttggactaaactcttggtcaacatgaggaagaaagctcagtcttctctttgttaccgtgtccatagggtttttttttcgtccacatggaccttataaagttacatagcatgagattaattagggccagtgctcaaagtcagtaaaatgatgacacctcttctctaatcactctcagttaatgcttctctttgagaattggggctaactttgtatagggcggtggtccttgacattttcttgcctttctgcctatttctttttccataaaagagaaaaaaattctgtaacctgccacctcatcaatctttggcacaaattagtttttaaaaactcagtatagcaaagttttgcaataaaatgcaagtatacattctgtgtacttgtgacaaagcagtattggacatttgagcaacttttgctgacagtttataacatctcagtgtggtcaaatttggccattttatatagtatcactgaattagatgataattttca

SEQ ID NO: 4954 - DNA, 2093 bp, Homo sapiens
ggtgtcatggggacactttcatggactcctcacttcaggaccctcttactgggtttctcacacccctttcatagtttatcttttcgccgcttttctgtaatcatatcagagactgatgattgttggtgactgcttttgttgctgtgattagaatcacagagcagaagaagcaccactaaccagtggaagcatctcagtgcagagcacagaagtatgactgcaatatacacgaaatagaactagaatgcctagttctgtaagtatatcacacactaggacacaggtatgtgtgagaaccccgcattatgaagatcagccattagaaaaccactgtgtaaaaggatccactcaagataagagcagctgccatttggagaaattgaaaaaggtatgaaatcagaaagtcagatcacagaagagaatatatgtttacttccaaatttaaattttaaaagtgtgatggctatattaaaagtgcaatttacttaactgtcctgcttaaagctttggggtaattgtctaggtggatcttaagtgtatttctcagttcaaacaagcaatagtttcccaggtgaattgagaagggatcagaacctaaggtcagggagattcattctgaaaaaaaagattcatatgtgggaaacacccctatttttttcccactgggacacaggggtgcacacctggtcatctctaagtggcagtaacacatatgaagcagacccttgtggtactgaaatgtattaacccaaagacctgtcaccacatactcgagcatccagactgaaatacttagagagatcagcttccaacagaattaaaaggtagatcccaaggatccattttgagcaccttttttcagcctttagttttaactggaaatgtagggactgtgagttactgtctcatattttgaaatgaaggtcttttgtttgaggaatttgcatttcatcgtagaaaccacgttcttggtttagttactttctaccaaaggaagttcttcctgtgttttgcaagtaggatgaagaacctaacagactccaatttaaaaagaatatcagagatatataattacactggtttaaaagaaatggggaatctaatttcagattgccacatgatgagagctgttgaagtcgttatcacggtatctgagttagtcacctagatcacatataatagattctcaaatagattttaaatcagttataatagtaattaagactttgttgagcatcccaagtaaagacaggatacttcatatttcgtatgagttaaaatcttaatattaaaaaaatgtatataacttgtcttaagacctagaaaaaagcattgttgacatatttaggcctgtaataaaataaagccacttctttgtaggttattttgaagatgcatgttacctagaagttttcataagccaagccttagcctcacagcactttactttcatgaaaaagatttaaaagaattaagaaattgtaaggacttctagagaggtgcatgccttattttctaagccattaaaggtatacaattctatgattcacaggcaaagaaacccaaagtagtttatatatttattaggaaaatacctgggacatatttacataaagagggatggaaaatgtgtgacaaatttgacatttaaaaaaattaagatttacattgtaatgacagcagtgattcaggttgtaaagattgatttacagtggattaaaattctgcttagatagtctttatctagaaccaggaaattcaactttcagaaagtcattttctgattcctatttagggagaagtaagatgaaccaaaaaaaatatgtggtaacccaaaacagtaacaaaagaaacctccttggtgacctaaataactgtatatgaaaataataatgtcatctgatatggaaacatgtaaccgaaaactttaaaatcaacaagtgaagacaaatagtacccatgaataatgtttaatgctgtggttttttgtggatttttttctgtcactaaaatggaatatttttctcactgctgcactctcttgtcatctagctctgccaaatttttggctattaaatctctgaatcaactca

SEQ ID NO: 4955 - DNA, 991 bp, Homo sapiens
atggggagtcgtgacctgcgccccgggccggggtcactcaccggcctcgctctggttgtagtagccgcgcaggttccgcaggctctctcggtcagtctgtgcctgggccttgtagatctgtgtgttccggtcccaatactccggcccctcctgctctatccacggcgcccgcggctcctctctcggactcgcggcgtcgctgtcgaacctcacgaactgggtgtcgtccacgtagcccactgagatgaagcggggctccccgcggccgggccgggacacggaggtgtagaaatacctcatggagtgggagcctgggggtgaggaggggctgagacccgcccgaccctcctcccggcgcggctcctcaggtcctgcgcccccgcctgcggtcccctcgctcctcccggcagaggccatttccctcccgacccgcactcaccggcccaggtctcggtcagggccagggccgccgagagcagcaggaggacggttcggggcgccatgaccagcatctcggcgtctgaggagactctgagtccgggtgggtgcgtggggactttagaactgggaccgcggcgacgctgattggcttctctagatatccaatacccaatgggagtgggaagtggggacgcgtcacgagtatcctggaagaaggacccgacacaagttgggagaagaagtgaaactcaggggagtggggaatccccaacgctgcgcctccccattgcagacgcggccctcggagcctgagaccctgagagccccgtccgggacctgggacttcgtcctgatccctcttctcctacaccaagcctctttgtcacactgtctgcctgagtcctggacaaggatctgtctgtggaaaccagggagagacccccaggctgcgcccagccccttccccttcacttctcgtcctggaatccctgtccctgaactggactccctgcctcccactccttacctctcctcttggactcttgtgtag

SEQ ID NO: 4956 - DNA, 577 bp, Homo sapiens
gttctcctcctcgtcgcagtagaaatacggctgcaccgagtcgtagtcgaggtcatagttcctgttggtgaagctaacgttgaggggcatcgtcgcgggaggctgctggagcggggcacacaaagcgggaggcagtcttgagttaaaggggtcttggtgcggaaacctggcgcagcgcgcagtgcgcgccacagtcccgaacctctccccttgcagagctatcccctaaagcggctgggtggtcttggtgggggaataaagggagcaccctttcaccccctttggacagtcccctgctatctcggagacgcacttagtgaaccagcggcttggtgcccgccgagcccccgctcccccgggagcccggagcgcaaagcccgggagtcggccccgcagcggcagaggaatcgaaatcggccctggcgcccttaagaagccgcgggaggtggcggtgaggaaaacaatttgccaaaatccaaggcacaaagttttgcgccacctgaaggagaaggcgagaggcgcctgggcgctagcggctgcgtgaaccccgctccgcgccggggcccctccgctgcgg

SEQ ID NO: 4957 - DNA, 13748 bp, Homo sapiens
attctcccagctccatcggctgccaacctagggccatcgtctgcctccatcacccctccgcccgcccgcctacccacccaatcccaaacgggtgctggatcaggtgctgaatccggctgcctcctcgggtcctccttccccttccctcttaggcatggggagtggagcaacagacggagagtggcatgaagacacaaaggaggaagcacaccattgccaagaccccaaggaagaaggatggaaagcgctggcagtcctgcctggcccccagccagttccctgctgaagatggccagatccccttgtctggtctgtatatgccacttttgctggggtggaaggagggaagggctggcttgctgagctgggctctagaatgggaagggtacctttctgcagatcccatttggactctccacttgaacaagtgaggtgtctgattttcttcttcggtaccttcctctcctccccctcccttcgcctcaccccgctttcatctctcatcaccacctgggtcctactgcttggcacccaaccaactggatgctgccacgtttggcagtgctgcactggcacgtgaacagtgtctcagatcctggcactgcagcaaacccaaagccaccaaacatgctcatgatgccacttggcagcagtcagagagagggggctgtgcacatagtggtggccaggcattgggtggagctctgtgcagggaactggcatgagaggatgcccttaacaactgggctgagtcagcactccctggtcaatctcagctctgccttcctcccaactagatatccacctccttcctacccttattgcccccacgaaagggatttagatggtaccatattgagtgtttgagcaccatgcgaaaggaaacaagcacagagggacaggctagagcacaggctgtagacacacccaaggctccaggctagtggaccatacatatccttggacaacaagaacaacaacaacaacaacaaaaccctaggagagcaaaaggaggtggagagagggacaccagctgtgttgttaccaggatggcacaagaagagattggaagggaagtaggaaggagtgaccctcagaccttgctcttgggtgatggggtggtttgtacttatgcatatttcattctgccttgtgccttgtgatttgctgagctgtggttgagatgaactggttctttctcccttgttaaaaggtccatattcaataatagtcctagaaagatggaaaggtgctctaggcctagagaggtagacaggtgttaggaagacaaagggacttgtccttccagaaagactatgcaaggcacccagttagagttggatagatttccatatctttgaaatccatcccaagaagggagattgaggataagcaatgatccctggtagaggggaaggcccctaggaggagaatccccagcatctgtggtgatacagactagccctcagaaaactagaccttgagcccccatctgaaagaatttctagtaggtttggctttcccagtgactgggcagatctttagaagatctggaagatttggctgtgggtgatgtggaggggaggctgggtggctctgggagataggacctgcccagaggtaggagtaaagtccatgctgggctgagctgctcagggctggggaagttctgatttcagcatctctggaagtgtatggctacttcagaagaagcaaggtgttttccacagcagaggagaaagcagggaggcactcagccaaagtggtgagtggacaatgtttctatcttttctcctgttcaagaacagccaacgtgagcagaagaccatggtcagtttccagtatgttgggggtgggagtcggggtgatgtcagagtaatgaagtcaacaaatctgaggttatgataagccctggtgtggtagcccctggggtagcagggttggtccctgggtgctgaagagatgggggcaggtcacagatatggtgctaagctctctaggtcagtggttctcaaacttcagagggcatagaatcatttcaggagtttctggttcagttggtcttaggtgtggtccaggaatatgcattttacataagcactcatgttccaagtggacacttgaaacgttgaaaaacactgttctgagagatggcagtcacctttaggatggtcgatccaatcagggtttcccttgccttttgcatctgtcttccccagacttactcatgtctttatgctgacatgtttgggatatgtttgttgtggggtgtgtgtatgcgttttgggtgggagcagtgggaggaaaaggagagattgtgaggttgaatccagcgaatgtaacttgttagaacaatgatcctcactggcagtagttaccacagaagaatcctttagggaacactttgaaaattcactctttcttcacccacagattctgaaggctggctgcccgtgggtttctgaaacctcatcattgagaatcactaggttaggaacattgtcaagagattattctctgtgatcaagtcaaaattgtgtagattttgtggctaggtacaagatgggtcctggaggcaggcctgggtcccgggtaatggaagtaggggtccacagagtacaactcagcctactgctgatactcagcaaatggcagaagatgctgtggtttgagcacttggtggggacatctagaaatgagcacagcatgggtcattcttcacatccaattgagaagacttagtgcagggtttggtatcagggaggacttgtagatatggggcagtgctgagcccctgctgattactggttgtggtgtcttagccattgtttgtgtaagaatatgtgtgcagttgggtgggattaggagtcaaccccgggtgctgcatcacctttccccctcttcttggacaggttcagcttgttctggtctacctatactcaacctgcttccccattagcttctggccagacttctttccatggctgcggaattgcaagaaataccatacttagactactgccagagaataatgacatttaccccttgtctgtgctttgtgtgagggctgtctgggttccatatatgaaggagcgtcactgggtggtcacgcaattgaatcacgcaattttatcttcttcccataacatatagtttctctcaagaggaattaccttcatgattacttcccatctttccccaaacttgatgggccatggtcaagatcttctgcaaatgtcctctctcaaatttgccttcatctgatctttttataatgtatctgagctataatcctgtagaccctgaggctgggtctacagacttgctgtagcaagagctttctcagtataaaggcatttcttcccaactcagtctcctagaaatgacgctttcatggcttataagtttctgactggttgcttctgagagaaattgtcccccaatacctggccattcgcagaagtttaccctgtttttcatggtgacatcatatgagttttcccaaaagtttcctcctaatttgcctcctacatatctcttccctgatgtccagaataatttacggtcctctccccatcgggtgtgtgtgtgtttgtttgtttgttttttgtgactgcgaggaggggagtggacccctcaaccatgtgcgtgcccccactgctgccatccccctgtcccctcttgactgccagcaacagcttggtatgggcccaatgcccatccattttcagggctagttgatttggcaggtgagttgttacacactccttagcagatcctctccccatatgttaatattcaacatttggtcactcttcctcttaccggttactttttcctctcactttctctgtttataagctttttctacctacttttgtgtgagaaaaattagcgtgtgttggagggtatttctgcttatgggagtataggtcatgggtcttgggatatgtcccttgtacttatacatatgcccatggggccccatccttgctggcactggtgtgtttccctgcagccccctctgctggggtctgctgctgtttctgagggtgtgtttgtttgtttcactggtgtagttatatatatggagctctatatttcagatttacatatctttccagggatgaatgactgtcttaaaacagatcacagtggtggagatttggagaatcagtggtctggtctataagccctgagagtggttaagaaacaaatacaaagaattaagcagatgggtgctattatgcctggaataaaaggcttgcttggttcttaagcctacttctgtaagtatactccagggctggaagggtgggatagaaacagatttctttatgtggttcctgttgcaaactctgtcttgtttggccattaaggcttcagattttcttatattcttctagcaatctttttgttcctagttgaggattggacaccttacaccatcctcacacagactctggtttagagcaaaaatagccaagatcactttcaccaccgcctcttggtctgaccctggtcgttaagtagggcagagctcaatttgggtgcctctttaaggacgagtgtatgttagaagccaagccctagggttaggggtgggggaggtactgtaaaataggtgttattgtgccaaatgcttgagttacggctgttactccacaggagaaataccatgatttaattctggtgacttggcattagcctctaggattctgcaaaggattgtgctgactcagccttctgtccaccagaatgcccactgtgcattgctctctggagcaggactgctgctgctaaggacttctggtgtgagaaagggactgggaaggaatgcttccagccactgggaacatggaatggtgccccctcaggaagcatgttaattgacctaagtcagcagagtcagcccggctcttttgcccccaaattccagggttccaggtaagtacagttgcttagagtcagctcatatctactgttgggaccgcacgtggtattgccaggccagggtgttaggtgtaaaagaacatgttgcgtgacaagaggaggggggatttctggttacatcaactctcggtgaaaacactcatagttcaaactgaagttggctgaaatccttaagatacagcacaccacacttctaatcattccatgccaggtgtttgtcgatgctttctttaaaacgtttcctttgtcttgtttttgttctaaattgtttttggtttctaacttttatacacaagtcacattcccagaaagcacaagtgaagaatcttctttcctcagatacatgctgctaagaaaatagttttatatatagaatttcaacaggagagagaaaaggacagggagagaggggtacaagagaggcggggaaagaaggtggcagtgagcacaagacccggtggccagtttctctcctgttgcctagatctgtgactggcatttttggtatcagaaattggggtggaattacaaaactaactccgcctaatttgctgttagttagaaaactaactccaccccacccctaatttgttagagttggagttattcagaagtgaatgggacaggaagtgagactcatggaatatatgggggctactgactgagctgaattttctgtcccctcccattctgtctgcatgtaagacactgcttcagtattaacatgttcacagagtgatgtgactgatagagcagaaaacctaaatcccagggctggctgaatttgtatgagaatatgaaatggataatgatagagcaacagcctggaggggagagaggatggaaggagaacaccttgaaagagaagtggtcttagggacaagagtagtaggaaaaactacctggaggacgaggaattttgcagacttttctttgctaaaagaaaacatggacttctctaccccacactactttagctgggctttagggttgccagaattttcacctgatggctacagaaaccatttgcctaggggtacagaacattcttctaggttctgttggttcccttggtgataacaccctatcaaagattgacctgtgcttcagtcatctccttgcccaccccatcccctcaattcgtgtcagctctagaaccccatgagtctcatggacgggtcccgactcccttggggatgcctccagcagctgctgcttaacggagaagctgggctgggctggactggagggagcaggagcaagggcagaggacaagggggaagaaaaggagactggggggaagggaacaagggacccagcaaaggtgggcctccaggggggcagcagggttaggagtttgtgagaaaggtaaatgcaaggagaaggcaggagatgaaagagaagcagatctcagattcagaagttaaataccccactcacccccttcttcctgggactgccaagatacttttggtgacactgacttttctaactcatagctggaaatgaggggctattacctgtcctgataaatacccaactcagggagcggggacatgtccctccccagagttcaggctcttctccctgtatcgccagctcccaccttggaggctgcgcatagcaggggagggctgcaccggcatcggcccttcgaggaccaccagacccatagcaaggagctaaagctgtttggtcttccaaagatgaggtggtttaaagaaacccttaaaccgggggggtgggggtgggacagggagcagggagtgacacaaataggaaaaaaaacacttgtctgatgggagttttcttcctttttttttttttctgtattttccaagtttacgtttttctttagttcattcctctggtgtccgtttctctcttttgtgcgcgtgtgcacgtactctctctcgctcttgcttttttggttgtgtttcagtttttttttttgaaagaactttggatttgccgttggtgggcagtgcctgtccctggaggctggaccctcacgtggcagggctaggacaaggggcaggcccacggccgctgagaggatctctgtgtttaaagcctttgagaataagttactgcagttcccagggtgcaaggtagggattggcagaggggtttctggtggcggcatcccctagagtccaggccacaggggctcccctgtcaggcaaggagagggttaggagggagagggtaggaagagtgaaccagaagcacttctcccatgccagcctccagtttggttagagttttgtgggctccctgcccatgccaggctccaactttgggagccaactgagcatttggaaagagtttgtgagcggtgtggtgctctagacaaagggttaggaaggagaagagagagtggcgaagtttgttttccttcccccttctttgccttgggctttctttttcgtttcttctttttatcttctttttcaaaattttttggtgttttctcagtggaacatcatgggataacgtgtgtgtgtgcatgtatgtgtatgcatttatggggatggggagctgggaattcagtgaggaaaaggaagatagaaccaaggatatattttgtgtgtggtaggcagacatgtatgaataatcagggtgccaagatgggtgtatgtgtctgtgaagatgggcaagggctacatctgcaaggagctgaggaggaggatcaatgtgtgtgtctgtggggattgggaggaggcaggactctgctggaagtggggtgtgtggtgcccactgagggtgggaactgaacagttcctgtgaggtgggcggggccagggggtggggtgagggatttgagctcccaccgaacaccccttggggtaaaagagggagccctgaggccctcccctctccccatcttggttaatctgtttataaagctagaagtgtagaggtagtcgtagtttttgggttggagtccgtgtgaggtaatcttgcttcctctttggcaaaagccacagcagccgaggcagcagtggcggcgttggtgatggagatgggtgggcccccttgaggtggggctgccttgcgcctgtgggccgaggagcgcaggtgggaggctagggcttcacgcccactcagcagcacctcacatgccaggcagtggtaggtgcagatgggcacccgcaatgggggtggcatggagcccccagagccccgcccaaagaagcagaaggatctctggtgggcagtagccggggcctccccgtcaaatgccatcttgcactggcggcacaggtagcgatgggttacatccacggtggagatgccagtgctgcctgtcagcagctcatcaacctcaccagcttccccctcccctggagcaggcagttcaggaggctttggaggtgctgtggctgtgggctcagggggctggggtggcggctggaggagggcattggggagcagcccaatgagggtctgaggtatcatggggttcatgggaaatagccccttcttcatgccatagagctgttggaagtaggccccctgtagctgggggccaaagacagctggcggtgctgttcccccagcagggggcaatggaaagggcaggaactggccccccaacagggctgggacagtggtcttcaatgctttgaggttcttgagggcatcattggaggagctggtggggcctgcaactggctttcgctcactggagaccttgtcccccaagggctcagtaggagggcctgggacagggtcagtggtgcctgctgtggaggtgttggtttggtcgggcatgggtctctgaggtaaggggcggcctgggccagcagtctggaccactgtggtggtaggcaggaccgaagtggcgaggccgaggaggcctgaggaggctgccgggcctagaaaggtgaaaggaaggatgaaggattagccatctcctgtcccatcattcttcctgccataggccacctccagccacacacacccgttcccagcaccggatttccatgccccttccctcccttctttcccccaagagcctgatgcaaaggaaggccacaggagattgggcatgggaagaatcaggaaggaaaaggaagggcatgtcattagagggggatgttctctgaagtccagctcctcccagcctccctactcacctgaattgaaaggagctaagttgcccagcgggggctgagccagagctgggccagataagaggaccggcgccaggcgaggcaaggttggggcagccccgaggggcatggaggcaggtgtggtggcaggtggggccttgagagctgggggagcctcaggtgctggggccaagtcgtagcacttgctttcactcttcagctgggctcgaaccgcctccttgagcttggccaggtgctgacgggaaaagagatggcctcggcaggagacatagaaatcatacttgacatcacaataggggcagtcagtgcgctgggctgctaagaggccctcactgctgcccccagtgctcccagcggctgtcccctgtagtttggccttcttttccttggcacgagcattctggaaccagacctggatgactctcttgggcagcccaatctcctctcccagcacctcacactcctgcatggtgggggtgcggtaagcttcatagcaggctttcatgatcttcagctgcaggctgctcatctgggtcctgtagcgccgctgccccattccatctggaaccccagtcccacctccaggtcccccactggtccctccagccccaggggattctggttcagctaggctggaagcagatgaatcactcagatctcctgcagagagactgcaagcctcactctctggagaagctttaggtggttcctctgggccctcttcctcactgggtggagggggaggtaggagaggtagaggtggctctggtgttggggtggtggcctctttcccaggtggtaggaaaggctggggcccagaagcaagcgtggcagtggggtagggaaaagcaggtgcttccctctttggggcttccctcccagtgccatcatctaccttgcctaataagaggttgaacttgggcaaggatgcaggggtggctgtggcaggcggtttcactgctggactaggcacccccccaggggtgcttcgaaactggcctttcctctcccgggccctggtattctggaaccagacctgtaccactcgctttttgagccccacctcctcggagatgcagtcgagcatcttgcgtgttgggttggaatcctgcatgtaccaacggtacaggatctctagctgctcaggcaagatggtggtgcgcaggcgcttgtccctggggggctcgccctcccctcctccccctgcttcactgcctgtgggagacaagctgccgtcctcatgcttccgtttgagaggtggacctggcattggtgaggtggctgccaccagggggtttctctccccaaacaccagcaagggcagatctaggagttgggggggagcactgggctgcagagatggcaggaaatgtagtcggcggtgactggtcaggaggtcctggctggagaaagaaatggcacactggtcacaggtatgggctggggaaggtgatggagtagccttctcttcaggctctttgcctcctgcctttgttgcctctgcttggctcagctcctccccatctggaggctctggtaatgggccctcaggccctgctggaggttcaaggccctgttcctcctctacttcttcttcttccacctcttcctcctcttcccctctctctgcctcttcctcctcctcttcaagggtctggtcatcatagcacttcttgaggtggcgcaccaactcaaaaacacaggagaaagtggcgtggcaacgcctgcagccggaggctcccccagtgcctcctccggttggcatggacccaccctcacaggcatttttgcgtgctttctggcgggcattctggaaccacaccaccaccacacggctagccagacccaacagacttgcgagtcgctccacctctccgtctttggggtaggcgctagtctcaaagaaagactgcagggcttgggtctggaactctgtgaacttggttctggagaaccggcggccggcaggcaccaggggaggaagattccctctggagctttcttcctcttctatgggccagtgtccccctgctcgacttcgctcttcaggggcacgggtcccccctgcctcaggctctgggaccaggaagggtgggcccagatggggaacaggtgaatccagagacccatcaggaggtttgggaggctctgcaaggggcgggtataggctgtcatagctctttcgaaactgagcagcataacggctcagggcttcaaagggcagaaagcggcggtggacatgttcctcgtgtgtcttgaggataagcatattggagaagagtttcccacaggccccacaggccagcttgtccccacccccgagggcctcaggtgggggtggggtagggggagggggcacagcttgcttcccttcattgtactggatcaccagctcaaagccaaagttttctagaagggctttggctgcagtgcgggcagcctcgttgggcaatgggtcggggggtgaggaaggccctgcctcattaccctctttggccatggggggccgctcccactcccgctcagccagctcagccttgggaggttggggtggaggaggaggggtggcagctggcagggacagcacaggtgcaggcccagctagtgtcagcttgggccccaccttgagatcgtggaggtagaagggcaggagcagctgctgctgctggagcttaagcagtgattcgggcaccagagggaaggggggcaggactggtggggtgaagagaggggctgggaatcggtgcaggtccaagggaggtgggggaggggacaggaaaggcaatccagatatgaagccactggtgtcagggcccttcttctcagtgcccacctccccctctgtctcgccttccttgggctcttcttggctgcgttctggcccttcaatcttggaatcagtcttggttccccgagagcgagtctgatgcagaactgaccgcatgtggatctccagggtggagctctggttgtaggagactctgcagactgtgcacttaaagggcttgtctgtggcagcagtggtggtgggtggggcaccggcctctccccgtgcaggggcagaggggtcaatggcagccttcttcatcttgtgaaggtgggagacagaattataatgaaccaacagaatattcttctgggtgaaggactccttacacacagtgcacttatagggccgggcagggtcgagaaacttgtccagggcaaagttggtggttttccgataggtcagagggtggcgagagtcagctggagctggctctgcagagcggagctccccagtggtcccctcttcctcctcagccatggtgggcggaggagctacgtcttcagcttgggcatcaggttcagggactggagatggggctggagaagggggttggccagggcttcctgagggtttgtctgggacctcaactgaggccaggggaggctcaggaagaggatctggactggcttctggggtcaggttagggccttctaggggagagagaagaaagtacaatgaggagggaacttcgtttaagccagaccccacccactcaataccaaggcagttgaccttggcctcagtcatcttcagaccttgttggcccatggagtcccctttcctggtaccttgggaggtttgctgttccattccttacctgctgcctggtctctgctcggtgtaggctctggcccatgagtggggggttcttggccattgtccagagggcttaatgtgggtgcagacagcactttggttgtaaatgtcatttctacagttgtagcctgcaatgagaaaaagcctagtggcttcaccaccaccccccactgcccctatgccactcctgacccatctgccctacacctgtacttgtgccgagatcccttgccacagatccagcctcctgtctgaacaaacctcccacctaattgctgcttttgctacagatgagagagcctgggctgctacctctcctatctggcttcctctttccccaaaccagaagtcatcattctttgaggctacctggtctggcaggctggtacctgctgttcaacaactcttctcaggacttagtggaggtgaaacagaagcctctgcctcatctcttaagtagaggcagctagacaagctcagttctgagtctccctctctaaaatccaacttcaaatccatgaaatgctgcttttgttgccaacacatgcacttgcctgaatactcctgcctcttcctcccctcctggatggccctaacaaggccttgtcggaccgtcctcacccagccaacacacgcacttgcctgaatgccccctgcccccaacacatgcacctgcctgaatacccctgcctcttcctcccctcctgcacagccctaataaggtcttgttgtaccgtcctcacccagcctgtactcactacaagcagcagcttctcaacgcactcgggcaccacgttgtgaaggtggctaaggtggaagtgcagggcaggccggcccaccagctgttcctggcacagtgggcatctgtacttgggctgcactgcatgctgggagagtgtatgagccctcacctggctggactctgggctcaggaagctgcagtatggacagcagtatacctggagggaacatatgggcagtggacgaagtgtcagggaaggatgggaccc

SEQ ID NO: 4958 - DNA, 3251 bp, Homo sapiens
ctaaatcaagtccattttatttgaaattttccacatgccacacatgtacatgaaaattcccatccagaatgtagtttgctacagtgaacaccaatgtcaggagcaggcatcaccgtgagacgccacgggggcaggtcagcgggacggggacagggaggttggtcatcgaaaggcaggtgatgcatgtcgtgtcatttagcacctggtcatgagatacggcgagacccccaggtccagggaaaggtctccccttaaaaccacgtggagctctgctgtctctgggcagtctcacgtggacagacaatgctcagaaggtggcgaaggggctggagggagataccaccgacggctgcaggggaggggcacgcacacacacaggcacgcacatgcttgcccatgaacaccccccgggcacacacacacccttgcacactccccaccctccctccaccccagacacatcagcacagcggtccaggctctggctcactccccgggaggcttctgtggccagggttcccatggcgggtctggtggcaacagcttggagaaaagcctcccgggaccaaccctcattcccaggtccactgatctggggtaggagtagccaagtgttctgacaggcggttttcccgtaaaccgaccccttcagcgtttctgctttttgttgtttgttttctgagacagggtattgctccgtggcccagagtggagggcaatggtgcgatcttggctcactgcaacatccaactcctgggctcaagcaatcctcctgcctcagcctcctgagtagctgggaccacaggcacatgtacaatgcccagctaacttttttttttattttatgtagcgatacagtctcactatgttgcccaggctggtctcgaactcctgggctcaagcgatcctcctgccccagcctcccaaagtgctgggatgacaggcgtgaaccaccacgcccggcccctcccatgtttctcaaaggagctttagagagcagaggagcccgagtcactgccaccactgggttcctcagtgtctgtggggtttgtgttcatcatgcccagtagatctagaaacttcttttgttttttttttttttgagacggagtctcactctgtcgcccaggctggaatgcagtggtgcgatctcagctcactgcaagctccgcctcccaggttcatgccattctcctgcctcagcctcctgagtggctgggaccacagcgctgcctgctgggggatcaaggtccccgcatccaggcctccagcaccctccatccctgcaggagcactgctggcaccgccaaggccggagcactggtctggagcttcattggccggcaggggcccagccctcagctgttggagccctacggctctaggtctggcccctccacaagccctccaggcccacgcctgagcccagccccggtcccctgggtccaacggcctgtggctctgggtccggacccagggtgtggttgagggagggcgctgctgagctggcaggcaacccttgtgtgtttgcagcgcaagaggagctcagcccgtcctggctgccgtcctgggtcgaagcagcaagtgtcttcccgccctgtgcacagacaggtcccaggagggcctcttggagaagaaaccgctcaggcccatgtcctggcagggcctctgggggcagcagatggcaaggatagagcccgccccctctgctgcagaaggaagcggccctcacccagcccccctgggctggacgggccgttgaaaacaagaaaagccttccatagcagaaaggagtactcaaggcccagaaaggcagctttgctctgggtcatcaggctcaagtgcctgctctgggccaccttcggaagcctggtggagccgagtgttgcctggtgacgtggagcaggaggcggggcggaggctgcgggacacggggctgcagggccgggaagggggtcaggagaataaatagcagctaggtgtggggtgagctgggagcacaggcaggagggggcagccagagaggttggggctctcccttttaaagaacaaagggatacataccctttcccctcctccctccctccaaccccacagtctctccctcacatacacacacggaagacgtgactcacacacacatgcacacacagggcacaggtacacgaaggcacacgtgcacacacagggcacaggtacacgcaggcacatgtacacacaggcacacgtgcacgcaggcacacgcatgcaggcacatgtgcacacacagggcacaggtacccgcaggcacacgtgcacgcaggcacacgcacgcaggcacggggacaagtgctgaccacgctcctccagcaggcagcatatggtctgctgcttaacagccgagctctgccaattggggaccattagggtgggttcttttcccagcatcaaatgctgcagaatataaattgcaactaacgctggtgccaaaatagcacttagagaaaataagcacgttattaacatctggtgaagcccatctcgggggtagcagcagcggaaattcttgctctaagtcagaggatggttgcaggggacactaaaaatacaaggtccactgtttcaggggtgctttccaaggcactgcaccccagcctcaggaacagcccttcccccagtcctgtctatgagtataaattatgctgctggttaaaaccgcttgctcatgagaacaggacacccaggcgcgatcgtacacacgctaggatgcattcctggagcagacgcaattctctagcccgagtggggaatgttctggaggaaggagtggggcggagctgcggtgcccagagacacaggccccctgagggtccgggaacctcccaggccactcgcccctgcctggtcggagagcaagaagtggtcagtcccaggaggcaccacaccacccgatctgatcgccgcgcctggtggtctccaggtgccattttaaagctctaaagaaatgcccaggaactgtgggtggggggggtgctcccaccacctctgagaccctcatctacagcccctgccccctggggccgtgggcagctggtcctgcggcctgcagactaggagacggggcctaggggtgtggctctcacaggccatgacaggagggccaggaggcctctgggaggcgaaggcttggtctggtgtgggtcccaccatcgggcactgctggaatcagcctgcagaagggtccctctggccaggaggcaaaggttctgcac

SEQ ID NO: 4959 - DNA, 2406 bp, Homo sapiens
tacttgggtgttcctgaatacttttaattccccaactactaaaaaatctcgttactaggagttgggttatgcagcgaaacggatgaacaatggattataactgccagaaagtcgagggtctcatactagcaacagcataaagccctgcttcttattgggagcaaaaaagcagattctccttccacagtctccttttggattttgcaacggagaactctgtggagctgctggttcacgtaaaagatcaggatccctctcgttgccagaggacacagaagagtaggaagcttttgttttcagaaagaaggtcctcaaccccacctcttcgaaggtgtttccccgaatttctcgaggacaaagaatctggactcctttgagagtaaagtttcctttccactccctgaagagcggggaaaacttccgtctttagtctccttccggttaaactgacaagtatcacaatcctttctcccctatcttcgggcggttccggctgggaacaataccctcagggtcaggaggacaggatctgagtgcaggccagccaaaaaggtgggaacagatgctccttccaacacctaaatgcttttttaaacggtcacctggatgtgcagccagggccaactatccctcagctcctccctgtcacaggtgcgcgctgcccacagattgccacgactggggggctccctaccagtcgcagcccaccctcgcctcaggtcttctctcgcgtccccgggcggccgcctgcgctaacgaccacatgaaaacgtctcagcacccaacaccatctctctatttcatctccatcagcgatggagagaacggattttgccgcggctgggctgcacagcagcgccgcggtccacagcagagcccgcgaccgccatcttaggcagttccaggaagcggccatttcagagcgcaccgcttagccgcggcggcggctctgcttctcaccttcaccgaggcctgaacagggtcaacagccagtcgtcgtggactggagggggaggggagagagggaggggaatgaaaaacaaaacagagaggaaagaaggattcggggacagggtgatgctctcagctcagggatatcgcctaggccatctccatagagatccgattcgcggctggcgcggtcgccggtctgaagataaatttagcactctagagcacccgaaccctacaatcttcacgagcgactctgccgccgcccaatcagcgccagatttgcgtcccgccaccaatccgcgctgagcagcggggcgggaccaaaggaaaggaccaagctcggttgaggcgcggcccagccgcagccgcagtcacagcctcagccgcagcggccgtgctacctaggtgatagcggagcggctgggtaggaagcaattgttctcaaacttcactagccccgtcggcgcggacgcttgtcgagaatgcagattcctgggtactgccagatacgaattgagcataccacaaaaaagttctcattttgtgtcctcccatcccattctcctcactaaccaaaggctaggaattatctgtgaatgtaggaccactggatttgcagtcttcatctgacactgtggagagtttctaggaatgaaacagatatatggccttgggtcccctttttttttcttttttttttttttaatagagacgagcatctcactatgttgcctagggtagtcttgaactcctggcctcaagcaatccccacccgactccgcctctcgaagtgatgggattacaggcataaaccaccacgcctggccagaaggtgctttaacaccaaatctgaaaattgttcagaagagaaacattgagcatgaacaccatctgtgcgagtcatttacttattgcccctcacctctaaatctaccttctgtactcttcttccctgtaatgatggggctagttgtcctcaaactgtttctcagacttctttttaagcttgcttcctgttcagttctgccaataggggtcactagagagagactgggaggcagaaggagagaatatgcttcctgttttttctgttcttgttaatgttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaat

SEQ ID NO: 4960 - DNA, 10141 bp, Homo sapiens
aggaagcgctcggtggtgaagtagcgcagggtcggcttcggggcgcgcaaagcggtgaggaagacctgcggcggcgggaggagagctgtggccaccgctgcgcgccggaggacgcaccgcccccactcctggagtccagcccggcgctcacctccgccacctcctcagggttctgcgccgcctcgcgaaagacttgcttgctgtgggcgaggtattggtagaagcggtggaaggtgtggatgtccgtgcggtccagcacctcctctgggctgcccaacaccttctccatgaaggcggtgtgcactgggccgcactcgatcaggctcaagctgctggccggagagcaacgagtgggagggggcggacgccagccaggccccagtcccagccccaaccccagtcccagccccaaccacgtcccggcccccgaccgcgagcagcaccgctgcgctgggaagtgaggcggaaagggcgctggggataaccagaacatttgaaacgcgggttcctgccggagcagccctcccaaatccatctgaggctacaagggagccctggtgtcaggattcgaatctagcggggtccctggccgctgtgtgaccttgggccagtcacctaacctctctgggctggagcttccccataacaataccaacacttcagcagctaggtcagcaggtggcacaatgcgtgccatgcgcccagcccaagtgcctggcacacagctaatgtgagccgggcagagagggccagggagatcgccccagagcggctcccgcaggacagggtgctcggcgtctctaggtcagagttaagagggttcggggaacgggggtgttgactcactggaccccaaagggcagcagcagaaccgccagactctcgcataagccttcgagcgcgaacttgctggcgcaataaacgtcattgaaaggcagcccttaggtggggagacgaggttcctgaggcgcagcggccagggggtcatccccgggcagacggtgcccctccaagctgacggcaccccactccaccccccccgcggaacctgccttcaaggctcagctccgcacacaaagaatctggagctgccgaggccactccctaccactcacccatcaatcctcccacgctcccggtcaccaacacgcgtcccgaaccgcgcctcttcatgtctggcaggaaggcctgcagcatccgcacagtccctactacattcacgtccagcacagaggccacggcgtcctcccccagcgcctccagcggccccagcaggcccaggcctgcgttacacactgcggagacaagaggcccgaccagcccgcctcagcatcaccctcagcacggcctgtcccctcgtgctccctgggcctgggaacatgttggtttcaacgcagggcggagaaggctcctaggagcccatatgcttccaggaggctcacccagcacgtccacgcggccctcagtcacgcgttcccgggcagcggccacggattttgagtcccttacgtccagctgcaacgtctccagggatcccggagggcatgccagggcccgggccgcctcccacagccggccctgtgttttcaggtccctcaacgtggcatacactggaggttttgggagaggaggaagatctgacttcccttctggcctccaagggctcctcccttctctccctccctgtccctgcctatctatacctttgaagctctgggatggatctgaagccagacgtacggccaagtgcaggccgatgcccgaggaacagccggtgatgagcaccacggtgcgggccatggtgagactgtggggagaggctggggctctgggcttgatatcacctgcttcgccccgccccgcctgcgggcccccaccccttgttgtgtctcccacgcaatctcaaggataagccttcctgcgggtccctggcccgctctccccaccctgttctgagccaaaacagacatgagcccactgcttggaacaacaaactgtcctggttgctggtcagagggaggggaggctttacaagcaggtgtgggttcccacgtgggcacagagtggccccctgggcagattcccctgggtatgcctctgtgccacaggagcgattatagtgaccgcagtttgctgcagaggctgtgaaagtaaaggcgttgggaggtgggagatgattgtatatgtgctggtttcgtccagggttcctagctcataactcacatgaccatggttacagtcttacgttgtcatgttggggtgcctcaggcctcaaaaaacagcctttcgtctctctgaccttctcctgtcctcttttcagctgcccaaggcaggactctaatctgattgtgggttgtaggatcctcattccagagtgggtccttgccccataccctggagaaaggaatgctgcacaaaggcccaaagaatctggactggccttgctgggcttagatcagaccctttttgcccaatcacattatcacagttgtccatgcttcagtcatggacagccaatggagttctccataaaaggcccaaaggacagggttcgggagcttctgagggctgaacgtgtggaggctgacagaatgtgcccagagggtgacgtaaccccaactctatggagatagaagctcctgctctggacccttccagaccgccctgtctgtatctcttcatatggctgtttatttctatcctttaaaatatgctttgaggctgggcacggtggctcatgcctgtaatcccagcactttgggaggcccaggaaaggggattgttggagcccaggagttcaagaccaggccaggtaacagagtgagacccggtctctgcaaaaaatattaaaaagcttcccaagtagccgggactacaggtgtgtgccatcactgccaccatacccagctaattttttgacttttttgtagagacggggtctcactttgtttcccaggcttttttttatttttgagacaaagtattgcttaggttggagtgcagtgtcttaatcttggctcactgcatcctgcatctgcctggttcaggcgattctcctgcatcagcctcccgagtagctgggattacaggcacccgccaccacgcccagctaatttttagtatttttagtagagacggagtttcaccatgttggccaggctggtctcaaacccctgatgtcaagcgatctgcccacctcagcctcccaaagtgctcggattataaaaaagtgccaccccacctggccctgtcatttttagaagattattttattttgagacggagtttcgcgcttcttgcccaggctggagtgctgtggcacgattctggctcactgcaacctccacctcccgggttcaagcagttctcctgtctcagcctcccaagtagttgggattacagacacgtcccaccacatccggctaatttttgtatttttagtagagatggggtttctccctgttggtgaggatggtcttgaactcccaacctaaggggatcagccagcctccacctcccaaagtgctggtattacaggcgtgagccactgtgcccatcctaaaagatcattttaactgctctggggtaatttcactgctgatgggcaggagtggaatcaagaaaactagttaggaggctactgctgtaattgaagggagagatgacagtgtgcagtctggaatagggtgatttggggatatgctttgatgagcaaaggtagagctgtcagtatttgctgctgaattggttgaaaggtgagagagactggagtcaaggactactccagggtttttaaaaccagtattgggaaaaatggagttgtcatatagtaaagtagagaagactgggggaggagccggtaggaggactggaaatgtggaattggggtttagacacattaagttcattgtatcaggtggacgtgttgtattgagtaggcagttggagatacagacctggagtctgtgggagacagtggggtttctttggtgggggggtcatcggcatctaagtgctattcgaagtcatgggactgcagaagattatattaacaatgtgaatattcacaagcttgaaaaaatgaatgtacggaagagagggggtcacactttacctcttattatcccacccccaggggtgaccttgtgagccacaccacacaggtacacacatgcacgcatatgtacacacactgtcacagaggggcaaagggggttggcgagagcgggactgagagcagatcccaggcctcagaaacccatgccacctgggccccctccctgtggccttcctggatgctgtagggatagcagatctgtctgggtcagcagggcaaggcgactggcaggagggggtggctgggaggcctcttcctccaagagcaggggcagcacatcatccaacaggcagagaagaccctcatccagaggtaggggcaggtcagggtggagtgcctgcctccttcccctagtgccccacacaaagctccaagagctccagcaggctcctgtctgtttccacttcccaggctttctgtggtcatgtccctgcccactccaaagggccatccccctcagccttccctccctctcagacccagctgaatccctgcctcggtaccgccccctcctggggcactcctgcccccttcctctgctgcatcctcacctagcctcctatctgttcacacctcccctgcaccagacctccacagaagttcagacagtggctctacaaccctactggcccctatcaatgacttctgcccccctgggaccctccactgggctcaggaaagatgggccattgtagcaaagtagccagtcctgtagccccagctggacctcctggtgaggcagcttcccagatggtggggatcgctcagtcctctggggcagaacagggtgagtggggctgtctccctttgattcacttagccctctttcttctttacacatttgcaaaatgtgacagtagtcatattactattcattctaataacagtccttgctgggtattaaacctctatactagcactttcaggcattatctccaccattactaaaaccgattagataggtattattatacccattttacagataagaaagactcagagggccggatggggtgggtcatgcctgtaatcccagcactctgagaggccagggcgggcggatcacctgaggtcgggagtccaagaccagtctgaccaacatggagaaacctcgtctctactaaaaatacaaaattagctgggcgtggtggcacatgcctgcaatcctagctacacttgaacccgggaggcagaggttgtggtgaactgagaccgcgctattgcactccaggctgggcaacaagagtgaaactccgtctcaaaacaaaagaaaaacaaaaaagaaaagaaaagggaaaggaaaggaaagcactcagagaaagcaaggaacttgcctgaggtctcatggctaatggagtgcaggtcacaacctgactctaccccaacccaagtcccacctaactcgtcctgcagatgccccttgggtatccagtgactgtgtctgggctttactgtggacttgaggcatgatcctgggctggcttctttctggaccttggtttctgggttgttgggttggttggttgattagattaattaattgacagtgtctcactctatcgcccaagctggagagcagtagctcgatcatgcccactgcagcctccaactcctgagctcaaggaatggtgccactgtgctaatttttttattttagagatggggtgtctcactatgttgctcaggctggtctggaactcctggcctggagcgatcctcctgcctcggccttccaaagctctgggattataggcgacagccatcgcgcctagccgcgcagatataacgggctaacgtgatctgtcttaattagccatccacagccgtcaccgccgtcccatccccagggaccgcacaggcccaggagacaaaggagggcgcgggagacagtggctgacggagcctttcttgcggggcggccagaggatcgctgagctcagggtctcccatcccaccggccccgcccccggcctcggccccagccccggccccagcctcggcctctgcgggatcgtcggcgaacacgtcccggtgcatggcggcggcgtagtcgaagccaaaggggtcgtccaggcgcatcagcagctggtgcaggaagcgcctggttgtgaagtagcgcagggtcggcttcggggcgcgcatagcggtgaggaagacctgcggcggcgggagaggagctctggcccgggctgcgcgcaggacgacgcaccgcccccgctcccggagtcccgccccccgctcaccttcaccacctcctcagggtgctgcgcctcctcgcggtagatctccttgctgtggtggaggtattagtgcaagaggcggaaggtccgggtgttcgtgcggtccatcacctggtcgggaccgcccaacaccttctgcatgaaggcggtgtccacagggccgcactcgatcaggctcacgctgctggcccgagagccgcaagtgggcagggacggaggcgacccaggcgccaagtcccatctcctgccccagcaccggccccgaccccggccctggccacgacccagaacagcaccgctgcgtcccgaaggtggaaagagcgctggggataaccagaacatttgaatagcgggttattgctcgacagccctcccaaacccatctgaggctgccaggtagccctggtgtcagaattcgaacctggcgggatccccggccgctgcatgaccttgggccagtcacctaacctctcttggctggagcttccccataacaataccaacacttcagcagccaggtcagcaagtggcacaatgcgtgccaatgctccagcctaagtgcctggcacgcagcaaatgtaagccgggcagagaccagagcggcttccgcaggacagggtgctcggcatctctaggtcagagttaagagggttgaggagacgggggtgttgactcactggaccccaaagggcagcagcagaaccgccagactctcgcataagccttcgagcgcgaacttgctggcgcaataaacgtcattgaaaggcagcccttgggtgggaagatgaggttcctgaggcgcagcggccagggggtcatcccccggcaggcagtgcccctccaagctgattgcaccccaccccctaaggagcctgccttcaaggctcagctctgcacacaaagaatctggagctccgggcccggtccctgccactcacccatcaatcctcccatgctcccagtcaccaacacgcgtcccgaacccggccgcttcatgtctggcaggaagtcctgcagcacccgcacagtacctactacattcacatccagtacagaggccacagcgtcctcccccagcggccccagcaggcccaggcctgtgtcacacactgcggggacagaggcccaaccagcccgcctcagcatcaccctcagcacggcctgtcccctcatgctccaggggcctggggacatgttggtttcaacgcagggcggagaaggctcctaggagcccatatgcttccaggaggctcacccagcacatccacacggccctcggtcacgcgttcccgggcagcggccagggagcttgagttccttacatccagctgcaacctctccagggatccctgagggcatgccagggcccgggccgcctcccacagccggccctgtgttttcaggtccctcaacgtggcatacactggaggttttgggagaggaggaagatctgacttctcttctggcctccaagggcttttcccttctctccctccctgtccctacctatctatacctttgaagctctgggatgggtccaaagccagatgtattgccaagtgcaggccaatacctgaggaacagccggtgatgagcaccacggtgcaggccatggtgagactgtggggagaggctggggctctgggctggatatcacctgcttcgccccgccccgcctgcgggcccccaccccttgttgtgtctcccacgcaatctcaaggataagccctcctgcgggtccctggcccgctctccccaccctgttctgagccaaaacagacatgagcccactgcttggaacaacaaactgtcctcgtttctggtcagagggaggggaggctttacaagcagatgtgggttcccacgtgggcacagagtggccccctgggcagattcccctgggtatgcctctgtgccacaggagcgattatagtgaccgcagtttgctgcagaggctgtgaaagtaaaggtgttgggaggtgggagatgattgtatatgtgttggtttcgtccagggttcctagctcataactcacatgaccatggttacagtctttcgttgtcatgttggggcgcctcaggcctcaaaaaacagcctttcctctctttgaccttctcctgtcctcttttcagctgcccaaggcaggattctaatctgattgtgggttgtaggatcctcattccagagtgggtccttgccccataccctggagaaaggaatgctgcacaaaggcccaaagaatctggactggccttgctgggcttagatcagaccctttttgcccaatcacattatcacagttgtccatgcttcagtcatggacagccaatggagttctccataaaaggcccaaaggacagggttcgggaagcttctgagagctgaacgtgtggaggctgacagaaggtgaagaactcatccatgtgcctggagggtgatgtaaccccaactctatggagatagaagctcctgctctgggcccttccagaccgccctgtctgtatctcttcatatggctgtttatttctatcctttaaaatatcctttgaggttgggcacggtggctgatgcctgtaatcccagcactttgggaggccaaggcaaggggattgctggagctcaggagttcaagaccagccagggcaacagaatgagaccccgtctttgcaaaaactacaaaaaaattagctgggtgtggtggtgtatgcttagagtcccagccacttgcggggtggggcgctgaggcgtggggtttggggggatggaggctgtagtgagccgagatcatgccactgcactccagcctgggtgacggagccagatcctgccactgcagtcattctggatgacagagtgagaccctgtctcaaaaaagaaagaaaaaaatttttttcctctgtaataaagcaataaacataataagggtttccctgtgtttcgtgggtcactgtcgcaaatgagttgactccaaagaggggaagggggtcatgggaactccaacttgaagccagttagtcagaagttccagggatcaggacttgtaaccgttgggaaggagggggtggtctcatggatctgcaccctaaccctgtgggatctgatgctgtctctggttgattacattggaactgaattggaggacacccagctgatgtctgctgcttggtgtgtgtggggaaaatcctccaaatatttggtcacagaagtcttctgtgttggtgactgttgctgtggcatgccagcaaaggacaaacatggtttgaaaagaggttttcctgcaacagaagggcattctacgttcaaaggtcagggtaacattagtgttaaaaagagagacgtggccgggcacggtggctcactcctgtaatcccagcactttggaaggccgaggcaggtggatcacttgagttcaggagttaaagaccagcctggccaacatggtgaaaccttatctctatgaaaaatacaaaaattagccgggcgtgatggcacaggcccgtagtcctaactccctggtagactgaggcaggagaattgcttgaacccgggaggcagaggttgcagtaaaccaatatggtgccactaaactccaacctgggcgacagagcaagactccatcttggaaaaaaaaaaattagcctggcgtggtggtgcatgcctatagtcccagctaccggggaggctgaggcacaagaattgcttgaacccaggaggcggaggttgcagtgagccgagactgtgccattgtactcaagcctgggcaacagaccaaggctccgtcac

SEQ ID NO: 4961 - DNA, 3069 bp, Homo sapiens
agccaacatgagtaactttatttataaaggtgtcacagttcttggcaagtaaatccattcctaggtaaaccatggcttctggcttcaaattcacaattcctaaggtccccctttttttacctggatgcttgagcaaaaggatattcggtttggaggctagagaaggaagcaatgatgctgcctgggtatttcacaggcatttgtataataaatgaaatgaacttggaaagcatttaaacaccagccacccatcagtgtgaactaagtaacaggtgaaatcataaggatggcacaatgtgtttgtcgttgtaacttgtttaaactaacttcactgttgtgaggttttcacggttcttctccgagggtcacttgtcagcttgggaggaggtggaacctcagctcttcacagttcctgatgatacataaagcaaaaaactgtttgactttctaaaaccttttcaacacaagccaaagccaaactacagactagtaacacatatttctgccctatatgtgttaccaattttaacacataaaattagaaataggttttttaaagcccatattgcaaaacaaagaagaatacgaacagattattcactaaaaaaatgcaaaacaccaacaatcatttgaaaagcgttaaacctcacaggtaaccacagaagtacaagttaaaacagtgagataaaactttcacctattactcagaaaagtttctttttttacgttgctacttagtgcagacaaggatttcaggaaatatgtacaaccaatattggcatatgctttctgaaaattgatttagcaacatttaccaactgtcacataaaagttatatatgttgactaaatttcacttgtaagaatttattccaagtcaatagtggaaatgtaggcatgtgaggttggagatttctgtgttgctgttgtcagtaaaacaattagaaaaactctgcatctctaatatcagtaactggttacgtaaattcagcctatacccctacaatgtgtttactatgcaggcattgaaaataatgttatatagtgaaatagcatcatgataatagggactacattactttatagaagatagacttacagaaaaaaggggcagcaaattgacacttaacaattttctcctgttccaaagatatccaatgttatataagaaataaccaaacatgggtaaggcagaggaaagaccagcacatggagggccaagctgtgagtgagttgggcttagggatccataaacccagagatgcagacgcccagctcagatggagcatcactcccacatacaacagaacccagagatgcagatgccccactcactccgatagagaatcaaccccatcccacataaaatagaacccagagatgcagatgcaccactcactcagatagagaatcaaccccacataaactagaacccagagatgcagatgccccattcactcagataatcaaccccacatacaacaggacccagagatgcagatgctccactcactcagatagagaatcaactccacatacaacaggacccagagatgcaaacaccccactcactcagacagagaatcaaccccacataaactagaacccagagatgcagatgccccactcactcagagaatcaaccccacataaaatagaacccagagatgcagatgcaccactcactcagagcaacaaccccacatacaacagaacccagagatgcagatgccccactcactcagatagagaatcaaccctacatacaacaggacccagagatgcagatgccccactcactcagatggagcatcaaccccacacacaacaggacccagagatgcagatgccccactcactcagatgcagcatcaaccccacacacaacaggacacagagatgcagatgccccactcactcagatggagcatcaaccccacacacaacaggactcatggaggcagtcacccagctcactcagatggagtgttaaccccacgcacacaaaacccagagatgcggatgcccagctcactcggatggagtattaaccccatgtacaacagaaccccgagatgcagatgctcagctcactgagatggagcatcaaccctacacacaacaggacccatggaggcagatgcccagctcactcagatgaagcatcaaccccatgcacaacagggcccatggaggctgacatccagctcgctcagatggagcaggagctgctgaagggtgttttggcccaggactggagcagaaggcagtagccctgaggcttacagagcagaccctatggccacatgcttggacttaggcctctgcttggctgcctgaaggctgcagggagctccttctctgtcctcaggttcctttcagggcctgtgccagtcagcgcctcccctggcataggtcttgtgcaatttctaatgacagcatgattcggagactataatagctacaccttcccccaaagcgaggaaagatctaactgtacaggccgctgtgaaactggaacatcggaggaagaggagctagaaagcttaccaggccgatgaggatgcttgctgtcaactgttccagccccactcggaacaagctgccaccaacgcatggcacccacagcctgcgtgggcctcgccgccccatcctgccttccctgtgcagcaaccagggcttggagacatcttcgcaccatcctgggactgggcagcgccaccccctgggtgctcttctctgccctggctcgctcccttcctgcctccgagaactctgcatgtggagcccagccccgtcctccccaggaccgacttgctggtgtagtcgaccagcaagaggggcttcagtaaagaggggaaggctgcactgaaaacatgttctggttaacttggtgaaagaagaagggtgctccactgaaatccagacaaggaagcctgaagttcttttccagggaaaagatgcttgggcctgaccggtatatctctgacggcaattctcgtctgtctttaagcatcccactcaacttcgcgccactgaagctccttaccctgaattccacccccagccc

SEQ ID NO: 4962 - DNA, 1360 bp, Homo sapiens
gccctgctccaccaggtagagctgggaggtttctatcgtcatctgaattaaacagggaagggacactcgagactgggggacaaacaggaaaaaagagccagcaaagactggtagtaatttattgttacacacacacacacacacacacacacacacacacacacacacacactaggttaacatcaaccaccgcaccatccaggcactccccagccaccacgtgtgggcacaaagacacacacacccctcttggtaggcagatttccctgtctgctcccctcttcctgtgggagaggcatgccttctgggcagtttaaaggtgggaagttacaggggcctaaaaaggtaaaagagcagcagctctgcactggccagctgtaaacagtaaataggccagtcatggagggtcctgaatccagatcctcaggaaggttttcaccaaacaccacagtcccatttgatgtgatgcccagcctctatccttaaggcatttccagcgtccctgaggcgctctgcttagacaactggcacagaagtggtcagggccttggctgtggctctgcctcctgcctcacgggaagccggggagtggagcagagaccagcattagggagccttgtggcagtggtgagaggctgctcaggaaggagctgtgcctctcccctggtcctggccccatgccctcagcatccttaagaaacacggctgtccacctttttccctgcaagaaaactaagtccatcccttatgactgtctcgggccccaaaggtgaagggcagctccggcaaggggagaactccgattgattggagtccctgttggggcagtagcagggttccacccaccgcggtcctaggcctgggggcgaagtccaggcctggccacaaggttcaaagatgtgtcagacccaagccgctaccccctactccgagggcgagggcggagaggctcagccccaggggcggggcctgtagtcggaggccgagcgggcgtggtccgggtagtccaggcggctctcggtggcagtgagcatgcgctccggctccaccacgaacatgtagtagaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccagg

SEQ ID NO: 4963 - DNA, 6371 bp, Homo sapiens
  misc_feature (1)..(1995): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaccgggccgcttcttgttcggcgtgggcggctcctggcagacccatcccgcggtgcagccgccggcccggtaggcgccaggaccccgagcctcggcggcggcggcggcggcggcagcgctgccttcactcacctcgtcctcgctcccgtcctaccccgttccgcgctgggtggagtccaagtctgattgcgagagtccggaacgccgcctcgggggcttgactccagccccggggatcgagaacggcgcccaggggtccctacgtctgccttgggggctcgagtcccgccctgggcgtccgtgacgtcgcccaggggtctccacgtctgccctggaacctggagagccgccgtgggggccccggaagctgccccggagtccccacgtctgccctgggggctcgagtccagctctcagggtcccggacgccacccagggggtccccatgtctgctttgggggctcgagtccagccatgggggtcctggacgccgcctcggcgtccccgcgtctgccttgggggcccgagtcccgccctgggggtcctggacgccgcctcggcatccccgcgtctgccttgggggctcgagtcccgccctgggggtccccgatgccgcccgggggtcctcacgtctaccttggagactggagttcccccgtgggagtctcggacgccaccccggagtcaccgtgtctagccttgggggcttgagtccagccctgggggtcctggacgtcgccgaggagcccccacgtctgcctttggggcttgagacctgctctgggggtcccggtcgccgcccaggtgggtccccacgtctagccttgggggcttgagtccagccctggggggcccggatgccgcccgggggttctcctcgtctgccttgggggttgggtccagccccaggcgtcctgaccaccgcccaggggcccccacgtctgcctgggggcctcaaattcagtcctgggggtcccggacgcctcccaggggtcttcatgtctgccgtgggcctcgagtccagccgtgagggtcccgaatgctgccttggagggtggagtccagctctgagggtcctgaagtcagctttgggggttcgaacccatccatcccaggggtccctgagtctacattaggggctggagtccagccttgagggtctccactgctgccttgggggcctggatgggatccagcgggtctgagtccagcctcgggagcccctgcggtggagctctgagtggggcaggggcctgggagatgccaggaggatgagagcggcgcccccctggtccaggggacagtaagaggcagccggtctcagagaagctaccccaaaactgttacccgtggtgtgcagagcgtcctgcaaccccagccctcaccaggatttcttgcgtttttcaggaaatcggttgtgattggcatgttccttaagcgtctgcaggaagccgaggcctttttggtatttcaggaggggttgctaacccccctccttgtaggatcggggtatcccagctgctaattcccctcctaacagccctgcagcgcctggattggaggtgtgacaggtggcatttttggcccgaagtccctaggcaggacgggtggctgtagcctgcgcgtttgtgtaaattaacctccctttttagttctgtgaagggagaacgtgattagtttaaaatcacctgcgtgaaagaggctcttgattagtttaaaatcacccacgtgaaaggggctcttgattagcttaaaatcacctgggtgtttcgttttatctcagttggcctctgaatgtttatcctacagcttcctgcaagctccagtctaccttctaagggaataacggggctcgtctttctacgttactttatgtgggagtagttgtaaaacagaatgagggagaccgcggggattgtgcggaaatgtagccaccgtttacatgtcgggaggctgaggtgggaggatcgcttgagcccaggagtttgacaccagcctgggcaacatggtaagaccccttctctaccctcccccccaaaaaaaaaattttagtgtggcatggtggtgggtgcctgtggtcccagctactcgggacgctgaggtgggaggattgcttgagcccaggagtttgacaccagcatgggcaatatggtaagaccccattatctacaaaaaaaaaaaaaaagggaccgggccgcttcttgttcggcgtgggcggctcctggcagacccatcccgcggtgcagccgccggcccggtaggcgccaggaccccgagcctcggcggcggcggcggcggcggcagcgctgccttcactcacctcgtcctcgctcccgtcctaccccgttccgcgctgggtggagtccaagtctgattgcgagagtccggaacgccgcctcgggggcttgactccagccccggggatcgagaacggcgcccaggggtccctacgtctgccttgggggctcgagtcccgccctgggcgtccgtgacgtcgcccaggggtctccacgtctgccctggaacctggagagccgccgtgggggccccggaagctgccccggagtccccacgtctgccctgggggctcgagtccagctctcagggtcccggacgccacccagggggtccccatgtctgctttgggggctcgagtccagccatgggggtcctggacgccgcctcggcgtccccgcgtctgccttgggggcccgagtcccgccctgggggtcctggacgccgcctcggcatccccgcgtctgccttgggggctcgagtcccgccctgggggtccccgatgccgcccgggggtcctcacgtctaccttggagactggagttcccccgtgggagtctcggacgccaccccggagtcaccgtgtctagccttgggggcttgagtccagccctgggggtcctggacgtcgccgaggagcccccacgtctgcctttggggcttgagacctgctctgggggtcccggtcgccgcccaggtgggtccccacgtctagccttgggggcttgagtccagccctggggggcccggatgccgcccgggggttctcctcgtctgccttgggggttgggtccagccccaggcgtcctgaccaccgcccaggggcccccacgtctgcctgggggcctcaaattcagtcctgggggtcccggacgcctcccaggggtcttcatgtctgccgtgggcctcgagtccagccgtgagggtcccgaatgctgccttggagggtggagtccagctctgagggtcctgaagtcagctttgggggttcgaacccatccatcccaggggtccctgagtctacattaggggctggagtccagccttgagggtctccactgctgccttgggggcctggatgggatccagcgggtctgagtccagcctcgggagcccctgcggtggagctctgagtggggcaggggcctgggagatgccaggaggatgagagcggcgcccccctggtccaggggacagtaagaggcagccggtctcagagaagctaccccaaaactgttacccgtggtgtgcagagcgtcctgcaaccccagccctcaccaggatttcttgcgtttttcaggaaatcggttgtgattggcatgttccttaagcgtctgcaggaagccgaggcctttttggtatttcaggaggggttgctaacccccctccttgtaggatcggggtatcccagctgctaattcccctcctaacagccctgcagcgcctggattggaggtgtgacaggtggcatttttggcccgaagtccctaggcaggacgggtggctgtagcctgcgcgtttgtgtaaattaacctccctttttagttctgtgaagggagaacgtgattagtttaaaatcacctgcgtgaaagaggctcttgattagtttaaaatcacccacgtgaaaggggctcttgattagcttaaaatcacctgggtgtttcgttttatctcagttggcctctgaatgtttatcctacagcttcctgcaagctccagtctaccttctaagggaataacggggctcgtctttctacgttactttatgtgggagtagttgtaaaacagaatgagggagaccgcggggattgtgcggaaatgtagccaccgtttacatgtcgggaggctgaggtgggaggatcgcttgagcccaggagtttgacaccagcctgggcaacatggtaagaccccttctctaccctcccccccaaaaaaaaaattttagtgtggcatggtggtgggtgcctgtggtcccagctactcgggacgctgaggtgggaggattgcttgagcccaggagtttgacaccagcatgggcaatatggtaagaccccattatctacaaaaaaaaaaaaaaa

SEQ ID NO: 4964 - DNA, 2092 bp, Homo sapiens
cgtaccttcccgaggtgctgctgggagctggctgctggccatagccagggtaggaggactgctgcccgtaagacgattgggagctctggctactgccatagccgccagtcgagccatatccctggggagttgactgagttccatagcctgctaccaggataagaaaaagggagtcacaaaagccaccaggaaagagaaaatgtaaggaatgggttaaagaaaacataatacctatactcataaagccagcctctcagaagctgttagtgatgttgcaactcataggcaaagatagttaccctcctttcaaagcctaaatttaatgcttcaacttctaccaactctttagtacagttccaatttcaccccgccaatcccaacaccatctccagcaccaccctctaaacccaggcccaaggatccctgttaacagcactgtaatatgcagctgtgcgtgcagtatctacaggacaaccacctttcttagttacacttcaggaccttggggcaaatcccacctccttatgtatcacatgatttcatacattttcaaacaaaaccattttctccatttcagaattggcctaaaactggttcttcctttagaaaatatgctctctttcatgctgatggaaaataagaagagtcaaaaaaattaaaagccaaagaaaataaatggaaacagaatcacaaaccaataaacatttttgttttttgtttttttttttatgtttttgagatggggcctcaacacactgcccaggctggaatgcagtggctgttcacaggcaccatcatagctcactgcagccccaaactcctgaattcaagggatcctcccgcctcagcctcctcagtagctgggactacaggtgtgccacaatgccctgtaaaggactcagatcccaaaaagttttaagacttatacactgtttcacggaaaagaaatatggaacagtttcaacatctcagtgctgctcaggtttaagaaaagcaacattcagggcattgtggctgacgcctgtaatcccagcactttggcaggtcaaggcaggcaggaggtcaggagttccagaccagcctgtccaacacggtgaaaccccatctctactaaaaacacaaaattagccaggcgtggtagcaggtacctgtaatcccagctactcaggaggctgaggcaggagaatcgtttgaacccggtaggctgatgttgcagtgagctgagacagcaccactgcactccagcctgggcaacaggaccagactccgtctccaaaaaacaagaaaaagaaaagcaatattcagaaagagtaggaagaggtgacccgctgagaaagactcactgttctggctctggccataagaagaatagctgctctggccatagcctgaagtgtccgtggactggctataaccactgtaactctgctgtccgtagggctgactgctctgctgggaatagccctgcccgggctgggtggggtaggccccatagctaaataaaaggaaaaccagcgtgatcagaaaacatggcgtgaccacccttgccctctacaaactctggaagcccaaaaatagcactcacctttgggttgcttgttgggtataatctgcaaaagaaaaatacaatcacattatcttcagctgccactctgaaagagttgaattaaagctaaattccttaactcaagcactgatgaataaaaaggaccacgtaggccaggcacggtggatcatgcctgtaatcccagcagtttgggaggccgaggtgggtggatcacttgaggtcaggaattcgagactggcctgaccaacatggtgaagccccatctctaataaaaatacaaaaaattagccgggcatggtggcgcacgcctgtaatcccagctactcgggaggtgaagcaggagaatcgcttgaacccgggaggcagaggttgcagtgagccattgcactccagcctggcaacagagcaagactccatctcaaaaaaaaaaataaaaataggaccatgttgcaacaaagggcataaaattcctccatgagacactggttgagaagaggaacaaactggcgttatcagccaagtgtt

SEQ ID NO: 4965 - DNA, 4100 bp, Homo sapiens
aattccagggaatggagctagtcatgccacacatctttgctgttttcacgaactgaggtaatttttatttttatttttatttttttgaggaacagtcttactctgtcacccaggctgcagtgtagtggtgtgatcacagctcactgcagccttgacctcctgggcttaggtgatcctcccaccctagcctcccatgtagctgggactagaggtatgtgccacctcacctcctttttttcttttctttttcttttttggagagacagattcttcttatgttgctattttaaactcctgaactcaagtgatcctcctgccttggcctcccaaagtgctgggattacaggtgtgagacactgcaccctgcccaagcacctctgctccgtgccatgctcttggctaattggagttgtgaaaggcatgaggattctggtcatggactcagctctcccatagggttctgacaccaaagcaatggtcacaacagtgaaaggaagaatccatctggccaggctcaggtggttcaaggccttcagaatctgccttgagactctcactggctttagactgaaaaccatcttggccccgtccatccgtgtaagcaatttaacgacagcttgcaaagcaccgagctttaacagaaagaagagatgagcacagcgcaagaacttggactccagaagagctgcctaacagattatttttctgtggcatttcatgagaacaaacgaagtaggaattttccttttgtttgtctggcctttggcatcgtttactttctttttattcttctgaaatgtacttcgagccctggcagcatttctgtcctaaaatcttattgtcagaggtttatttttcagcttttcaaatcatatctgatagagtgagtgtactgcctggactcatcactttacttcagaagaaatacagctcaccctttaaatgacaatggtgactgtccacatctttatgttttctacactgaagtggcaggcttcatttaaaaataatgttttccctcatcaaaagagagctagggtagaaccgtcaactctgctgttgtctgggtagtgacctaacacccacgttttggacaatcactcactgtcttatattgggttttcattgcatgtaggataattctttgtcaatggtagttttgtcaaccgtgatctgaggtaatgaggttttctacttttgcttgaaattttgaaaatatgcaagctttaaacatttgcaaagttggattctgttttctttagaaagcaatctgatttgctgatattctctccatctgtcaggggatgcgtgatgtggtgtagacttaatgtgctgcctttctggaacatggacagagtagcagcacagaaaaatgagcatttcagctctgtgatgatttgtgaaaaaaaatctcagatcattgagcaggcattttgctgacacctgtgaaaagtaaccacatgagagagcatggcgtgatggtcggaggccacgtgctggagctggactgcttgagtcaaatcccagctgctcagctgtagtgaactgaatggtggtccccaaaagatacatgtatctcctaatccctggaacctgtgaatgtgaccttattaggcaaaagggtctttgcagatgtaattacattgaggctctcagagatgagaacatcctggattatcagggtgggtcctatatccaatgacaagtgtctccttataggagacagaagaagttgcagacccggaagagactaagtaaagatggaggcagagactggagtgaggctgctgcaggccaaaaatgcctggtgccagcaaaagctggaagaggcaaggaaggacctttccctggggcttttggagggagtgcagccctgctgatgccttagtgttggatatctgggctatggaactatgagagagaaacttctgttgttttaagccacctagtttgtggtactctgttatggcagccacaggaaactaatacactctttaccacctgagtgaccttggccaacttacttaacctccatgaatcagtcccctcaaaggaccaccctccccccagggtcactgtgatgataaagtgctttagcataggtgactggtttagaccagggcctggtacctagcacatgctatgccagtgtttctatcatggcagcagcagatgcagtggagcttagatttcaactgtgtccatgctggttagaaaagtcacagtctgggacacaggacacttctggaagaatctccctcagtggatcccagtgttccagcaatgttttccaagcagctgaagaacaggaagcaggaacagggttccctacaagagccattattcagatgcctctacatctgactggtttcggagaagtgtgacttctggaggtttatgtgctgggactttaacagcatacgtactaaaaaccacatttatgtttcctcaaatgctgggctctctatgagccttgacctgcctgagaagattagaggcggctgcctaatctgatcagtcaactcagtgaaacaactgcattgattaaagccataagatgttaggattctctgttcttggtggcctaaaaggtcccattcctttcccaaagtgcttagcttgatcccatcccagggaacaattttgggtggaggagaacctggccacagatcataagatcatgtatgactaagtctacttgccttcatggaaacatacatggagttttgggcaatttctttgaagcccctctagaggcttctaaagattgtttagtgccatctggtttttaatcctggatgtcaaacttgttgatttttgccctggaccatctgtttttcaacttcccacggaacctttcctttgggccaagtagggaaagaaatactatatttttaattctttttgttttgccttctcatcccagtcacagcattagaaagggaaaatcgactgtctgacaaagctctgaaagactggacatgaagtgctggccttgctatctgcagggcatctccctatagattggataccttttccttcactctctgataaaaagtgagacagactgagcatagtcctgtgaccatttaatgcctgtgcccagaacatgggtctgtaccacttgcaggagtcacagtggggaggagcagggaccttggggtctgcctgcctctgtctgaattccagctgagcccattcctaggccagtgcctgggaaagttatctgacctctgagatccagtctactagcctcacaagtgagactgtgacaacacttacctcaatgaggcactggacatcatctcatttaatcctcaacatgcctcagtgtccagcatttaacaagctcccataaacattagttactctcattccttaatatgaatagcatttaaaataataaagtgggagagagcaatgctgcatgccctacaactggccagagagcttgcagcaaggagaatgcttaggtggaacatacaggccttttctgtgttcatcccattccaaaggatttggtgttgccatatatggaacatgaagattagaaatggccatttccaaactggtgaatcccttggtgcctttttctccattgtgattcatccggggtaccctcagttttcagtggtcatggtcattccaaaccagccatgagctgggggaacattgtactgtggtaaacccagggccacctgaccagagcttctccaattttataaacccaagttgtaggtgggatgatggatgcaggcttccctggcaaatgcttcctgggcattgtagacactgtcacttctagggggctgcagttgcctcattgtataattctggtcatcagaaaggaggcagtaatggatgagctgcccttctggacaaaatgacatctctcttattgaaaaaggctaagaagctattttcttttccccctctgcaaccactatttattgcatgagatttcagaatgatgatgataaaaaagcaagtttatagagacatcatgaggttgtgtaaataaaataaagtaatatctgggacagatataccaaagaaaattgaacccaaaatgtctaactttgcagtccatactcagccag

SEQ ID NO: 4966 - DNA, 711 bp, Homo sapiens
tgcattccacaagtatttattgatcttactgcataccaggccctcagatggggacacagccacgaatgaagcatggtccctgctaccacaaggtcctcttcacttacacacacactgaggactactgcttcgtcacgctttccgaagcagctgagtggggctatgtaagtgaccttgcagatgaagtcgccacctgcaagaactcacaggtgagaacagagggtggccaccaaaaggtcactgaactcccccgagaaaactgttgagccacacacatgtccaactttccaggtccaagacatactgcagtactgctttgtaatagccaccaggtgcaaagccaggaagaaccagagggaaacaggtttttctcacatgagggaagagcagcctgcatcacttaatggttggactgagttaatgcaggacttaggcctcttaaaaggcaacaatgagaacccttacttggacccactccccaccacggttgatctctcattatgctgagcatatctcttggaaaggggcagggcgggcgcggtggctcatgcctgtaatcccagcactttggaaggccaaggcaggcagcagaagagttcagacaggaaatttctctctgtggcataacacaaatggaaagaaaaccactaggggacacacaggaagaaataaggtttctgtttcttcctcaagtgtcccaagtgccatggc

SEQ ID NO: 4967 - DNA, 545 bp, Homo sapiens
atgactgcatccaactcgcaggtgcgccagaactaccaccaggactcagaggccgccatcaaccgccagatcaacctggagctctacgcctcctactttaacctctccatgtcttactactttgaccgtgatgatgcggctttgaagaactttgccaaatactttcttcaccaatctcatgaggagagggagcatgctgagaaactgatgaaactgcagaaccaacaaggtggctgaattttccttcaggatatcaagaaaccagactgatgactgggatagtgggctgaatgtgatagagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaacgtgaccaacttgcacaagatgggagcacccgaatctggcttggcagaatatctctttgacaagcacaccctgggagaaagtgataatgaaagctaa

SEQ ID NO: 4968 - DNA, 435 bp, Homo sapiens
ggagcaggagccggagccctgaggttcggggccgagaccccggccccgcgccccggccccggcgggtgtgcgcgctctcccgccactgcccggcgcccgcgaccatgctccgcggttgggaggcaggaacccaggcacccagcgatccccggatagcctctcccgggccgggctggtattgagatcaaggcgtccaggatcaaaagatcaccgcctgcccgccccctctgcatctccaactggcgagcaggaggacccccatccacacaacgaccctgacctggtcatggcgtccagctccggcctggcgtgaggaccccccaatccgcgtgagggagcccccaacccagaccacacccttgagcctgagcccgacattattcctgaggtgagaggtctgtgtgcccctgtgtgtccctctcagcctccctgatt

SEQ ID NO: 4969 - DNA, 2089 bp, Homo sapiens
atttctccctgcctttgcctgggcttgtcctgaagcctgctcatgggaacagctggaaagaaccatgtgctgccagtctgagctttttattttgttttacttagaaagatagagacagggtcttgccatgttgcccaggctggtctcgaactcctgggctcaagtgatcctcctgcctcggccttccaaagggctggggttacaggcgtgtgccaccgcactcagccgcagccagtctgttttcaaagatggtctttgggttaatgacaattctctctctgcttactctccaggcagtgtggctttctgaatccaaggaggctgggcatagggagatgggatttgtttgcccggtttggactcagcattttttgtactcgatttaatagactcataaaatgtcaaaggtttaagtgagcttagagttgatctggcccaaacctggctgatcagaatctccaggggaagttttattgaaatgccagatctctgcgttctgagatcctgatttagtaactccagggttggaacctgagttttttgtttttttgtgtgtgtgtgtgaaggcaaggtcttactctgttgctctggctggagtgcagtggtgtgatcacagctcactgcagccttgaattcctgggcctaagcaaccctcttgcctcagccttccaagtagctgggactccgggggtacaccactgtgcccggctaattttaaatgtttttgtagagatgggatctcactatgttgcccaggccagtctcaaactcttgagctcaagtgatcctcctgccttagcctcctaaagtgctgggattacaggcatgagccaccgtgcctggctgatactagcattcttttttattttttattatttttttaagatagagtcttgctctgttgcccaggctggagtgcagtggcacagtctcagctcagtgcaacctccgcctcccaggttcaagcaattctcctgcctcagcctcccaagtagctgggataacaggcacatgccaccacgcctgcgcttgatcgtgggaggcagagcttgcattattgtgccactccattctagcctgggcaacagagcgagactctgtcttccaaacaaagcggaaaaagattatctgcgagaatgactgcattggccccttgggtgggagggcttctccagggcaaggtgaggggatgcccagtgctgggagtgctgcctggagaggagtcagttccagtggcgggggccctgggttttggctgaggactgcgtgttggcagctgctctgcctctcacagcccttcccagctgcacacgtcgtgagcgtcagtgtgcaatcacaggcctgcctcctttgggccactttgtgaccatgttttttgcttgtggggcagggtaatttcaggatctaaattggtgcagttggatgttctcagccccgagaggcagctcttcccgttctaggctttttgttttgttttgtagaaatggagtcctacgacgttgcccaggctggtctcaaactcctgggctcaagtgatcctcccaccttggcctcccaatgtgctgggattacaggcatgagccactgtgccgtgctgattttcttgatactattttttgtagagctggggtcttgctgtgttgcccaggctggtctcgaactcctggccacaagccaccctcctgcctcagcctcccagagtgctgggattacatccccttcttaccttctctgtcagaggagcccccacagcatgtgagtactgagtcatgcggtcttgtggttgctgaacgggctctgctgctctggtcctaggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggcttcaccagattgtatatattcctaccagatggagataattacagctttaaaaatttttattttttcattttatttcacacattgacattaaatttttatggacacat

SEQ ID NO: 4970 - DNA, 1467 bp, Homo sapiens
tgcctcagcctcctgagtagctgggattacaggcatgtaccaccatgcctaattttttttttttttttttaggagggatggggttttgccatcttggccaggctggtctcaaactcctggcctcaagtgatccacctgcctcagcctcccagagtgctaggattataggcatgagccactgtgcccggccacgggctggactctttagccagccccaaatcccagccacatgactttggctgggtcactcctttgaggcacgaagaccacgtcacttggttgcatgcttgggtgcccagtgggacaggtatgagaagacccactcaagagtggtgagaaagaaggctggctaggaacccaggtggggcaggttgtctgcacgttatggctattatgagcagtgctgctatggacatttacatgtacgcacgtctttctgtgagtatatgttttcagttttcttgccttttttttttttttttttttttttttaagacagagtctcagtctgttgcccaggctggagtgcagtggcacgatcttggcttactgcaacctccacctcctggattcaagtggttctcctacctcagcctcccaaatagctgagactccaggcatccaccaccacacctccctaattttttgtatttttagtacagacagggttttgccatgttggctacgctggtctcaaactcctgagctcaagtgacccgcctacctcagcctttcaaagtgctgggattacaggtgtgagccactgcacgcagccatgttttcagttttcttgagggagattcctaggagtagaattgctgggctgtgtggtaacttccaggcctccttaaagctttagcctggactgggtagagcatggtttccactgcattctcttagtcacagtgagttgcaggttcaccccagcgtcagtggcgggcgggaagtggggatgacacaaggacctgagtgtccaagggggcttcatggagccctcatgtgaagtccccagcatggaccctgacacatcgtaggtcctcaacaaatgtcactccctgttgtcactctgtttagtactaagaataatgatataaaactgggacagtaaggaaaacacaaactgttgggacctatatctgaatctattagtctgcctaatagaaaagccaccatcaggattttggagattacaagctcactttagattagccatactggagtcagccctggaggctcccagagatcagaacaatcccagcgcttgacaggatggctgggaaacaatacatatgaatgccggaaaatgcagaactaatctaggaaaaagtgtaagaagaaaataaacatcatctgtcattctatctatcagagataactgctgtcaatattttggtttccttccaatattttttctattcactctgtgcataagtatgtatattttaataaaagtataattaagatcac

SEQ ID NO: 4971 - DNA, 2183 bp, Homo sapiens
tttctgtagagccggcgttttgccctgttgcccaggagtttttcctttaatgttctcctgctacttactaattcactttgtcaccctgtgagctcataagagcagagagatagcaacaggagctaaaaaaactctaagctgtgaaaaaatattaaatatgaaatcatgatagctattagcttaatttgttttaggcaaattgcaaagtaattttttgggaatcagtgtcccactgcagtgattccatatggggattcctaattcccagtatgtttttaaaataatttgtaaacacctagtacaaacgcatgatatgaaattcaagaggtgggaggatcacctgagcccaggaggttgagacttgcagtgagctgagttcacaccactgcactcgagccttgatgacagaatgagactgtctcaaaaaaaaaaaaaaaaaaaaattgtccttaagtccatgtggacccctgactaggtttgtgccctagacagccttcctctgagggcagttcaggtggtgagactccagctttaaatggcctctagagaaatttcactaacctgccttggtgtttgaccctgtataacccctttcttctggaggtccctttgggtggcagtagatacgggatttggtgtctgacagctctggggacagatcccagctccaaatggcagagtctctacagattacaagccaaatacttagcactatgtgctgatcttcaggaagtcagtctatatttcataacaagtcacatggggataatgaaggaatggcctaaaatgctctcagtaatattcctgagtcatccctcagggctaggcttggtgttaggcatggcggggaagggagcagagctgtgtgcagaggaagatgcagttcttgccttgtcagggtccctgacctgatggcgacccatggtggagtcttcatagtgacagacaccactgtaaaagcagatccaggttgtgcaaccctcaaagcaggtctcctcactcaccgggatagatagactattggccgtacctgcatccaccgcttgccatggtttcgttgtgggtggaggatactttcctgtcccctggctttgggtttgcccacgtggcttgctctggccttggaatgaagcagaaacgaaaggctgccagttccgagcccacgtctgaagtcgccttaggtggttccgcgggccccgtgcgctcccaccttcacccagagggccttctctggtgcagccgctgcttcttcagcctccgcccaaaaggaacggagccccctggccgatccgcaggcctacagggagccacagagcgcagcggctggaccagcgttcaagcccaagcacaggcctgcgagaaccttgttccagccgccgtttaggatggttgattaggacgcgttgcagtggcggtagctcaccaatccagtgcgtgcacccgctcctttattaggctatagagccagtggctcccacagggacctgatacaacagtgcgttaaataaggagcatattgagctctcatgtcgtaagccagtggagaagtccagggctagtgtgggggctccggcgggggctgtggcccccatccgcatggagcctccccatggttcacaggtctcagtcttcggagccttcggccctgcgagcccgaacggtccacagggcggcgccagaccctctttcgaacgccatcctctaaagcctcggctccaaccggttccacttcttcaggctcaggattttcactcttctcgaatgggggtggccctcccccaatcttctgagtcgcaacagcatctccctccctccaggacctcagagccagagctgggcgagaggccctgacctccggggtagggtggaagcgtccctgtgaaggtgcagtcctgcctcccatccccaggcgccgggcctctcccaccctcagcgccctgctcacctccagctgaagatgccagggcacctctgcttcctccctgccctctctgcagtaccgccgagtgtgcataaaagggtttaatataggctttgccgggcgcggggactcccacctgtaatcccagtacgttgagagaccaaggcgggaggatcacttgaggccaggagttcaaaaccagcctgggcaacaaagtgaggcccgtctctgaaaaaaaaaaaaaaaaaaaaaaaagaataaa
